US011931400B2

(12) United States Patent
Apte et al.

(10) Patent No.: US 11,931,400 B2
(45) Date of Patent: Mar. 19, 2024

(54) THERAPEUTIC AND DIAGNOSTICS COMPOSITIONS TARGETING TOLL-LIKE RECEPTORS AND METHODS THEREOF

(71) Applicant: PSOMAGEN, INC., Rockville, MD (US)

(72) Inventors: Zachary Apte, San Francisco, CA (US); Jessica Richman, San Francisco, CA (US); Daniel Almonacid, San Francisco, CA (US); Melissa Alegria, San Francisco, CA (US); Valeria Marquez, San Francisco, CA (US); Eduardo Morales, San Francisco, CA (US); Rodrigo Ortiz, San Francisco, CA (US); Janet Torres, San Francisco, CA (US); Paulo Covarrubias, San Francisco, CA (US); Javier Gimpel, San Francisco, CA (US); Ingrid Araya, San Francisco, CA (US)

(73) Assignee: PSOMAGEN, INC., Rockville, MD (US)

(*) Notice: Subject to any disclaimer, the term of this patent is extended or adjusted under 35 U.S.C. 154(b) by 140 days.

(21) Appl. No.: 15/914,925

(22) Filed: Mar. 7, 2018

(65) Prior Publication Data

US 2018/0311310 A1  Nov. 1, 2018

Related U.S. Application Data

(60) Provisional application No. 62/536,924, filed on Jul. 25, 2017, provisional application No. 62/468,286, filed on Mar. 7, 2017.

(51) Int. Cl.
| | | |
|---|---|---|
| *C07K 14/00* | (2006.01) | |
| *A61K 38/08* | (2019.01) | |
| *A61K 38/16* | (2006.01) | |
| *G01N 33/68* | (2006.01) | |

(52) U.S. Cl.
CPC ............ *A61K 38/164* (2013.01); *A61K 38/08* (2013.01); *C07K 14/001* (2013.01); *G01N 33/68* (2013.01); *Y02A 50/30* (2018.01)

(58) Field of Classification Search
CPC ..... A61K 38/164; A61K 14/001; A61K 38/08
See application file for complete search history.

(56) References Cited

U.S. PATENT DOCUMENTS

| | | |
|---|---|---|
| 2009/0028889 A1 | 1/2009 | Nakaar et al. |
| 2015/0011532 A1* | 1/2015 | Paidi .................. C07D 413/14 514/210.21 |
| 2015/0213193 A1 | 7/2015 | Apte et al. |
| 2016/0110515 A1 | 4/2016 | Apte et al. |
| 2016/0224748 A1 | 8/2016 | Apte et al. |
| 2016/0232313 A1 | 8/2016 | Apte et al. |

FOREIGN PATENT DOCUMENTS

WO   2016/177797 A1   11/2016

OTHER PUBLICATIONS

EPO, Search Report of 18763116.3 dated Feb. 4, 2022.
Hubert Plovier et al.: "A purified membrane protein from Akkermansia muciniphila or the pasteuyrized bacterium improves metabolism in obese and diabetic mice", Nature Medicine, vol. 23, No. 1, Jan. 1, 2017, pp. 107-113.
Meng Xuan-Yu et al: "Molecular Docking: A powerful Approach for Structure-Based Drug Discovery", Current Computer-Aided Drug Design, , vol. 7, No. 2, Jun. 1, 2011, pp. 146-157.
Liang Shuang et al.: "Mapping of a Microbial Protein Domain Involved in Binding and Activation of the TLR2/TLR1 Heterodimer", The Journal of Immunology, vol. 182, No. 5, Mar. 1, 2009, pp. 2978-2985.
International Application No. PCT/US2018/021404, International Search Report and Written Opinion, dated Aug. 29, 2018, 12 pages.
Koivunen et al., "Identification of Receptor Ligands with Phage Display Peptide Libraries", The Journal of Nuclear Medicine, vol. 40, No. 5, May 1999, pp. 883-888.
Ottman, "Pili-like Proteins of Akkermansia Muciniphila Modulate Host Immune Responses and Gut Barrier Function", PLOS One, vol. 12, No. 3, e0173004, Mar. 1, 2017, pp. 1-18.
"Uncharacterized Protein of Gene Amuc_1100", Uniprot Database Entry B2UR41, Available at: <https://www.uniprot.org/uniprot/B2UR41>, Jul. 1, 2008, 4 pages.

* cited by examiner

*Primary Examiner* — Jeanette M Lieb
(74) *Attorney, Agent, or Firm* — LEX IP MEISTER, PLLC

(57) ABSTRACT

Therapeutic compositions and an associated method for improving a Toll-like receptor (TLR)-related condition, including determining a set of peptide sequences associated with a microorganism-related modulator of a TLR, determining a first set of binding parameters for the set of peptide sequences in relation to the TLR, selecting a target subset of peptide sequences from the set of peptide sequences based on the first set of binding parameters, reengineering the target subset of peptide sequences based on mutating amino acid residues of the target subset of peptide sequences, determining a second set of binding parameters for the reengineered target subset of peptide sequences in relation to the TLR, and identifying a first peptide for use in a therapeutic composition for improving the TLR-related condition, based on the second set of binding parameters for the reengineered target subset of peptide sequences.

12 Claims, 4 Drawing Sheets

Specification includes a Sequence Listing.

one or more instances (e.g., for determining a plurality of components of a therapeutic composition; for refining a therapeutic composition; etc.)

identify modulator S110 modulator (e.g., *Amuc_1100*)

TLR2 determine peptide sequences associated with modulator S120

S130 identify target peptide sequences for reengineering

ADQAPW
PPPIANP
WLGFQVY
FSPPAPI
DFTIFPP
HTPAIFA
AARLTPFSPP
LETAYKPF
AAPAAPAIQQ
HFNQPKAQEP
...

n[X][Z][B]APWn
nPP[X][Z][B][O]Pn
n[X][Z][i][O][B][J][f]n
n[X][J]TAYKP[B]n
n[X]A[J][B]AP[Z][i][O][U]n
nH[X][J]QP[B]AQEPn
n[B]AR[X]TP[Z]SPPn
nF[X]PPAP[J]n
nDFT[X]FPPn
n[X]TPA[J]F[B]n
nXXGFXLKXXn
nXXTPA[ND][NE]XXXn
..

S140 determine binding parameters for reengineered peptide sequences (e.g., apply molecular docking techniques)

extract peptide sequence motifs generate and/or deliver therapeutic composition S150

FIGURE 2

THERAPEUTIC AND DIAGNOSTICS COMPOSITIONS TARGETING TOLL-LIKE RECEPTORS AND METHODS THEREOF

CROSS-REFERENCE TO RELATED APPLICATIONS

This application claims the benefit of U.S. Provisional Application Ser. No. 62/468,286 filed 7 Mar. 2017, and U.S. Provisional Application Ser. No. 62/536,924 filed 25 Jul. 2017, which are each incorporated in its entirety herein by this reference.

INCORPORATION BY REFERENCE OF SEQUENCE LISTING

The Sequence Listing written in file 101215-P30US-0035327_SequenceListing.txt created on Jul. 11, 2018, 9,277,776 bytes, machine format IBM-PC, MS-Windows operating system, in accordance with 37 C.F.R. §§ 1.821- to 1.825, is hereby incorporated by reference in its entirety for all purposes.

TECHNICAL FIELD

This invention relates generally to the field of therapeutics and diagnostics, and more specifically to new and useful therapeutic and diagnostics compositions and associated methods related to detection and/or modulation of toll-like receptors.

BACKGROUND

Toll-like receptors (TLRs) such as TLR2 are integral membrane proteins involved in the functionality of the immune system and/or other physiology. As such, TLRs and their associated mediation of immune responses can have key roles in pathogenesis, the development of, and/or the treatment of TLR-related conditions. For example, TLR2 is involved with hydrocarbon absorption and metabolism (e.g., through regulating expression of Cytochrome P450, family 1, member A1 for detoxifying carcinogenic polycyclic aromatic hydrocarbons, etc.), and has been implicated in immune disorders, metabolic disease, and other TLR-related conditions.

Recognition by the innate immune system is mediated by receptors from different protein families, that is, they are diverse in terms of their sequence and structure. These receptors recognize pathogen-associated molecular patterns (PAMPs). PAMPs are molecular structures present in a large group of microorganisms which have molecular patterns but not a specific structure. That means that these molecular patterns do not display antigenic variability and might be products of microorganism metabolism. On the other hand, the immune system also recognizes damage-associated molecular patterns (DAMPs). DAMPs are endogenous molecules for example, molecules associated to cellular stress or molecules related to tissue damage. In this regard, both PAMPs and DAMPs can be recognized by TLR protein family. In particular, TLR2 recognizes a broad variety of PAMPs and is well-known for forming a dimeric functional structure, as homodimers (e.g., TLR2-TLR2) or even heterodimers with other TLRs (for example, but not limited to: TLR2-TLR6); and thereby increases its range of detection. For example, TLR2 and TLR6 can form heterodimers for detecting bacterial molecules such as peptidoglycan, even when TLR2 can also detect bacterial lipopeptides by itself without TLR6. In another example, TLRs (e.g., TLR2 and TLR4) can regulate an individual's inflammatory response to microbial-related oral conditions including periodontitis, where inflammation of the tissues supporting the teeth can lead to tooth loss. Given the importance of TLRs, modulators of TLRs (e.g., ligands binding to a TLR) or any other molecule potentially able to bind a TLR can help to diagnose and/or treat TLR-related conditions. However, TLRs can be bound by a plethora of different types of ligands. For example, TLR2-binding ligands can include non-acylated peptides and proteins with varied structure and origin. In other examples, TLRs can be bound by ligands derived from a variety of taxonomic groups including archaeal, bacterial, fungal, viral, and/or any other suitable microbiome agent. The number of potential modulators of TLRs can thus be staggering, given that the human microbiome includes up to 10 times more microbial cells than human cells. Further, identification of effective TLR modulators (e.g., modulators derived from microbial products) can be challenging given that the characterization of the human microbiome is still in nascent stages due to limitations in sample processing techniques, genetic analysis techniques, and resources for processing large amounts of data. Nevertheless, TLRs and microbial-related modulators are suspected to play a role in a number of health/disease-related states.

As such, there is a need for therapeutic compositions (and/or processes of identifying such therapeutic compositions) capable of precisely modulating TLRs and/or other suitable receptors in order to improve TLR-related conditions and/or other suitable conditions in patients.

BRIEF DESCRIPTION OF THE FIGURES

FIG. 2 is a schematic representation of variations of embodiments of therapeutic compositions and a method for facilitating diagnosis and/or treatment of a condition (target sequences identified for reengineering=SEQ ID NOS: 198, 693, 35253, 35269, 35271, 35283, 35303, 37718, 35803, and 35839, respectively; extracted peptide sequence motifs=SEQ ID NOS:6-245, SEQ ID NOS:246-693, SEQ ID NOS:694-35253, SEQ ID NOS:35304-35323, SEQ ID NOS:35324-35803, SEQ ID NOS:35804-35839, SEQ ID NOS:35284-35303, SEQ ID NOS:35254-35269, SEQ ID NOS:35270-35271, SEQ ID NOS:35272-35283, SEQ ID NO:1, SEQ ID NOS:2-5, respectively).

DESCRIPTION OF THE EMBODIMENTS

Figure 1:
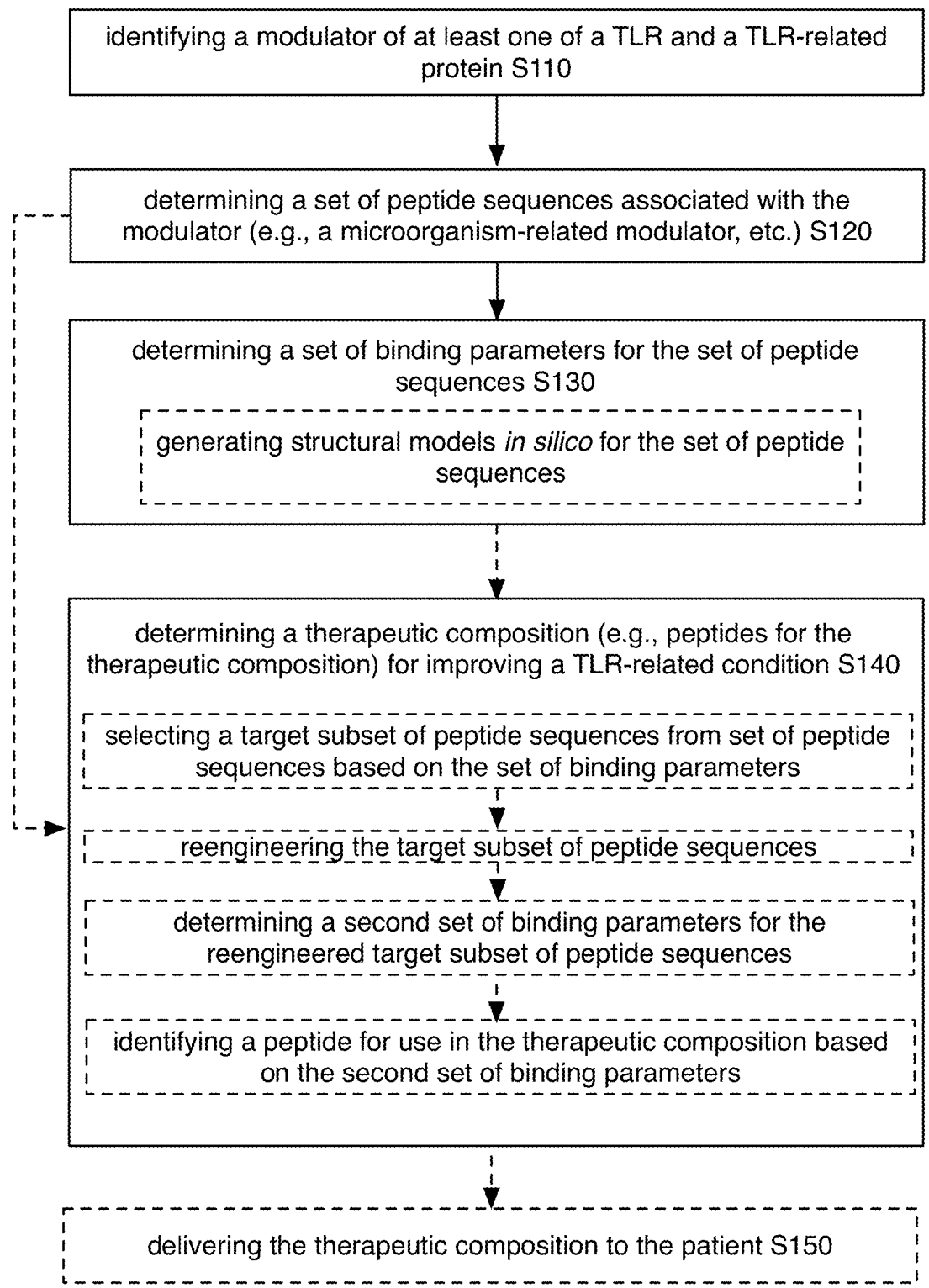
FIG. 1 is a flowchart representation of a variation of an embodiment of a method for determining sequences operable to facilitate diagnosis and/or treatment of a condition.

The following description of the embodiments of the invention is not intended to limit the invention to these embodiments, but rather to enable any person skilled in the art to make and use this invention.

1. Overview

Embodiments of therapeutic compositions for improving a Toll-like receptor (TLR)-related condition can include one or more peptides, such as configured to modulate TLR-related functionality and derived based on reengineering of a target peptide sequence associated with a microorganism-related modulator of a TLR, where the one or more peptides can correspond to peptide sequences derivable from at least one motif of a set of peptide sequence motifs (e.g., where letters in the motifs that are not explicitly defined can correspond to amino acid types defined in Table 12 below and/or can correspond to any one or more of natural amino acids, non-natural amino acids, L-amino acids, D-amino acids, Homo-amino acids, Beta-homo-amino acids, N-methyl amino acids, Alpha-methyl amino acids, unusual amino acids, etc.) including a first motif including XXGFXLKXX (SEQ ID NO:1), where X in the first motif includes any amino acid (e.g., natural amino acids, non-natural amino acids) or no amino acid (e.g., where X is deleted, where one or more mother molecules are inserted, included, and/or otherwise added, etc.); a second motif including XXTPA[Z][B]XXX (SEQ ID NOS:2-5), where X in the second motif includes any amino acid (e.g., natural amino acids, non-natural amino acids) or no amino acid (e.g., where X is deleted, where one or more mother molecules are inserted, included, and/or otherwise added, etc.), where Z in the second motif includes at least one of (N,D), and where B in the second motif includes at least one of (N,E); a third motif including [X][Z][B]APW (SEQ ID NOS:6-245), where X in the third motif includes at least one of (I,F,W,Y,A), where Z in the third motif includes at least one of (D,A,Q,E,G,H,I,L,F,P,T,Y), and where B in the third motif includes at least one of (Q,L,W,Y); a fourth motif including PP[X][Z][B][O]P (SEQ ID NOS:246-693), where X in the fourth motif includes at least one of (Y,P), where Z in the fourth motif includes at least one of (W,Y,F,A,V,C,T,L,S,H,Q,E,G,I), where B in the fourth motif includes at least one of (W,I,F,P,D,G,C,A), and where O in the fourth motif includes at least one of (G,N); a fifth motif including [X][Z][i][O][B][J][f] (SEQ ID NOS:694-35253), where X in the fifth motif includes at least one of (G,Y,W), where Z in the fifth motif includes at least one of (W,V,I,F,R,M,S,L), where i in the fifth motif includes at least one of (I,G), where O in the fifth motif includes at least one of (Y,P,H,L,F), where B in the fifth motif includes at least one of (I,D,Y,F,V,T,G,A,Q), where J in the fifth motif includes at least one of (F,R,C,L,A,Q,D,V), and where f in the fifth motif includes at least one of (F,Y); a sixth motif including F[X]PPAP[J] (SEQ ID NOS:35254-35269), where X in the sixth motif includes at least one of (P,S), and where J in the sixth motif includes at least one of (P,Y,L,A,E,G,V,I); a seventh motif including DFT[X]FPP (SEQ ID NOS:35270-35271), where X in the seventh motif includes at least one of (V,I); an eighth motif including [X]TPA[J]F[B] (SEQ ID NOS: 35272-35283), where X in the eight motif includes at least one of (Y,T,H), where J in the eight motif includes at least one of (H,I), and where B in the eight motif includes at least one of (Y,A); a ninth motif including [B]AR[X]TP[Z]SPP (SEQ ID NOS:35284-35303), where B in the ninth motif includes at least one of (P,A), where X in the ninth motif includes at least one of (A,P,W,N,L), and where Z in the ninth motif includes at least one of (P,F); a tenth motif including [X][J]TAYKP[B] (SEQ ID NOS:35304-35323), where X in the tenth motif includes at least one of (W,L), where J in the tenth motif includes at least one of (A,N,S,W,E), and where B in the tenth motif includes at least one of (S,F); an eleventh motif including [X]A[J][B]AP[Z]I[O][U] (SEQ ID NOS: 35324-35803), where X in the eleventh motif includes at least one of (N,W,A), where J in the eleventh motif includes at least one of (F,N,Y,P), where B in the eleventh motif includes at least one of (P,H,Y,W,A), where Z in the eleventh motif includes at least one of (Y,A), where O in the eleventh motif includes at least one of (W,Q), and where U in the eleventh motif includes at least one of (R,Q); and a twelfth motif including H[X][J]QP[B]AQEP (SEQ ID NOS: 35804-35839), where X in the twelfth motif includes at least one of (E,G,W,F), where J in the twelfth motif includes at least one of (G,A,N), and where B in the twelfth motif includes at least one of (H,W,K).

In examples, therapeutic compositions can include one or more peptides including at least contiguous amino acids derived from at least one of a set of peptide sequence motifs including: XXGFXLKXX (SEQ ID NO:1), and XXTPA[ND][NE]XXX (SEQ ID NOS:2-5), where the notation "X" can indicate any amino acid, a defined set of amino acids, or no amino acid; the non-X letters indicate at least amino acid types described in Table 12 below; the bolded letters can indicate amino acids conserved between the peptide sequence motif and the peptide sequence upon which the peptide sequence motif is based (e.g., peptide sequence of a peptide of microbial-origin) and the notation "[ ]" can indicate additional or alternative amino acids that can be used. In examples, the therapeutic composition can include peptides derived from a peptide sequence motif of xGFXLK (SEQ ID NO:1), where the notation "x" corresponds to any amino acid, but preferably hydrophobic residues (e.g., F, Y, W), and the notation "X" can indicate any amino acid (e.g., natural amino acids, non-natural amino acids) or no amino acid (e.g., where X is deleted, where one or more mother molecules are inserted, included, and/or otherwise added, etc.). In specific examples, the therapeutic composition can include one or more peptides with sequences of any one or more of sequences described in Table 1, peptides with sequences corresponding to any one or more sequences in the Sequence Listing, homologous sequences to sequences described herein, and/or any other suitable sequences described herein (e.g., derivable from peptide sequence motifs described herein, etc.). In another example, the therapeutic composition can include one or more peptides derived from one or more microorganisms, and operable to bind to one or more TLRs (e.g., TLR2). In other examples, the therapeutic composition can include one or more peptides with sequences of any length and/or identity percentage to any of the sequences herein (e.g., including peptide sequences derivable from peptide sequence motifs described herein, such as including the residues in bold and maintaining each position pattern, etc.) but the therapeutic compositions can include peptides with any suitable percentage of identity and/or suitable substitution modifications.

In variations, peptides and/or other suitable components described herein can be encapsulated or covalently-conjugated with one or more carriers (e.g., of different composition, of same or similar composition, etc.), where carriers and/or components of the therapeutic composition can include any one or more of: micelles, polymers, liposomes, dendrimers, metallic nanoparticles, microspheres, polyelectrolyte complex, emulsions, hydrogels, and/or injectable polymers. In variations, peptides and/or other suitable components described herein can be conjugated or modified with different molecules.

The therapeutic compositions, method 100, and/or system 200 can function to modulate and/or bind to TLRs and/or other suitable proteins related to TLR-related conditions, in order to diagnose (e.g., the presence of, the severity of, etc.) and/or treat the TLR-related conditions in a patient. Additionally or alternatively, the therapeutic compositions, method 100, and/or system 200 can function to illuminate the roles of different types of microorganisms in specific health conditions (e.g., the role of *Akkermansia muciniphila* in diabetes and/or obesity), such as through identifying the modulating roles of peptides associated with the microorganisms. TLR-related conditions (e.g., directly and/or indirectly associated with TLRs such as TLR2, etc.) can include any one or more of: diabetes, obesity, sepsis, inflammatory disease (e.g., Crohn's disease), immune disorders, metabolic disease (e.g., conditions associated with metabolic syndrome), endocrine disease, atherosclerosis, asthma, cardiovascular disease, immune-related conditions, and/or any other suitable conditions. In examples, therapeutic compositions and/or components associated with the therapeutic compositions can inform interactions between microorganisms and TLR-related conditions (e.g., a protective role of *A. muciniphila* in a condition, etc.). Determination, generation, and/or delivery of the therapeutic compositions are preferably performable by the method 100 and/or system 200 described below, but can additionally or alternatively be performed through any suitable processes and/or components.

The components of the therapeutic composition and/or system 200 can be physically and/or logically integrated in any manner (e.g., with any suitable distributions of functionality across the components, such as in relation to portions of the method 100; etc.). Further, the therapeutic compositions, method 100, and system 200 can be configured in any manner analogous to U.S. application Ser. No. 15/098,027 filed 13 Apr. 2016 and entitled "Method and System for Microbiome-Derived Diagnostics and Therapeutics for Autoimmune System Conditions", and U.S. application Ser. No. 15/098,248 filed 13 Apr. 2016 and entitled "Method and System for Microbiome-Derived Diagnostics and Therapeutics for Endocrine System Conditions", each of which are herein incorporated in their entirety by this reference. However, the therapeutic compositions, method 100, and system 200 can be configured in any suitable manner.

2.1 Therapeutic Composition—Peptides

The one or more peptides of the therapeutic composition function to interact (e.g., bind as a ligand) with one or more TLR-related components (e.g., different types and/or regions of TLRs, such as a specific active site domain or section within the TLR receptor; TLR-related proteins; etc.) such as in order to modulate TLR-related functionality (e.g., TLR2 receptor signaling pathway) for diagnosing, detecting, treating and/or otherwise modulating one or more TLR-related conditions. TLRs can include any one or more of: TLR1, TLR2, TLR3, TLR4, TLR5, TLR6, TLR7, TLR8, TLR9, TLR10, TLR11, TLR12, TLR13, and/or other suitable TLRs expressed in humans, other mammals, and/or other organisms. In an example, the peptide can modulate TLR2-related functionality and/or can be derived based on reengineering of a target peptide sequence associated with a microorganism-related modulator of TLR2 (e.g., where the TLR-related condition can include at least one of a metabolic disease and an immune disorder, etc.). In a specific example, the therapeutic composition can include a peptide operable as an activator of TLR2 in improving one more of a metabolic disease and an immune disorder. In other examples, the peptide can be operable as an inhibitor of TLR2, but the peptides can include any one or more of: full agonists, agonists, antagonists, inverse agonists, allosteric modulators, and/or any suitable type of relationship with TLRs and/or any other suitable proteins. The peptides preferably influence immune system-related functionality of the TLRs, but can modulate and/or otherwise modify any suitable TLR-related functionality. In an example, the peptides can modulate protein-protein interactions with the TLR, such as between TLR2 and TLR1 and/or Toll interacting protein. In another example, the peptides can modulate protein-ligand interactions. The peptides can be used in in vivo and/or in vitro targeting of TLRs and/or TLR-related proteins, but can otherwise be configured.

The peptides are preferably associated with (e.g., characterized by, having, defining, etc.) one or more binding parameters including: binding energy (e.g., affinity energy), association rate, dissociation rate, half-life of interaction (e.g., between receptor and peptide), binding constants, binding specificity, thermodynamics associated parameters (e.g. enthalpy, entropy, Gibbs free energy), parameters associated with number and type of binding sites (e.g., stoichiometry), parameters associated with undesired binding (e.g., self-assembly, interference with other proteins, etc.), and/or any other suitable binding parameters. The binding parameter values for the peptides (e.g., in relation to binding with TLRs) are preferably at least comparable to or improved over wild types peptides associated with microorganisms, but the binding parameters can have any suitable values. In an example, the therapeutic composition can include a peptide with a binding energy that is at least 1 Kcal/mol lower than wild type peptides, that implies a more favorable affinity between ligand and receptor. In another example, the therapeutic composition can include a peptide with a binding energy to TLR2 that is lower (e.g., a more favorable affinity) than a native peptide derived from Amuc_1100, a protein from *Akkermansia muciniphila* (*A. muciniphila*) and a putative activator of TLR2. In specific examples, the peptides can display TLR2 binding energies described in Table 1 below, where the binding energies are lower (e.g., a more favorable affinity) than a binding energy associated with a native peptide derived from Amuc_1100 (e.g., −6.8 Kcal/mol for a peptide sequence of LGFELK (SEQ ID NO:37736), etc.). Additionally or alternatively, the peptides can have comparable and/or improved binding parameters in relation to those associated with any suitable TLR-binding ligand, such as TLR2-binding ligands including any one or more of: MALP-2, MALP-404, OspA, antigen mixtures, lipomannan, LcrV, Porin, GPI anchor, hemagglutinin, zymosan, glycophosphatidylinositol, lipophosphoglycan, lysophosphatidylserine, glycolipids, lipopeptides, HSP60, HSP70, zymosan, lipoteichoic acid, lipoproteins, and/or other suitable modulators. However, these molecules can be also associated with any suitable parameters describing the characteristics of the peptides.

The peptides preferably possess peptide sequences derivable from peptide sequence motifs, such as including one or more of: nXXGFXLKXXn (SEQ ID NO:1), nXXTPA[ND][NE]XXXn (SEQ ID NOS:2-5), n[X][Z][B]APWn (SEQ ID NOS:6-245), nPP[X][Z][B][O]Pn (SEQ ID NOS:246-693), n[X][Z][i][O][B][J][f]n (SEQ ID NOS:694-35253), n[X][J]TAYKP[B]n (SEQ ID NOS:35304-35323), n[X]A[J][B]AP[Z]I[O][U]n (SEQ ID NOS:35324-35803), n1-1[X][J]QP[B]AQEPn (SEQ ID NOS:35804-35839), n[B]AR[X]TP[Z]SPPn (SEQ ID NOS:35284-35303), nF[X]PPAP[J]n (SEQ ID NOS:35254-35269), nDFT[X]FPPn (SEQ ID NOS:35270-35271), and n[X]TPA[J]F[B]n (SEQ ID NOS:35272-35283), where the notation is described above in Section 1, and where "n" can correspond to any number and type of amino acids (e.g., including n=0). Additionally or alternatively, the peptide sequences can be derivable from any homologous peptide sequence motifs (e.g., varying in sequence length, number and/or positioning of unspecified Xaa amino acids, additional or alternative amino acids, and/or with respect to any other suitable aspect of the peptide sequence motifs, etc.). Additionally or alternatively, the peptide sequence motifs can be determined based on applying substitution, deletion, insertion, duplication, inversion, and/or any other suitable operations. For example, the peptide sequence motifs can include xGFXLK (SEQ ID NO:1)(e.g., where the notation is described above in Section 1), which can be determined based on performing suitable operations on the XXGFXLKXX (SEQ ID NO:1) peptide sequence motif. In specific examples, the xGFXLK (SEQ ID NO:1) peptide sequence motif can be used in determining the peptide sequences described in Table 1 below, and/or any other suitable peptide sequences. Additionally or alternatively, such operations can be applied to any suitable peptide sequence motifs and/or peptide sequences described herein. In a variation, the unspecified Xaa amino acids and/or residues at other suitable positions in the peptide sequence motifs can be any amino acid type with equal probability. In another variation, the amino acid types for the unspecified Xaa amino acids and/or residues at other suitable positions can be characterized by unequal probabilities (e.g., with higher or lower probabilities based on the amino acid properties including hydrophobicity, polarity, dissociation constants, association constants, molecular weight, residue weight, pH, molecular formula and/or other suitable properties, such as in relation to correlation with binding parameters associated with TLRs). In another variation, Xaa can indicate no amino acid. However, the therapeutic composition can include peptides derived from any suitable peptide sequence motifs (e.g., including any suitable amino acids described in Table 12 below and/or other amino acid forms, etc.).

The peptide sequences are preferably derived from (e.g., are modifications of, variants of, etc.) modulators of TLRs and/or TLR-related proteins. Modulators of TLRs and/or TLR-related proteins can be associated with human-origin, microbial origin, and/or any other suitable origin. Modulators can be known modulators, putative modulators, unknown modulators, identified modulators, and/or any other suitable type of modulators. In a variation, the peptide sequence motifs can be derived from peptides of microbial origin. In a specific example, the xGFXLK (SEQ ID NO:1) peptide sequence motif can be extracted from the peptide sequence of LGFELK (SEQ ID NO:37736) in a native peptide of the Amuc_1100 protein of *A. muciniphila*, where the bolded letters indicate the amino acids conserved between the native peptide sequence and the peptide sequence motif. In this specific example, the xGFXLK (SEQ ID NO:1) peptide sequence motif can be used in determining peptide sequences including any one or more of: FGFELK; YGFELK; WGFELK; IGFELK; LGFHLK; LGFFLK; LGFFLK; LGFQLK; LGFGLK; LGFPLK; LGFSLK; LGFVLK; LGFRLK; LGFCLK; LGFTLK; LGFWLK; and LGFYLK (SEQ ID NOS:37719-37735, respectively), where the italicized letters indicate amino acids that have been mutated from the native peptide sequence. In another specific example, peptide sequence motifs and/or other suitable aspects associated with components of therapeutic compositions can be derived from Amuc_1100 and/or other molecules associated with *A. muciniphila* and/or other suitable microorganisms of other suitable taxonomic groups with positive or inverse correlations with conditions (e.g., diabetes such as type 2 diabetes, obesity, autoimmune conditions, etc.). In another specific example, the peptides can be derived based on reengineering of the target peptide sequence associated with a microorganism-related modulator associated with Amuc_1100 protein (e.g., peptide sequence segments from the Amuc_1100 amino acid sequence, etc.) from *Akkermansia muciniphila*, and where the peptides can correspond to one or more peptide sequences derivable from at least one of nXXGFXLKXXn (SEQ ID NO:1), nXXTPA[ND][NE]XXXn (SEQ ID NOS: 2-5), n[X][Z][B]APWn (SEQ ID NOS:6-245), nPP[X][Z][B][O]Pn (SEQ ID NOS:246-693), n[X][Z][i][O][B][J][f]n (SEQ ID NOS:694-35253), n[X][J]TAYKP[B]n (SEQ ID NOS:35304-35323), n[X]A[J][B]AP[Z]I[O][U]n (SEQ ID NOS:35324-35803), and nH[X][J]QP[B]AQEPn (SEQ ID NOS:35804-35839). In another specific example, peptide sequence motifs and/or other suitable aspects associated with components of therapeutic compositions can be derived from Rv1168c protein from *Mycobacterium tuberculosis* (e.g., associated with HIV trans-activation through activation of TLR2 receptor). In another specific example, the peptides can be derived based on reengineering of the target peptide sequence associated with a microorganism-related modulator associated with Rv1168c protein (e.g., peptide sequence segments from the Rv1168c amino acid sequence, etc.) from *Mycobacterium tuberculosis*, and where the peptides can correspond to one or more peptide sequences derivable from at least one of n[B]AR[X]TP[Z]SPPn (SEQ ID NOS:35284-35303), nF[X]PPAP[J]n (SEQ ID NOS: 35254-35269), nDFT[X]FPPn (SEQ ID NOS:35270-35271), and n[X]TPA[J]F[B]n (SEQ ID NOS:35272-35283). In another variation, the peptide sequence motifs can be derived from peptides of human-origin (e.g., described in databases including but not limited to Peptide-Atlas, Proteomics DB, Signal Peptide Database, Pepbank, etc.), and/or from peptides of human-origin and microbial-origin (e.g., determining a peptide sequence motif based on combining aspects of a human-origin peptide with aspects of a microbial-origin peptide, etc.). Additionally or alternatively, peptide sequence motifs and/or peptide sequences can be derived based on reengineering of target peptide sequences (e.g., mutating amino acid residues of the target peptide sequences, such as modifying amino acid residues, adding amino acid residues, deleting amino acid residues, in any suitable position, etc.) associated with microorganism-related modulators (e.g., associated with Amuc_1100, such as where one or more target peptide sequences are from the Amuc_1100 amino acid sequence; associated with Rv1168c; etc.). In examples, the peptide sequence motifs and/or peptide sequences can be based on binding parameter values for TLR binding site (and/or other suitable binding sites) for one or more molecules, such as Staphylococcal Superantigen-Like protein 3 (SSL3) (e.g., where the peptide is associated with Amuc_1100 and derivable from at least one of n[X][Z][B]APWn (SEQ ID NOS:6-245), nPP[X][Z][B][O]Pn (SEQ ID NOS:246-693), n[X][Z][i][O][B][J][f]n (SEQ ID NOS:694-35253); where the peptide is associated with Rv1168c and derivable from at least one of nF[X]PPAP[J]n (SEQ ID NOS:35254-35269), nDFT[X]FPPn (SEQ ID NOS:35270-35271), n[X]TPA[J]F[B]n (SEQ ID NOS: 35272-35283); etc.), a proline-proline glutamic acid protein (e.g., where the peptide is associated with Amuc_1100 and derivable from at least one of n[X][J]TAYKP[B]n (SEQ ID NOS:35304-35323), n[X]A[J][B]AP[Z]I[O][U]n (SEQ ID NOS:35324-35803), nH[X][J]QP[B]AQEPn (SEQ ID NOS: 35804-35839); where the peptide is associated with Rv1168c and derivable from at least one of n[B]AR[X]TP[Z]SPPn (SEQ ID NOS:35284-35303); etc.) and/or other suitable proteins and/or molecules. Additionally or alternatively, peptide sequence motifs can be derived independently of modulators, such as through in silico techniques (e.g., models) applying algorithms including random properties. However, peptide sequence motifs can be derived from modulators in any suitable manner.

The therapeutic composition can include peptides possessing specific amino acid pattern sequences with any suitable degree of identity (e.g., at least 50%, 70%, 90%, single amino acid, multiple amino acids, etc.) to the peptide sequences and/or peptide sequence motifs described herein. In a specific example, the therapeutic composition can include one or more peptides corresponding to one or more peptide sequences with at least 90% identity to one or more determined peptide sequences derivable from at least one peptide sequence motif described herein and/or other suitable peptide sequences described herein (e.g., described in the Sequence Listing, etc.). The identity between peptide sequences and/or peptide sequence motifs can be represented at any suitable positions in the sequences (e.g., the identity can be achieved through contiguous amino acids and/or non-contiguous amino acids in the sequences, etc.). However, identity between peptide sequences and/or peptide sequence motifs can be configured in any suitable manner.

Peptide sequences and/or peptide sequence motifs can possess any suitable length (e.g., number of amino acids in the sequence). In a specific example, the therapeutic composition can include a hexapeptide selected from Table 1. In another specific example, at least two amino acids can be inserted upstream (e.g., amino end) and at least two amino acids can be inserted downstream (e.g., carboxylic end) of a peptide sequence (e.g., for a modulator) and/or peptide sequence motif (e.g., derived from a modulator), but any suitable number of amino acids can be inserted and/or deleted from sequences described herein.

The therapeutic compositions can include any number of peptides possessing any number of peptide sequences derived from any number of peptide sequence motifs. In a specific example, the therapeutic composition can include peptides derived from a combination of peptide sequence motifs, where combination of peptides can include one or more of: combining two or more peptides together into a therapeutic composition for diagnostics purpose, combining two or more peptides into one single peptide that maintains both sequence motifs for each peptide combined in one molecule, and/or any other suitable combination of peptide sequence motifs and/or peptide sequences derivable from peptide sequence motifs described herein (e.g., a combination between a first peptide sequence motif described herein and a second peptide sequence motif with at least 2 amino acids inserted upstream at an amino end and at least 2 amino acids inserted downstream at an carboxylic end, etc.). In a specific example, the peptide can correspond to a peptide sequence derivable from nXX[MOTIF1][α][α]NS[α][α]N[β]LA[γ]C[AG]LS[62][δ]I[β]V[δ][β][δ]QL[δ]I[γ][MOTIF2]X Xn (SEQ ID NOS:35840-35983), where α includes an aromatic type amino acid selected from at least one of F, W and T, where β includes a positive type amino acid selected from at least one of R, H and K, where γ includes a negative type amino acid selected from at least one of D and E, where δ includes any amino acid, except for α, β and γ types, where X includes any amino acid type or no amino acid, where n includes any number and type of amino acid, where MOTIF1 includes a first target motif from a set of peptide sequence motifs including peptide sequence motifs described herein, and where MOTIF2 includes a second target motif (e.g., different from the first target motif, same as the first target motif, etc.) from the set of peptide sequence motifs. In another specific example, the peptide can correspond to a peptide sequence derivable from a combination of at least three motifs (e.g., different motifs, same motifs, etc.) from a set of peptide sequence motifs including peptide sequence motifs described herein, where the peptide corresponds to the peptide sequence derivable from nXX[MOTIF1]nX[MOTIF2]nX[MOTIF3]XXn (SEQ ID NOS: 35984-37711), where X includes any amino acid type or no amino acid, and where n includes any number and type of amino acid.

However, peptides and/or other suitable molecules included in one or more therapeutics composition can be configured in any suitable manner.

TABLE 1

Example Peptide Sequences and Associated Binding Energies on TLR2.

| Sequence | Binding Energy |
|---|---|
| FGFELK (SEQ ID NO: 37718) | -7.5 Kcal/mol |
| YGFELK (SEQ ID NO: 37719) | -7.3 Kcal/mol |
| WGFELK (SEQ ID NO: 37720) | -7.2 Kcal/mol |
| IGFELK (SEQ ID NO: 37721) | -7.0 Kcal/mol |
| LGFHLK (SEQ ID NO: 37722) | -7.2 Kcal/mol |
| LGFFLK (SEQ ID NO: 37723) | -7.2 Kcal/mol |
| LGFNLK (SEQ ID NO: 37724) | -7.1 Kcal/mol |
| LGFQLK (SEQ ID NO: 37725) | -7.0 Kcal/mol |
| LGFGLK (SEQ ID NO: 37726) | -7.0 Kcal/mol |
| LGFPLK (SEQ ID NO: 37727) | -7.0 Kcal/mol |
| LGFSLK (SEQ ID NO: 37728) | -7.0 Kcal/mol |
| LGFVLK (SEQ ID NO: 37729) | -7.0 Kcal/mol |
| LGFRLK (SEQ ID NO: 37730) | -6.9 Kcal/mol |
| LGFCLK (SEQ ID NO: 37731) | -6.9 Kcal/mol |
| LGFTLK (SEQ ID NO: 37732) | -6.9 Kcal/mol |
| LGFWLK (SEQ ID NO: 37733) | -6.9 Kcal/mol |
| LGFYLK (SEQ ID NO: 37734) | -6.9 Kcal/mol |

2.2 Therapeutic Composition—Microorganisms

The therapeutic composition can additionally or alternatively include any ligands and/or other biomolecules derived from microorganisms corresponding to taxonomic groups associated with TLRs, where the ligands and/or other biomolecules can function to facilitate interactions between the peptides of the therapeutic composition and TLRs and/or TLR-related proteins in order to facilitate diagnosis and/or treatment of TLR-related conditions. Additionally or alternatively, the therapeutic composition can include the microorganisms themselves (e.g., in a therapeutic composition including probiotics, etc.). In a variation, the therapeutic composition can include biomolecules derived from microorganisms expressing and/or encoding genes homologous to genes encoding Amuc_1100 and/or similar proteins (e.g., in relation to amino acid sequence, functionality, etc.), such as those including peptide sequences that are similar to (e.g., with an identity greater than an identity threshold), the same as, and/or derivable from the peptide sequences and/or peptide sequence motifs described herein. In another variation, the therapeutic composition can include microorganism-derived biomolecules facilitating the modulation of TLRs and/or TLR-related proteins by the peptides (e.g., biomolecules supporting binding and/or other suitable interactions between the peptides and the TLRs, etc.), where the biomolecules can be derived from microorganisms of the same or different type as those associated with the corresponding peptide in the therapeutic composition. In other variations, the therapeutic composition can include peptides and/or other biomolecules associated with (e.g., derived from associated peptide sequences) one or more types of microorganisms (e.g., the therapeutic composition including peptides derived based on reengineering of one or more target peptide sequences associated with one or more microorganism-related modulators associated with at least one of the following set of taxa, etc.) including at least one of: *A. muciniphila, Mycobacterium tuberculosis (M. tuberculosis), Faecalibacterium prausnitzii, Lactobacillus rhamnosus, Bacteroides fragilis, Porphyromonas gingivalis, Leptospira, Chlamydophila pneumoniae, Borrelia burgdorferi, Neisseria meningitidis, Haemophilus influenzae, Yersinia, Schistosoma mansoni, Trypanosoma cruzi, Mycobacterium, Propionibacterium acnes, Mycoplasma, Aspergillus fumigatus, Candida albicans, Malassezia, Saccharomyces cerevisiae, Plasmodium falciparum, Leishmania major,* Planctomycetes-Verrucomicrobia-Chlamydiae, Firmicutes, Bacteroidetes, gram-positive bacteria, herpes simplex virus, cytomegalovirus, varicella zoster virus, measles, fungi, archaea, gram-negative bacteria, virus, phages and/or any other suitable types of microorganisms across different groups of kingdoms, phyla, classes, orders, families, genera, species, subspecies, strains, infraspecies taxon, and/or any other suitable taxa (e.g. associated with a TLR). In variations, the therapeutic composition can include peptides and/or other biomolecules associated with microorganisms from taxonomic groups and/or with functionality described in U.S. application Ser. No. 15/098,027 filed 13 Apr. 2016 and entitled "Method and System for Microbiome-Derived Diagnostics and Therapeutics for Autoimmune System Conditions", and U.S. application Ser. No. 15/098,248 filed 13 Apr. 2016 and entitled "Method and System for Microbiome-Derived Diagnostics and Therapeutics for Endocrine System Conditions", each of which are herein incorporated in their entirety by this reference. However, ligands and/or other biomolecules derived from any suitable types of microorganisms can be included in the therapeutic composition and can be configured in any suitable manner.

2.3 Therapeutic Composition—Other

The therapeutic composition and/or components (e.g., peptides, other biomolecules) of the therapeutic composition can be in any suitable form suitable for facilitating delivery and/or treatment for one or more patients. The peptides in the therapeutic composition are preferably in a purified and/or isolated form, achieved through any suitable sample handling operation including one or more of: chromatography (e.g., size exclusion chromatography; high performance liquid chromatography; chromatography based on hydrophobicity; affinity chromatography; etc.), desalting, washing, centrifuging, and/or any suitable operation; however, the peptides can be in any suitable form. Additionally or alternatively, the therapeutic composition can include any one or more of: a pharmaceutical carrier, a lipid carrier, a dendrimeric carrier, a polymeric carrier, a metallic nanoparticle carrier, an amphiphilic carrier (e.g., composed by hydrophilic and hydrophobic sections), micelles, liposomes, an aqueous medium (e.g., water, oils, glycerol, glycol, ethanol, polyols, etc.), anti-angiogenic agents, therapeutic agents (e.g., chemotherapeutic agents), antimetabolites, natural compounds, alkylating agents, and/or any other suitable carriers and/or agents for facilitating diagnosis and/or treatment of TLR-related conditions, and can be administered by oral way, parenteral way, by osmotic pumps, and/or any other suitable manner. In examples, peptides and/or other suitable components described herein can be encapsulated or covalently-conjugated with one or more carriers (e.g., of different composition, of same or similar composition, etc.), where carriers and/or components of the therapeutic composition can include any one or more of: micelles, polymers, liposomes, dendrimers, metallic nanoparticles, microspheres, polyelectrolyte complex, emulsions, hydrogels, and/or injectable polymers.

In variations, peptides and/or other suitable components described herein can be conjugated or modified with different molecules (e.g., to increase their stability, to help to reach one or more targets, to prevent degradation such as in an extracellular environment, etc.). For example, peptides can be modified with non-natural amino acids (e.g., to prevent hydrolytic enzymes and/or proteases that can recognize them and can break peptide linkages, etc.). In examples, stereochemical modification, peptide bond surrogates, and/or other techniques can be applied. In examples, techniques promoting conformational stabilization can be applied (e.g., backbone cyclization, stapled peptides, disulfide formation, polymerization, tertiary structure formation, etc.) and/or shielding strategies can be applied (e.g., self-assembling, polymer conjugation, controlled shielding, etc.). Techniques and/or other suitable approaches described herein can improve upon potential characteristics of peptides (e.g., low hydrolytic stability in presence of enzymes; aggressiveness of biological fluids for peptides due to presence of proteases and peptidases; degradation in incubation in serum-containing media; etc.).

However, therapeutic compositions can include any suitable components configured in any suitable manner, and any suitable techniques can be applied in improving characteristics of components of the therapeutic compositions.

3. Method

Figure 3:
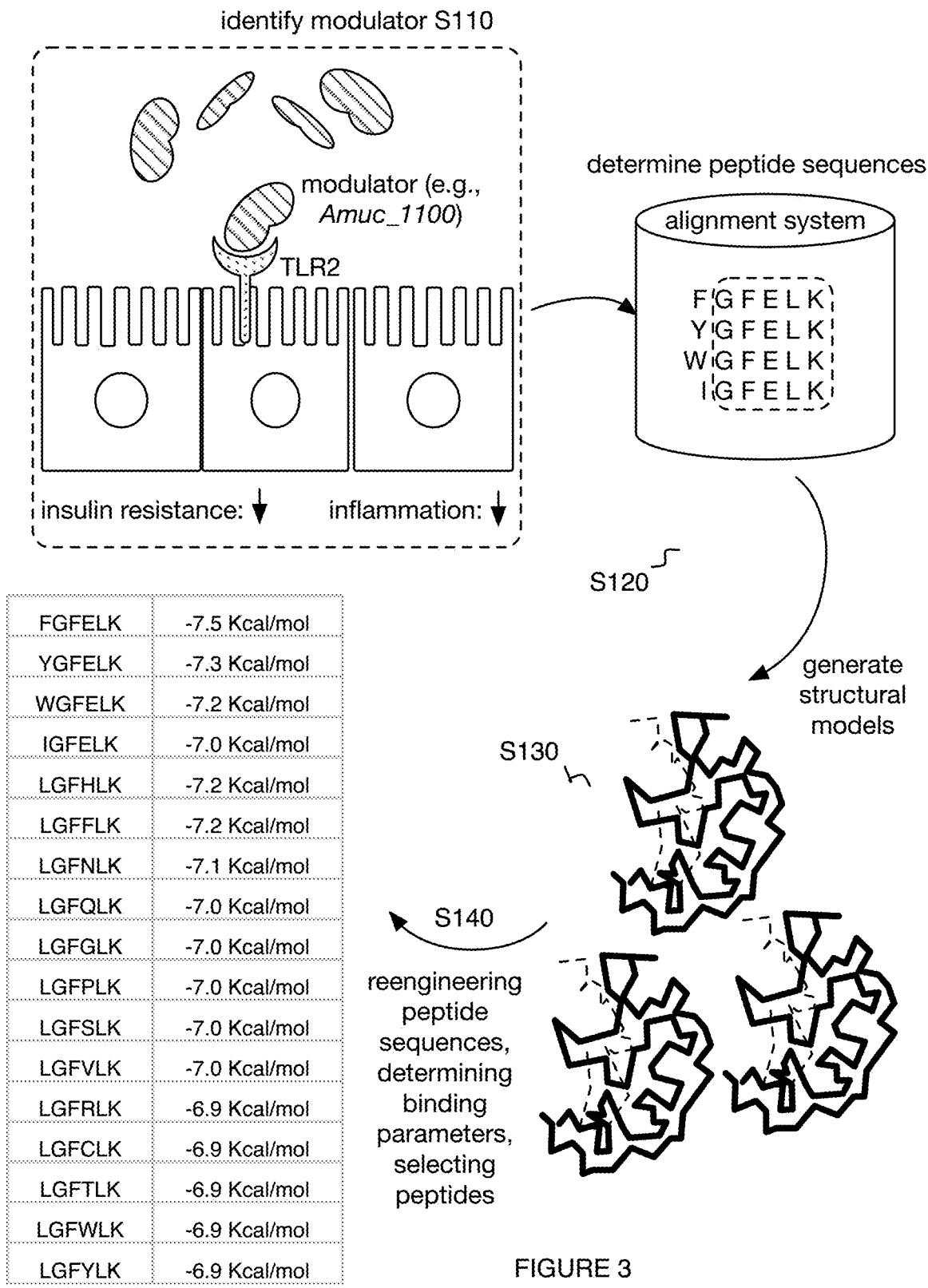
FIG. 3 is a schematic representation of variations of embodiments of therapeutic compositions and a method for facilitating diagnosis and/or treatment of a condition (determine peptide sequences=SEQ ID NOS:37719-37721, respectively; peptides selected=SEQ ID NOS:37719-37735).

As shown in FIGS. 1-3, embodiments of a method 100 for improving a TLR-related condition (e.g., through determining peptide sequences operable to facilitate modulation, diagnosis, detection, and/or treatment of a TLR-related condition in a patient, etc.) can include: identifying a modulator of at least one of a TLR and a TLR-related protein (e.g., based on an analysis of biomolecules associated with microbial-origin and/or other suitable origin, etc.) S110; determining one or more peptide sequences (e.g., a set of peptide sequences, etc.) associated with the modulator (e.g., a microorganism-related modulator, etc.), such as peptide sequences with an identity satisfying an identity threshold (e.g., at least 50%, 70%, 90%, single amino acid, multiple amino acids, etc.) to the modulator S120; determining a set of binding parameters for the set of peptide sequences in relation to the TLR S130; and/or determining a therapeutic composition based on the set of binding parameters S140. In variations, determining a therapeutic composition S140 can additionally or alternatively include selecting a target subset of peptide sequences from the one or more peptide sequences based on the first set of binding parameters; reengineering the target subset of peptide sequences (e.g., based on mutating amino acid residues, such as through modifying amino acid residues, adding amino acid residues, deleting amino acid residues, at any suitable position, etc.); determining a second set of binding parameters for the reengineered target subset of peptide sequences in relation to the TLR; and/or identifying one or more peptides and/or other suitable molecules for use in one or more therapeutic compositions for improving the TLR-related condition, based on the second set of binding parameters for the reengineered target subset of peptide sequences (e.g., through selecting peptide sequences based on higher binding affinity for the receptor, i.e., lower free energy). In an example, a first peptide, a second peptide, and/or any suitable number of peptides can be identified for use in the therapeutic composition, such as based on the second set of binding parameters, where the first peptide can correspond to a first peptide sequence different from a second peptide sequence corresponding to the second peptide. Embodiments of the method 100 can additionally or alternatively include delivering the therapeutic composition to a patient (e.g., in a form described in Section 2) in order to improve the TLR-related condition S150; and/or any other suitable operations.

In variants, any suitable Blocks of the method 100 can be repeatedly performed in any suitable order (e.g., in a cycle, as shown in FIG. 1), such as to refine a therapeutic composition (e.g., based on reengineering peptides based on mutating amino acids, including mutating non-conserved amino acids, such as through modifying, adding, and/or deleting amino acid residues) and/or to generate a plurality of therapeutic compositions (e.g., including different reengineered peptides). In an example, the method 100 can include refining the therapeutic composition, where refining the therapeutic composition includes selecting a second target subset of peptide sequences from a second set of peptide sequences based on a third set of binding parameters (e.g., in relation to the TLR associated with the first and/or second set of binding parameters; in relation to a different TLR; etc.); reengineering the second target subset of peptide sequences; determining a fourth set of binding parameters for the reengineered second target subset of peptide sequences (e.g., in relation to the TLR associated with the first and/or second set of binding parameters; in relation to a different TLR; etc.); and/or identifying a second peptide for use in the refined therapeutic composition for improving the TLR-related condition, based on the fourth set of binding parameters. However, any suitable Blocks of the method 100 can be repeated in any suitable sequence for any suitable purpose.

One or more instances of the method 100 and/or processes described herein can be performed asynchronously (e.g., sequentially), concurrently (e.g., in parallel; concurrently on different threads for parallel computing to improve system processing ability for determining peptide sequences; etc.), in temporal relation to a trigger event, and/or in any other suitable order at any suitable time and frequency to determine one or more peptide sequences and/or peptide sequence motifs described herein, such as through using one or more instances of the system 200 (e.g., including a sample handling network, a peptide sequence determination system such as a remote computing system and/or other suitable system components for determining peptide sequences and/or peptide sequence motifs, etc.). In variations, the method 100, system 200, and/or therapeutic compositions can include any aspects analogous to those described in U.S. application Ser. No. 14/593,424 filed 9 Jan. 2015 and entitled "Method and System for Microbiome Analysis", and U.S. application Ser. No. 14/919,614 filed 21 Oct. 2015 and entitled "Method and System for Microbiome-Derived Diagnostics and Therapeutics", each of which are herein incorporated in their entirety by this reference. However, the method 100 and system 200 can be configured in any suitable manner to facilitate peptide sequence determination.

3.1 Method—Identifying a Modulator.

Block S110 recites: identifying a modulator of at least one TLR-related component (e.g., a TLR and/or a TLR-related protein, etc.), such as based on an analysis of biomolecules associated with microbial-origin and/or other suitable origin. Block S110 can function to select putative modulators that can be analyzed to determine peptide sequences associated with modulation of target functionality (e.g., functionality corresponding to TLRs and TLR-related proteins). In a specific example, Block S110 can include identifying Amuc_1100 protein associated with *A. muciniphila*, Rv1168c protein associated with *M. tuberculosis*, and/or other suitable modulators of TLR-related proteins. Identifying modulators can be based on: sequencing (e.g., performing microbiome sequencing to identify genes encoding proteins associated with TLR modulation for populations of patients with or without TLR-related conditions; performing protein sequencing on microbial-derived ligands binding to TLRs; etc.), scientific literature (e.g., performing natural language processing on scientific literature associated with TLR2 modulation to identify modulators, etc.), peptide databases (e.g., generating a plurality of API requests tailored to different peptide databases; applying machine learning algorithms to identify and select modulators; etc.), and/or any suitable aspect.

In a variation, Block S110 can include identifying one or more regions of one or more modulators, which can function to identify regions (e.g., regions including sequences of interest, such as based on binding energy and/or other suitable characteristics, etc.) from which peptide sequences can be derived (e.g., in Block S120). In a specific example, the cytoplasmic and/or extracellular regions of Amuc_1100 and/or other suitable modulators can be identified (e.g., stored at a remote server for subsequent analysis, etc.). In another specific example, the N-terminal region of a proline-proline glutamic acid protein type (e.g., Rv1168c, etc.) can be identified. However, any suitable regions and/or other suitable aspects of modulators can be determined and/or otherwise utilized for deriving therapeutic compositions.

Block S110 is preferably performed at a peptide sequence determination system, which can include one or more of: a remote computing system (e.g., a server, at least one networked computing system, stateless, stateful), a local computing system, a user device (e.g., user smartphone, laptop, tablet, computing system, etc.), databases (e.g., peptide databases, microorganism databases, etc.), and/or any suitable component. Additionally or alternatively, identifying a modulator can be performed at a sample handling network (e.g., through in vivo experiments for determining modulation functionality of peptides, evaluation of physiological effect after using therapy composition, etc.), which can include one or more of: peptide analysis systems (e.g., a phage display system, a mass spectrometry system, etc.), a sequencing system (e.g., protein sequencing system; microbiome sequencing system; etc.), a library preparation system, sample kits (e.g., including sample containers, associated instructions), and/or any other suitable sample handling components. However, Block S110 can be performed by any suitable component in any suitable manner.

3.2 Method—Determining One or More Peptide Sequences

Block 120 recites: determining one or more peptide sequences (e.g., a set of peptide sequences, etc.) associated with the modulator (e.g., a microorganism-related modulator, etc.), such as with an identity satisfying an identity threshold for the modulator, which can function to identify a pool of peptide sequences with potential TLR-modulation functionality. The degree of identity can be based on peptide sequence motifs (e.g., a degree of identity corresponding to the number of Xaa amino acids in the peptide sequence motif, etc.) extracted from peptide sequences corresponding to modulators, but can additionally or alternatively be based on any suitable parameters (e.g., functional considerations, therapeutic considerations, etc.). Determining the set of peptide sequences can include one or more of: performing alignment operations (e.g., local alignments using BLAST tools, FASTA algorithm) with a set of alignment parameters (e.g., length parameters, such as to limit identification to peptides of short length with >4 amino acids; scoring parameters; gap penalty parameters; E-value; percent identity; percent similarity; etc.); extracting peptide sequence motifs; and/or any other suitable operation. In a specific example, Block S120 can include performing a local alignment operation on peptide sequences derived from the Amuc_1100 of *A. muciniphila*. Block S120 is preferably performed at the peptide sequence determination system but can additionally or alternatively be performed at any suitable component.

In a variation, Block S120 can include determining a set (e.g., a library, a plurality, etc.) of peptide sequences (and/or the peptides characterized by the peptide sequences, etc.) associated with different sequence lengths (e.g., 6-10 amino acids, any suitable sequence length, etc.), such as based on cytoplasmic and extracellular regions of the Amuc_1100 protein. However, Block S120 can be performed in any suitable manner.

3.3 Method—Determining Binding Parameters.

Block S130 recites: determining binding parameters (e.g., types of which are described above in Section 2) for the set of peptide sequences and/or peptides derived from the peptide sequences (e.g., such as binding parameters in relation to binding with TLR, etc.), which can function to evaluate the peptide sequences for diagnosis and/or treatment purposes. Determining binding parameters preferably includes generating structural models in silico (e.g., through in silico techniques) for the set of peptide sequences. In a specific example, Block S130 can include determining structural models in silico (e.g., at a peptide sequence determination system) for peptide sequences derived from mutating the variable Xaa positions in the xGFXLK (SEQ ID NO:1) peptide sequence motif; and performing free energy calculations using molecular simulations with the structural models to determine binding energies on TLR2 (e.g., described in Table 1). Block S130 (and/or other suitable portions of the method 100, such as determining binding parameters for reengineered peptide sequences, etc.) can include determining binding parameters with one or more techniques (e.g., in silico techniques, etc.) including one or more of: a molecular docking technique, a MM-(GB/PB)SA (Molecular Mechanics (Generalized Born/Poisson-Boltzmann) Surface Area) technique, free energy perturbation (FEP) technique, an adaptive biasing force (ABF) technique, an umbrella sampling method technique, and/or other suitable techniques. Additionally or alternatively, determining binding parameters can be performed with systems (e.g., the sample handling network) operable to determine binding parameters through in vitro processes (e.g., phage display; mass spectrometry; isothermal microcalorimetry, calorimetry, fluorescence binding assays, high throughput peptide analysis; etc.), in vivo processes, and/or any suitable processes.

In a variation, Block S130 can include applying molecular docking techniques to determine the relative energy of binding (and/or other suitable binding parameters) between one or more TLRs (e.g., TLR2, etc.) and one or more sets of peptides (e.g., characterized by peptide sequences determined in Block S120, etc.). In an example, Block S130 can include identifying one or more sites (e.g., known sites, putative sites, unknown sites, identified sites, etc.) of one or more TLRs for evaluating binding parameters (e.g., using molecular docking techniques and/or other suitable techniques, etc.). In a specific example, Block S130 can include identifying a first site as a TLR2 binding site of SSL3 associated with (e.g., from, etc.) *Staphylococcus aureus* (e.g., crystallized and/or deposited in the Protein Data Bank, etc.), and/or identifying a second site as a TLR2 binding site of a proline-proline glutamic acid protein (e.g., Rv1168c) associated with *Mycobacterium tuberculosis*, where the first site can correspond to leucine-rich repeats (LRR) 11-13 and/or the second site can correspond to LRR 15-19 in TLR2 receptor. Additionally or alternatively, any suitable sites of any suitable TLRs and/or other suitable molecules can be identified and/or associated with any suitable microorganisms. Sites can be defined as the center of a grid (e.g., 33 Å$^3$ in size, etc.), and/or any suitable location and/or shape for use in molecular docking techniques and/or other suitable techniques.

However, Block S130 and other portions of the method 100 can be performed in any suitable manner (e.g., determining other suitable parameters in evaluating identified peptide sequences, etc.).

3.4 Method—Determining a Therapeutic Composition.

Block S140 recites: determining a therapeutic composition, which can function to determine one or more components of one or more therapeutic compositions associated with one or more TLRs. Block S140 can include determining any suitable component suitable for a therapeutic composition, such as any one or more of peptide sequences, motifs, forms for delivery, carriers, agents, supplemental components, generation protocols, and/or other suitable components.

In a variation, Block S140 can include reengineering (e.g., mutating, substituting amino acids, etc.) peptide sequences and/or peptides derived from the peptide sequences S142. As such, Block S140 can include determining a target set of peptide sequences and/or peptides to reengineer, such as based on binding parameters (e.g., determined in Block S130), and/or any other suitable parameters. The target set of peptide sequences and/or peptides can be the same as the set of peptide sequences determined in Block S120, a subset of the set of peptide sequences (e.g., peptide sequences of modulators corresponding to binding sites at TLR-related proteins, peptide sequences with binding parameter performance satisfying a threshold condition, peptide sequences with binding energy satisfying a threshold condition, peptide sequences selected based on a ranking of binding parameter performance, etc.), and/or can include any suitable peptide sequences and/or peptides. As such, Block S140 can additionally or alternatively include selecting a target subset of peptide sequences (e.g., for performing subsequent analyses, such as reengineering and/or additional binding parameter determination, etc.) from a set of peptide sequences based on binding parameters (e.g., binding parameters determined in Block S130).

Reengineering can include mutating amino acids at any suitable position of the target peptide sequences and/or peptides (e.g., modifying amino acid residues, adding amino acid residues, deleting amino acid residues, etc.). Mutating can include mutation of any suitable amino acid to any other suitable amino acid. In an example, Block S140 can include reengineering (e.g., mutating, with other amino acid residues, at each position of each peptide sequence, etc.) and/or peptide at a first target set of peptide sequences and/or peptides derived from Amuc_1100 (e.g., target peptide sequences associated with Amuc_1100) and targeting a first site of a first TLR-related protein (e.g., TLR2 binding site for SSL from *Staphylococcus aureus*); reengineering a second target set of peptide sequences and/or peptides derived from Rv1168c (e.g., target peptide sequences associated with Rv1168c) and targeting the first site; reengineering a third target set of peptide sequences and/or peptides derived from Rv1168c and targeting a second site of the same or different TLR-related protein (e.g., TLR2 binding site for a proline-proline glutamic acid protein such as Rv1168c from *Mycobacterium tuberculosis*); and/or reengineering a fourth target set of peptide sequences and/or peptides derived from Amuc_1100 and targeting the second site. Block S140 can additionally or alternatively include determining binding parameters for the reengineered peptide sequences (e.g., for peptides derivable from the peptide sequences). For example, molecular docking runs and/or other suitable techniques can be performed on the first, second, third, fourth, and/or other suitable target peptide sequences and/or peptides, and optimization parameters (e.g., ranking based on binding parameter values, such as based on binding parameter values that was best performing out of a plurality of molecular docking runs, etc.) can be applied for determining a select set of peptide sequences and/or peptides (e.g., selecting the peptide sequences and/or peptides with equal to or less than the relative energy of binding than one or more wild peptide sequences and/or peptides, etc.), such as for identifying one or more peptides for use in the therapeutic composition based on the binding parameters (e.g., identifying peptide sequence motifs based on performance rankings of the binding parameters, and identifying peptides derivable from the peptide sequence motifs, etc.). However, reengineering peptide sequences and/or determining associated binding parameters can be performed in any suitable manner.

In the example, the first target set of peptide sequences and/or peptides (e.g., derived from Amuc_1100 and targeting the first site, etc.) can additionally or alternatively include (e.g., based on best performing affinity to the first site, etc.) ADQAPW (SEQ ID NO:198) (e.g., −9.6 kcal/mol), PPPIANP (SEQ ID NO:693) (e.g., −10.3 kcal/mol) and WLGFQVY (SEQ ID NO:35253) (e.g., −9.7 kcal/mol), where reengineering the first target set can result in binding energies (e.g., derived from molecular docking results, etc.) shown in Tables 2, 3, and 4. Describing Tables 2-11, the first row of each table depicts the position of each amino acid in the corresponding target peptide and/or peptide sequence, and the first column corresponds to the 20 naturally occurring amino acids. Describing Table 2, residue 1 (ALA1) from the native peptide ADQAPW (SEQ ID NO:198) may be mutated by PHE, resulting in a new reengineered peptide FDQAPW (SEQ ID NO:54) that binds the TLR2 receptor with a better-performing affinity (−10.1 kcal/mol) than the native peptide (−9.6 kcal/mol).

TABLE 2

Mutants of ADQAPW (SEQ ID NO: 198) peptide (in kcal/mol)

| | ALA1 | ASP2 | GLN3 | ALA4 | PRO5 | TRP6 |
|---|---|---|---|---|---|---|
| ALA | | −10 | | | | |
| ARG | | | | | | |
| ASN | | | | | | |
| ASP | | | | | | |
| CYS | | | | | | |
| GLN | | −9.9 | | | | |
| GLU | | −9.7 | | | | |
| GLY | | −9.8 | | | | |
| HIS | | −10.2 | | | | |
| ILE | −9.6 | −10 | | | | |
| LEU | | −9.8 | −9.6 | | | |
| LYS | | | | | | |
| MET | | | | | | |
| PHE | −10.1 | −10.9 | | | | |
| PRO | | −9.7 | | | | |
| SER | | | | | | |
| THR | | −9.8 | | | | |
| TRP | −9.6 | | −10.1 | | | |
| TYR | −9.6 | −11 | −9.8 | | | |
| VAL | | | | | | |

Block S140 can include determining one or more peptide sequence motifs based on the binding parameters for the reengineered peptide sequences; and/or identifying one or more peptides (e.g., for use in a therapeutic composition) based on the one or more peptide sequence motifs.

For example, Block S140 can include selecting a peptide sequence motif (e.g., based on results shown in Table 2) of [X][Z][B]APW (SEQ ID NOS:6-245), where X can correspond to at least one or more of (I,F,W,Y,A), Z can correspond to at least one or more of (D,A,Q,E,G,H,I,L,F,P,T,Y), B can correspond to at least one or more of (Q,L,W,Y), and where the bolded amino acids can be conserved. However, any suitable peptide sequence motifs can be derived from reengineering the ADQAPW (SEQ ID NO:198) peptide sequence and/or peptide, and/or reengineering any other suitable peptide sequence and/or peptide.

TABLE 3

Mutants of PPPIANP (SEQ ID NO: 693) peptide (in kcal/mol)

| | PRO1 | PRO2 | PRO3 | ILE4 | ALA5 | ASN6 | PRO7 |
|---|---|---|---|---|---|---|---|
| ALA | | | | −10.9 | | | |
| ARG | | | | | | | |
| ASN | | | | | | | |
| ASP | | | | | | −10.5 | |
| CYS | | | | | −10.6 | −10.3 | |
| GLN | | | | | −10.3 | | |
| GLU | | | | | −10.3 | | |
| GLY | | | | | −10.3 | −10.4 | −10.4 |
| HIS | | | | | −10.4 | | |
| ILE | | | | | | −10.9 | |
| LEU | | | | | −10.5 | | |
| LYS | | | | | | | |

TABLE 3-continued

Mutants of PPPIANP (SEQ ID NO: 693) peptide (in kcal/mol)

| | PRO1 | PRO2 | PRO3 | ILE4 | ALA5 | ASN6 | PRO7 |
|---|---|---|---|---|---|---|---|
| MET | | | | | | | |
| PHE | | | | -11 | -10.6 | | |
| PRO | | | | | -10.6 | | |
| SER | | | | -10.5 | | | |
| THR | | | | -10.6 | | | |
| TRP | | | | -11.6 | -11.1 | | |
| TYR | | | -11.2 | -11.3 | | | |
| VAL | | | | -10.8 | | | |

Block S140 can include selecting a peptide sequence motif (e.g., based on results shown in Table 3) of PP[X][Z][B][O]P (SEQ ID NOS:246-693), where X can correspond to at least one or more of (Y,P), Z can correspond to at least one or more of (W,Y,F,A,V,C,T,L,S,H,Q,E,G,I), B can correspond to at least one or more of (W,I,F,P,D,G,C,A), O can correspond to at least one or more of (G,N), and where the bolded amino acids can be conserved. However, any suitable peptide sequence motifs can be derived from reengineering the PPPIANP (SEQ ID NO:693) peptide sequence and/or peptide, and/or reengineering any other suitable peptide sequence and/or peptide.

TABLE 4

Mutants of WLGFQVY (SEQ ID NO: 35253) peptide (in kcal/mol)

| | TRP1 | LEU2 | GLY3 | PHE4 | GLN5 | VAL6 | TYR7 |
|---|---|---|---|---|---|---|---|
| ALA | | | | | -9.8 | -9.9 | |
| ARG | | -9.7 | | | | -10.1 | |
| ASN | | | | | | | |
| ASP | | | | | -10.4 | -9.7 | |
| CYS | | | | | | -10.1 | |
| GLN | | | | | | -9.9 | |
| GLU | | | | | | | |
| GLY | -9.7 | | | | -10.1 | | |
| HIS | | | | -9.8 | | | |
| ILE | | -9.8 | -9.7 | | -10.6 | | |
| LEU | | | | -9.7 | | -10 | |
| LYS | | | | | | | |
| MET | | -9.7 | | | | | |
| PHE | | -9.8 | | | -10.3 | -10.6 | -10.2 |
| PRO | | | | -10 | | | |
| SER | | -9.7 | | | | | |
| THR | | | | | | -10.2 | |
| TRP | | -10.4 | | | | | |
| TYR | -9.7 | | | | -10.1 | -10.4 | |
| VAL | | -10.2 | | | | -10.3 | |

Block S140 can include selecting a peptide sequence motif (e.g., based on results shown in Table 4) of [X][Z][i][O][B][J][f] (SEQ ID NOS:694-35253), where X can correspond to at least one or more of (G,Y,W), Z can correspond to at least one or more of (W,V,I,F,R,M,S,L), i can correspond to at least one or more of (I,G), O can correspond to at least one or more of (Y,P,H,L,F), B can correspond to at least one or more of (I,D,Y,F,V,T,G,A,Q), J can correspond to at least one or more of (F,R,C,L,A,Q,D,V) and f can correspond to at least one or more of (F,Y). However, any suitable peptide sequence motifs can be derived from reengineering the WLGFQVY (SEQ ID NO:35253) peptide sequence and/or peptide, and/or reengineering any other suitable peptide sequence and/or peptide.

In the example, the second target set of peptide sequences and/or peptides (e.g., derived from Rv1168c and targeting the first site, etc.) can additionally or alternatively include (e.g., based on best performing affinity to the first site, etc.)

FSPPAPI (SEQ ID NO:35269) (e.g., -11.0 kcal/mol), DFTIFPP (SEQ ID NO:35271) (e.g., -10.9 kcal/mol) and HTPAIFA (SEQ ID NO:35283) (e.g., -10.0 kcal/mol), where reengineering the second target set can result in binding energies (e.g., derived from molecular docking results, etc.) shown in Tables 5, 6, and 7.

TABLE 5

Mutants of FSPPAPI (SEQ ID NO: 35269) peptide (in kcal/mol)

| | PHE1 | SER2 | PRO3 | PRO4 | ALA5 | PRO6 | ILE7 |
|---|---|---|---|---|---|---|---|
| ALA | | | | | | | -11 |
| ARG | | | | | | | |
| ASN | | | | | | | |
| ASP | | | | | | | |
| CYS | | | | | | | |
| GLN | | | | | | | |
| GLU | | | | | | | -11 |
| GLY | | | | | | | -11 |
| HIS | | | | | | | |
| ILE | | | | | | | |
| LEU | | | | | | | -11.4 |
| LYS | | | | | | | |
| MET | | | | | | | |
| PHE | | | | | | | |
| PRO | | -11.7 | | | | | -11.7 |
| SER | | | | | | | |
| THR | | | | | | | |
| TRP | | | | | | | |
| TYR | | | | | | | -11.6 |
| VAL | | | | | | | -11 |

Block S140 can include selecting a peptide sequence motif (e.g., based on results shown in Table 5) of F[X]PPAP[J] (SEQ ID NOS:35254-35269), where X can correspond to at least one or more of (P,S), J can correspond to at least one of (P,Y,L,A,E,G,V,I), and where the bolded amino acids can be conserved. However, any suitable peptide sequence motifs can be derived from reengineering the FSPPAPI (SEQ ID NO:35269) peptide sequence and/or peptide, and/or reengineering any other suitable peptide sequence and/or peptide.

TABLE 6

Mutants of DFTIFPP (SEQ ID NO: 35271) peptide (in kcal/mol)

| | ASP1 | PHE2 | THR3 | ILE4 | PHE5 | PRO6 | PRO7 |
|---|---|---|---|---|---|---|---|
| ALA | | | | | | | |
| ARG | | | | | | | |
| ASN | | | | | | | |
| ASP | | | | | | | |
| CYS | | | | | | | |
| GLN | | | | | | | |
| GLU | | | | | | | |
| GLY | | | | | | | |
| HIS | | | | | | | |
| ILE | | | | | | | |
| LEU | | | | | | | |
| LYS | | | | | | | |
| MET | | | | | | | |
| PHE | | | | | | | |
| PRO | | | | | | | |
| SER | | | | | | | |
| THR | | | | | | | |
| TRP | | | | | | | |
| TYR | | | | | | | |
| VAL | | | | -11.1 | | | |

Block S140 can include selecting a peptide sequence motif (e.g., based on results shown in Table 6) of DFT[X]FPP (SEQ ID NOS:35270-35271), where X can correspond to at least one or more of (V,I) and where the bolded amino acids can be conserved. However, any suitable peptide sequence motifs can be derived from reengineering the DFTIFPP (SEQ ID NO:35271) peptide sequence and/or peptide, and/or reengineering any other suitable peptide sequence and/or peptide.

TABLE 7

Mutants of HTPAIFA (SEQ ID NO: 35283) peptide (in kcal/mol)

| | HIS1 | THR2 | PRO3 | ALA4 | ILE5 | PHE6 | ALA7 |
|---|---|---|---|---|---|---|---|
| ALA | | | | | | | |
| ARG | | | | | | | |
| ASN | | | | | | | |
| ASP | | | | | | | |
| CYS | | | | | | | |
| GLN | | | | | | | |
| GLU | | | | | | | |
| GLY | | | | | | | |
| HIS | | | | | -10.4 | | |
| ILE | | | | | | | |
| LEU | | | | | | | |
| LYS | | | | | | | |
| MET | | | | | | | |
| PHE | | | | | | | |
| PRO | | | | | | | |
| SER | | | | | | | |
| THR | -10 | | | | | | |
| TRP | | | | | | | |
| TYR | -10.2 | | | | | | -10.4 |
| VAL | | | | | | | |

Block S140 can include selecting a peptide sequence motif (e.g., based on results shown in Table 7) of [X]TPA[J]F[B] (SEQ ID NOS:35272-35283), where X can correspond to at least one or more of (Y,T,H), J can correspond to at least one or more of (H,I), B can correspond to at least one or more of (Y,A), and where the bolded amino acids can be conserved. However, any suitable peptide sequence motifs can be derived from reengineering the HTPAIFA (SEQ ID NO:35283) peptide sequence and/or peptide, and/or reengineering any other suitable peptide sequence and/or peptide.

In the example, the third target set of peptide sequences and/or peptides (e.g., derived from Rv1168c and targeting the second site, etc.) can additionally or alternatively include (e.g., based on best performing affinity to the second site, etc.) AARLTPFSPP (SEQ ID NO:35303) (−7.5 kcal/mol), where reengineering the third target set can result in binding energies (e.g., derived from molecular docking results, etc.) shown in Table 8.

TABLE 8

Mutants of AARLTPFSPP (SEQ ID NO: 35303) peptide (in kcal/mol)

| | ALA1 | ALA2 | ARG3 | LEU4 | THR5 | PRO6 | PHE7 | SER8 | PRO9 | PRO10 |
|---|---|---|---|---|---|---|---|---|---|---|
| ALA | | | | -7.8 | | | | | | |
| ARG | | | | | | | | | | |
| ASN | | | | -7.5 | | | | | | |
| ASP | | | | | | | | | | |
| CYS | | | | | | | | | | |
| GLN | | | | | | | | | | |
| GLU | | | | | | | | | | |
| GLY | | | | | | | | | | |
| HIS | | | | | | | | | | |
| ILE | | | | | | | | | | |
| LEU | | | | | | | | | | |
| LYS | | | | | | | | | | |
| MET | | | | | | | | | | |
| PHE | | | | | | | | | | |
| PRO | -7.5 | | | -7.6 | | | | -7.7 | | |
| SER | | | | | | | | | | |
| THR | | | | | | | | | | |
| TRP | | | | -7.6 | | | | | | |
| TYR | | | | | | | | | | |
| VAL | | | | | | | | | | |

Block S140 can include selecting a peptide sequence motif (e.g., based on results shown in Table 8) of [B]AR [X]TP[Z]SPP (SEQ ID NOS:35284-35303), where B can correspond to at least one or more of (P,A), X can correspond to at least one or more of (A,P,W,N,L), Z can correspond to at least one or more of (P,F), and where the bolded amino acids can be conserved. However, any suitable peptide sequence motifs can be derived from reengineering the AARLTPFSPP (SEQ ID NO:35303) peptide sequence and/or peptide, and/or reengineering any other suitable peptide sequence and/or peptide.

In the example, the fourth target set of peptide sequences and/or peptides (e.g., derived from Amuc_1100 and targeting the second site, etc.) can additionally or alternatively include (e.g., based on best performing affinity to the second site, etc.) LETAYKPF (SEQ ID NO:37718) (−7 kcal/mol), AAPAAPAIQQ (SEQ ID NO:35803) (−7.1 kcal/mol), and HFNQPKAQEP (SEQ ID NO:35839) (−7 kcal/mol), where reengineering the fourth target set can result in binding energies (e.g., derived from molecular docking results, etc.) shown in Tables 9, 10, and 11.

TABLE 9

| Mutants of LETAYKPF (SEQ ID NO: 37718) peptide (in kcal/mol) | | | | | | | |
|---|---|---|---|---|---|---|---|
| | LEU1 | GLU2 | THR3 | ALA4 | TYR5 | LYS6 | PRO7 | PHE8 |
| ALA | | −7.4 | | | | | | |
| ARG | | | | | | | | |
| ASN | | −7.2 | | | | | | |
| ASP | | | | | | | | |
| CYS | | | | | | | | |
| GLN | | | | | | | | |
| GLU | | | | | | | | |
| GLY | | | | | | | | |
| HIS | | | | | | | | |
| ILE | | | | | | | | |
| LEU | | | | | | | | |
| LYS | | | | | | | | |
| MET | | | | | | | | |
| PHE | | | | | | | | |
| PRO | | | | | | | | |
| SER | | −7.1 | | | | | | −7 |
| THR | | | | | | | | |
| TRP | −7.3 | −7.1 | | | | | | |
| TYR | | | | | | | | |
| VAL | | | | | | | | |

Block S140 can include selecting a peptide sequence motif (e.g., based on results shown in Table 9) of [X][J]TAYKP[B] (SEQ ID NOS:35304-35323), where X can correspond to at least one or more of (W,L), J can correspond to at least one or more of (A,N,S,W,E), B can correspond to at least one or more of (S,F), and where the bolded amino acids can be conserved. However, any suitable peptide sequence motifs can be derived from reengineering the LETAYKPF (SEQ ID NO:37718) peptide sequence and/or peptide, and/or reengineering any other suitable peptide sequence and/or peptide.

TABLE 10

| Mutants of AAPAAPAIQQ (SEQ ID NO: 35803) peptide (in kcal/mol) | | | | | | | | | |
|---|---|---|---|---|---|---|---|---|---|
| | ALA1 | ALA2 | PRO3 | ALA4 | ALA5 | PRO6 | ALA7 | ILE8 | GLN9 | GLN10 |
| ALA | | | | | | | | | | |
| ARG | | | | | | | | | | −7.2 |
| ASN | | | | −7.1 | | | | | | |
| ASP | | | | | | | | | | |
| CYS | | | | | | | | | | |
| GLN | −7.1 | | | | | | | | | |
| GLU | | | | | | | | | | |

TABLE 10-continued

Mutants of AAPAAPAIQQ (SEQ ID NO: 35803) peptide (in kcal/mol)

| | ALA1 | ALA2 | PRO3 | ALA4 | ALA5 | PRO6 | ALA7 | ILE8 | GLN9 | GLN10 |
|---|---|---|---|---|---|---|---|---|---|---|
| GLY | | | | | | | | | | |
| HIS | | | | -7.2 | | | | | | |
| ILE | | | | | | | | | | |
| LEU | | | | | | | | | | |
| LYS | | | | | | | | | | |
| MET | | | | | | | | | | |
| PHE | | | -7.2 | | | | | | | |
| PRO | | | | | -7.3 | | | | | |
| SER | | | | | | | | | | |
| THR | | | | | | | | | | |
| TRP | -7.1 | | | | -7.1 | | | | -7.2 | |
| TYR | | | -7.1 | -7.2 | | -7.5 | | | | |
| VAL | | | | | | | | | | |

Block S140 can include selecting a peptide sequence motif (e.g., based on results shown in Table 10) of [X]A[J][B]AP[Z]I[O][U] (SEQ ID NOS:35324-35803), where X can correspond to at least one or more of (N,W,A), J can correspond to at least one or more of (F,N,Y,P), B can correspond to at least one or more of (P,H,Y,W,A), Z can correspond to at least one or more of (Y,A), O can correspond to at least one or more of (W,Q), U can correspond to at least one or more of (R, Q), and where the bolded amino acids can be conserved. However, any suitable peptide sequence motifs can be derived from reengineering the LETAYKPF (SEQ ID NO:37718) peptide sequence and/or peptide, and/or reengineering any other suitable peptide sequence and/or peptide.

The peptide sequence motifs described herein, peptide sequences, and/or peptides are preferably of any suitable length, such as where any number and/or type of amino acids can be included at the ends of the peptide sequence motifs, peptide sequences, and/or peptides. For example, Block S140 can include determining peptide sequence motifs based on Amuc_1100 (e.g., native peptide sequences of peptides of Amuc_1100, etc.), where the peptide sequence motifs can include one or more of: n[X][Z][B]APWn (SEQ ID NOS:6-245), nPP[X][Z][B][O]Pn (SEQ ID NOS:246-693), n[X][Z][i][O][B][J][f]n (SEQ ID NOS:694-35253), n[X][J]TAYKP[B]n (SEQ ID NOS:35304-35323), n[X]A[J][B]AP[Z]I[O][U]n (SEQ ID NOS:35324-35803), and nH[X][J]QP[B]AQEPn (SEQ ID NOS:35804-35839), and

TABLE 11

Mutants of HFNQPKAQEP (SEQ ID NO: 35839) peptide (in kcal/mol)

| | HIS1 | PHE2 | ASN3 | GLN4 | PRO5 | LYS6 | ALA7 | GLN8 | GLU9 | PRO10 |
|---|---|---|---|---|---|---|---|---|---|---|
| ALA | | -7.3 | | | | | | | | |
| ARG | | | | | | | | | | |
| ASN | | | | | | | | | | |
| ASP | | | | | | | | | | |
| CYS | | | | | | | | | | |
| GLN | | | | | | | | | | |
| GLU | | -7.1 | | | | | | | | |
| GLY | | -7.1 | -7.5 | | | | | | | |
| HIS | | | | | -7.6 | | | | | |
| ILE | | | | | | | | | | |
| LEU | | | | | | | | | | |
| LYS | | | | | | | | | | |
| MET | | | | | | | | | | |
| PHE | | | | | | | | | | |
| PRO | | | | | | | | | | |
| SER | | | | | | | | | | |
| THR | | | | | | | | | | |
| TRP | | -7 | | | -7 | | | | | |
| TYR | | | | | | | | | | |
| VAL | | | | | | | | | | |

Block S140 can include selecting a peptide sequence motif (e.g., based on results shown in Table 11) of H[X][J]QP[B]AQEP (SEQ ID NOS:35804-35839), where X can correspond to at least one or more of (E,G,W,F), J can correspond to at least one or more of (G,A,N), B can correspond to at least one or more of (H,W,K), and where the bolded amino acids can be conserved. However, any suitable peptide sequence motifs can be derived from reengineering the HFNQPKAQEP (SEQ ID NO:35839) peptide sequence and/or peptide, and/or reengineering any other suitable peptide sequence and/or peptide.

where "n" can correspond to any number and type of amino acids (e.g., including n=0). In another example, Block S140 can include determining peptide sequence motifs based on Rv1168c (e.g., native peptide sequences of peptides of Rv1168c, etc.), where the peptide sequence motifs can include one or more of: n[B]AR[X]TP[Z]SPPn (SEQ ID NOS:35284-35303), nF[X]PPAP[J]n (SEQ ID NOS:35254-35269), nDFT[X]FPPn (SEQ ID NOS:35270-35271), and n[X]TPA[J]F[B]n (SEQ ID NOS:35272-35283), and where "n" can correspond to any number and type of amino acids (e.g., including n=0). Additionally or alternatively, any number and/or type of amino acids can be added (e.g., at one or more ends of a peptide sequence, at a position within the peptide sequence, etc.), deleted (e.g., any subset combination of amino acids of peptide sequences, etc.), and or otherwise modified (e.g., mutated to any other suitable amino acid), at any position of the peptide sequences.

In an example, Block S140 can include determining a therapeutic composition binding to TLR2 in the LRR 15-19 section and in the LRR 11-13 section (e.g., the first site and the second site, etc.).

In a variation, Block S140 can include determining a patient microbiome analysis (e.g., associated with the TLR-related condition; etc.) based on a sample from the patient (e.g., based on sequencing the sample and/or analyzing at least one of microbiome composition features, microbiome functional features, microbiome pharmacogenomics features, and/or other suitable features for the patient; etc.), where identifying a peptide for a therapeutic composition can be based on the patient microbiome analysis, binding parameters for reengineered peptide sequences, and/or any other suitable parameters.

However, determining peptide sequence motifs, target peptide sequences and/or peptides, and/or any other suitable components associated with therapeutic compositions can be performed in any suitable manner.

The compositions (e.g., including peptides, biomolecules, associated peptide sequences, associated peptide sequence motifs, etc.), methods 100, and systems 200 described herein can be determined, generated, and applied without undue experimentation. Further, any biomolecules with chemical and/or physiological relatedness to aspects described herein can be substituted and/or otherwise used.

The method 100 and/or system 200 of the embodiments can be embodied and/or implemented at least in part as a machine configured to receive a computer-readable medium storing computer-readable instructions. The instructions can be executed by computer-executable components integrated with the application, applet, host, server, network, website, communication service, communication interface, hardware/firmware/software elements of a patient computer or mobile device, or any suitable combination thereof. Other systems 200 and methods 100 of the embodiments can be embodied and/or implemented at least in part as a machine configured to receive a computer-readable medium storing computer-readable instructions. The instructions can be executed by computer-executable components integrated by computer-executable components integrated with apparatuses and networks of the type described above. The computer-readable medium can be stored on any suitable computer readable media such as RAMs, ROMs, flash memory, EEPROMs, optical devices (CD or DVD), hard drives, floppy drives, or any suitable device. The computer-executable component can be a processor, though any suitable dedicated hardware device can (alternatively or additionally) execute the instructions.

The FIGURES illustrate the architecture, functionality and operation of possible implementations of compositions, methods 100, and systems 200 according to preferred embodiments, example configurations, and variations thereof. It should also be noted that, in some alternative implementations, the functions noted can occur out of the order noted in the FIGURES. For example, aspects shown in succession may, in fact, be executed substantially concurrently, or the aspects may sometimes be executed in the reverse order, depending upon the functionality involved. The embodiments include every combination and permutation of the various system components and the various method processes, including any variations, examples, and specific examples. As a person skilled in the art will recognize from the previous detailed description and from the figures and claims, modifications and changes can be made to the embodiments without departing from the scope.

TABLE 12

Amino Acids

| 1-Letter Symbol | 3-Letter Symbol | Meaning |
|---|---|---|
| A | Ala | Alanine |
| C | Cys | Cysteine |
| D | Asp | Aspartic Acid |
| E | Glu | Glutamic Acid |
| F | Phe | Phenylalanine |
| G | Gly | Glycine |
| H | His | Histidine |
| I | Ile | Isoleucine |
| K | Lys | Lysine |
| L | Leu | Leucine |
| M | Met | Methionine |
| N | Asn | Asparagine |
| P | Pro | Proline |
| Q | Gln | Glutamine |
| R | Arg | Arginine |
| S | Ser | Serine |
| T | Thr | Threonine |
| V | Val | Valine |
| W | Trp | Tryptophan |
| Y | Tyr | Tyrosine |
| X | Xaa | unknown or other or none |

4. Additional or Alternative Examples

In variations, the method 100 and/or system 200 can apply one or more experiments to assess the activation of TLR2 receptors mediated by protein fragments and/or peptides. Any of the variants described herein (e.g., embodiments, variations, examples, specific examples, illustrations, etc.) and/or any portion of the variants described herein can be additionally or alternatively combined, excluded, and/or otherwise applied.

In a specific example, stimulation of TLR2 receptors mediated by protein fragments and/or peptides were assessed using HEK-Blue cells that overexpress TLR2. For the immune receptor stimulation analysis HEK-Blue hTLR2 and HEK-Blue™ Null1 (parental cell line) cell lines were used. Stimulation of the receptors with the corresponding ligands activates NF-κB and AP-1, which induces the production of secreted embryonic alkaline phosphatase (SEAP), the levels of which were measured by spectrophotometer. All cell lines were grown and subcultured up to 70-80% of confluency using as a maintenance medium Dulbecco's Modified Eagle Medium (DMEM) supplemented with 4.5 g/l D-glucose, 50 U/ml penicillin, 50 µg/ml streptomycin, 100 µg/ml Normocin, 2 mM L-glutamine and 10% (v/v) of heat-inactivated FBS. For each cell line, an immune response experiment was carried out by seeding HEK-blue cells in flat-bottom 96-well plates and stimulating them by addition of the peptides (see table 1). The 96-well plates were incubated for 16-18 h at 37° C. in a 5% CO2 incubator. Zymosan (10 ug/ml for hTLR2), was used as positive control whereas maintenance medium (DMEM) without any selective antibiotics was used as negative control. SEAP secretion was detected by measuring the OD630 at 1 h after addition of 180 µL of QUANTI-Blue (Invivogen) to 20 µL of induced HEK-Blue hTLR2/Null supernatant. Protein fragments from Amuc to be assessed in HEK-Blue cells were obtained by an expression plasmid for the production of His-tagged Amuc_1100 (full protein and its fragments), was constructed by amplification of its gene devoid of the coding sequence for its signal sequence and cloning of the resulting PCR product in pET-28a *E. coli* XL1Blue. The following primer sequences were used to obtain protein full, first fragment and second fragment of Amuc_1100:

TABLE 13

Primer sequences used to obtain protein full, first fragment and second fragment of Amuc_1100

| Name | Primer sequence |
| --- | --- |
| Complete amuC_1100 | GGGTACCATATGATCGTCAATTCCAAACGC (SEQ ID NO: 37712) <br> CCTTGGCTCGAGTTAATCTTCAGACGGTTCCTG (SEQ ID NO: 37713) |
| Fragment 1 amuC_1100 | GGGTACCATATGATCGTCAATTCCAAACGC (SEQ ID NO: 37714) <br> CCTTGGCTCGAGAATGGGGAGCTGGGGCG (SEQ ID NO: 37715) |
| Fragment 2 amuC_1100 | GGGTACCATATGCTGGCGGAATGCGGCCTG (SEQ ID NO: 37716) <br> CCTTGGCTCGAGTTAATCTTCAGACGGTTCCTG (SEQ ID NO: 37717) |

Bolded sequences are restriction sites for NdeI and XhoI enzymes.

Conformation of the resulting plasmid pET-28a-1100 was verified by polymerase chain reaction (PCR), sequencing analysis and transformed into *E. coli* BL21 (DE3). This strain was then grown in LB-broth containing kanamycin (50 μg/ml) with shaking at 220 rpm at 37° C., followed by induction through the addition of 1 mM IPTG in the growth medium during mid-exponential phase. After three hours of induction, cells were pelleted by centrifuging 10 min at 5,000 g and cell pellets stored at −20° C. until lysis. Cell pellets were resuspended and lysed using lysozyme and frozen −80° C. and heat 37° C. Supernatant was collected after centrifugation and the Amuc_1100 was purified by nickel column affinity. The protein visualization and quantification was determined by SDS-Page and bradford method, respectively. The Amuc_1100 protein was stored at −20° C.

Figure 4:
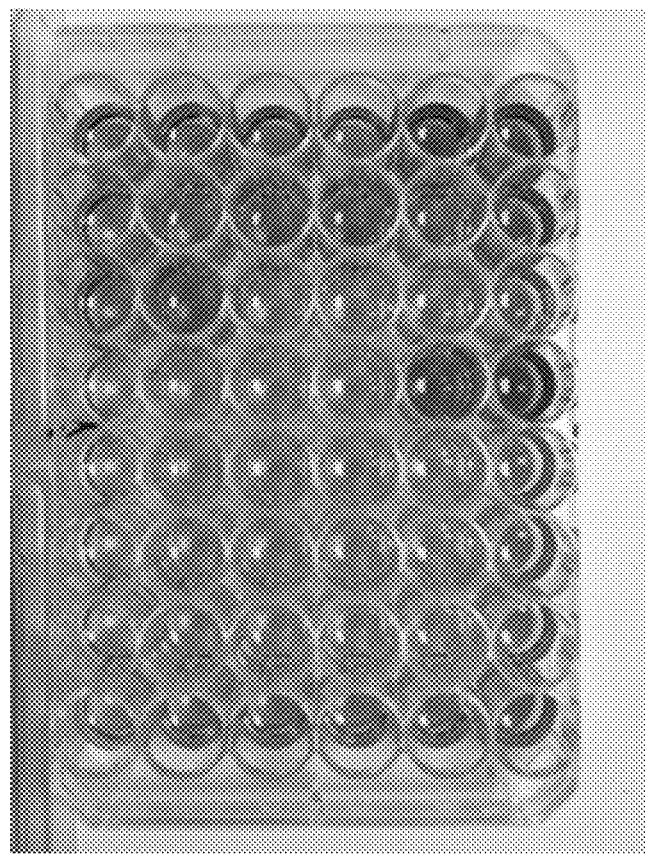
FIG. 4 illustrates a specific example of experimental results with a 96-well plate seeded with HEK-TLR2 cells, and where different fragments of Amuc_1100 protein were assayed.

In Table 14 and FIG. 4, results are informed as positive TLR2 activation (e.g., purple color or darker color) or no TLR2 activation (e.g. pink color or lighter color). Three fragments of Amuc_1100 were tested: Fragment 1, Fragment 2 and Fragment 3, where the first one contains the fragments 2 and 3. Fragments 2 and 3 share a region nXXGFXLKAINSLVN[KR]LA[ED]CGLSKFIKVY[KR]PQLPIETPA[ND][NE]XXXn (SEQ ID NO:37737), where the notation "X" can indicate any amino acid (e.g., a defined set of amino acids, non-natural amino acid, etc.) and/or no amino acid (e.g., where X is deleted, where one or more mother molecules are inserted, included, and/or otherwise added, etc.), and n can represent that the fragment (e.g., XXX fragment) can have any length with any suitable added amino acids at any suitable end, which can improve the activation of TLR2 (e.g., as determined by computational calculations and described above, etc.).

TABLE 14

| Experimental Results | |
| --- | --- |
| Section | Results based on the color |
| Fragment 1 (FL) (20 uL) | Positive |
| Fragment 1 (FL) (50 uL) | Positive |
| Control BLB21 | Negative |
| Neg. control | Negative |
| Zymosan (Positive control) | Positive |
| Fragment 2 AmuC | Positive |
| Fragment 3 AmuC | Positive |

FIG. 4 illustrates a 96-well plate seeded with HEK-TLR2 cells. Different fragments of Amuc_1100 protein were assayed. In FIG. 4, the first horizontal line of the plate illustrates from left to right (by duplicate): Fragment 1 AmuC (first extract×2),Fragment 1 AmuC (second extract low concentration×2), Fragment 1 AmuC (second extract high concentration×2). The second line illustrates from left to right (by duplicate): Fragment 2 AmuC (low concentration×2), Fragment 2 AmuC (high concentration×2), Fragment 3 AmuC (low concentration×2). The third line illustrates from left to right (by duplicate): Section 2 AmuC (high concentration×2), Control BLB21 (*E. coli*×2), Control II. The fourth line illustrates from left to right (by duplicate): Control imidazole (protein purification×2), Negative control (medium×2),Positive control (Zymosan×2). The fifth through eighth lines illustrate the same, but with parental cell line (HEK 293 Null), used as control.

SEQUENCE LISTING (37737 sequences)

SEQ ID NO: 1 - protein, 10 aa, Artificial Sequence
  Synthetic construct
  MISC_FEATURE (1)..(3): Xaa = any amino acid, or is absent
  MISC_FEATURE (6)..(6): Xaa = any amino acid, or is absent
  MISC_FEATURE (9)..(10): Xaa = any amino acid, or is absent
XXXGFXLKXX

SEQ ID NO: 2 - protein, 10 aa, Artificial Sequence
  Synthetic construct
  MISC_FEATURE (1)..(2): Xaa = any amino acid, non amino acid, or is absent
  MISC_FEATURE (8)..(10): Xaa = any amino acid, non amino acid, or is absent
XXTPANNXXX

SEQ ID NO: 3 - protein, 10 aa, Artificial Sequence
  Synthetic construct
  MISC_FEATURE (1)..(2): Xaa = any amino acid, non amino acid, or is absent
  MISC_FEATURE (8)..(10): Xaa = any amino acid, non amino acid, or is absent
XXTPANEXXX

SEQ ID NO: 4 - protein, 10 aa, Artificial Sequence
  Synthetic construct
  MISC_FEATURE (1)..(2): Xaa = any amino acid, non amino acid, or is absent
  MISC_FEATURE (8)..(10): Xaa = any amino acid, non amino acid, or is absent
XXTPADNXXX

SEQ ID NO: 5 - protein, 10 aa, Artificial Sequence
  Synthetic construct
  MISC_FEATURE (1)..(2): Xaa = any amino acid, non amino acid, or is absent
  MISC_FEATURE (8)..(10): Xaa = any amino acid, non amino acid, or is absent
XXTPADEXXX

SEQ ID NO: 6 - protein, 6 aa, Artificial Sequence
  Synthetic construct
IDQAPW

SEQ ID NO: 7 - protein, 6 aa, Artificial Sequence
  Synthetic construct
IDLAPW

SEQ ID NO: 8 - protein, 6 aa, Artificial Sequence
  Synthetic construct
IDWAPW

SEQ ID NO: 9 - protein, 6 aa, Artificial Sequence
  Synthetic construct
IDYAPW

SEQ ID NO: 10 - protein, 6 aa, Artificial Sequence
  Synthetic construct
IAQAPW

SEQ ID NO: 11 - protein, 6 aa, Artificial Sequence
  Synthetic construct
IALAPW

SEQ ID NO: 12 - protein, 6 aa, Artificial Sequence
  Synthetic construct
IAWAPW

SEQ ID NO: 13 - protein, 6 aa, Artificial Sequence
  Synthetic construct
IAYAPW

SEQ ID NO: 14 - protein, 6 aa, Artificial Sequence
  Synthetic construct
IQQAPW

SEQ ID NO: 15 - protein, 6 aa, Artificial Sequence
  Synthetic construct
IQLAPW

SEQ ID NO: 16 - protein, 6 aa, Artificial Sequence
  Synthetic construct
IQWAPW

SEQ ID NO: 17 - protein, 6 aa, Artificial Sequence
  Synthetic construct
IQYAPW

SEQ ID NO: 18 - protein, 6 aa, Artificial Sequence
  Synthetic construct
IEQAPW

SEQ ID NO: 19 - protein, 6 aa, Artificial Sequence
  Synthetic construct
IELAPW

SEQ ID NO: 20 - protein, 6 aa, Artificial Sequence
  Synthetic construct
IEWAPW

SEQ ID NO: 21 - protein, 6 aa, Artificial Sequence
  Synthetic construct
IEYAPW

SEQ ID NO: 22 - protein, 6 aa, Artificial Sequence
  Synthetic construct
IGQAPW

SEQ ID NO: 23 - protein, 6 aa, Artificial Sequence
  Synthetic construct
IGLAPW

SEQ ID NO: 24 - protein, 6 aa, Artificial Sequence
  Synthetic construct
IGWAPW

SEQ ID NO: 25 - protein, 6 aa, Artificial Sequence
  Synthetic construct
IGYAPW

SEQ ID NO: 26 - protein, 6 aa, Artificial Sequence
  Synthetic construct
IHQAPW

SEQ ID NO: 27 - protein, 6 aa, Artificial Sequence
  Synthetic construct
IHLAPW

SEQ ID NO: 28 - protein, 6 aa, Artificial Sequence
  Synthetic construct
IHWAPW

SEQ ID NO: 29 - protein, 6 aa, Artificial Sequence
  Synthetic construct
IHYAPW

SEQ ID NO: 30 - protein, 6 aa, Artificial Sequence
  Synthetic construct
IIQAPW

SEQ ID NO: 31 - protein, 6 aa, Artificial Sequence
  Synthetic construct
IILAPW

SEQ ID NO: 32 - protein, 6 aa, Artificial Sequence
  Synthetic construct
IIWAPW

SEQ ID NO: 33 - protein, 6 aa, Artificial Sequence
  Synthetic construct
IIYAPW

SEQ ID NO: 34 - protein, 6 aa, Artificial Sequence
  Synthetic construct
ILQAPW

SEQ ID NO: 35 - protein, 6 aa, Artificial Sequence
  Synthetic construct
ILLAPW

SEQ ID NO: 36 - protein, 6 aa, Artificial Sequence
  Synthetic construct
ILWAPW

SEQ ID NO: 37 - protein, 6 aa, Artificial Sequence
  Synthetic construct
ILYAPW

SEQ ID NO: 38 - protein, 6 aa, Artificial Sequence
  Synthetic construct
IFQAPW

SEQ ID NO: 39 - protein, 6 aa, Artificial Sequence
  Synthetic construct
IFLAPW

SEQ ID NO: 40 - protein, 6 aa, Artificial Sequence
  Synthetic construct
IFWAPW

SEQ ID NO: 41 - protein, 6 aa, Artificial Sequence
  Synthetic construct
IFYAPW

SEQ ID NO: 42 - protein, 6 aa, Artificial Sequence
  Synthetic construct
IPQAPW

SEQ ID NO: 43 - protein, 6 aa, Artificial Sequence
  Synthetic construct
IPLAPW

SEQ ID NO: 44 - protein, 6 aa, Artificial Sequence
  Synthetic construct
IPWAPW

SEQ ID NO: 45 - protein, 6 aa, Artificial Sequence
  Synthetic construct
IPYAPW

SEQ ID NO: 46 - protein, 6 aa, Artificial Sequence
  Synthetic construct
ITQAPW

SEQ ID NO: 47 - protein, 6 aa, Artificial Sequence
  Synthetic construct
ITLAPW

SEQ ID NO: 48 - protein, 6 aa, Artificial Sequence
  Synthetic construct
ITWAPW

SEQ ID NO: 49 - protein, 6 aa, Artificial Sequence
  Synthetic construct
ITYAPW

SEQ ID NO: 50 - protein, 6 aa, Artificial Sequence
  Synthetic construct
IYQAPW

SEQ ID NO: 51 - protein, 6 aa, Artificial Sequence
  Synthetic construct
IYLAPW

SEQ ID NO: 52 - protein, 6 aa, Artificial Sequence
  Synthetic construct
IYWAPW

SEQ ID NO: 53 - protein, 6 aa, Artificial Sequence
  Synthetic construct
IYYAPW

SEQ ID NO: 54 - protein, 6 aa, Artificial Sequence
  Synthetic construct
FDQAPW

SEQ ID NO: 55 - protein, 6 aa, Artificial Sequence
  Synthetic construct
FDLAPW

SEQ ID NO: 56 - protein, 6 aa, Artificial Sequence
  Synthetic construct
FDWAPW

SEQ ID NO: 57 - protein, 6 aa, Artificial Sequence
  Synthetic construct
FDYAPW

SEQ ID NO: 58 - protein, 6 aa, Artificial Sequence
  Synthetic construct
FAQAPW

SEQ ID NO: 59 - protein, 6 aa, Artificial Sequence
  Synthetic construct
FALAPW

SEQ ID NO: 60 - protein, 6 aa, Artificial Sequence
  Synthetic construct
FAWAPW

SEQ ID NO: 61 - protein, 6 aa, Artificial Sequence
  Synthetic construct
FAYAPW

SEQ ID NO: 62 - protein, 6 aa, Artificial Sequence
  Synthetic construct
FQQAPW

SEQ ID NO: 63 - protein, 6 aa, Artificial Sequence
  Synthetic construct
FQLAPW

SEQ ID NO: 64 - protein, 6 aa, Artificial Sequence
  Synthetic construct
FQWAPW

SEQ ID NO: 65 - protein, 6 aa, Artificial Sequence
  Synthetic construct
FQYAPW

SEQ ID NO: 66 - protein, 6 aa, Artificial Sequence
  Synthetic construct
FEQAPW

SEQ ID NO: 67 - protein, 6 aa, Artificial Sequence
  Synthetic construct
FELAPW

SEQ ID NO: 68 - protein, 6 aa, Artificial Sequence
  Synthetic construct
FEWAPW

SEQ ID NO: 69 - protein, 6 aa, Artificial Sequence
  Synthetic construct
FEYAPW

SEQ ID NO: 70 - protein, 6 aa, Artificial Sequence
  Synthetic construct
FGQAPW

SEQ ID NO: 71 - protein, 6 aa, Artificial Sequence
  Synthetic construct
FGLAPW

SEQ ID NO: 72 - protein, 6 aa, Artificial Sequence
  Synthetic construct
FGWAPW

SEQ ID NO: 73 - protein, 6 aa, Artificial Sequence
  Synthetic construct
FGYAPW

SEQ ID NO: 74 - protein, 6 aa, Artificial Sequence
  Synthetic construct
FHQAPW

SEQ ID NO: 75 - protein, 6 aa, Artificial Sequence
  Synthetic construct
FHLAPW

SEQ ID NO: 76 - protein, 6 aa, Artificial Sequence
  Synthetic construct
FHWAPW

SEQ ID NO: 77 - protein, 6 aa, Artificial Sequence
  Synthetic construct
FHYAPW

SEQ ID NO: 78 - protein, 6 aa, Artificial Sequence
  Synthetic construct
FIQAPW

SEQ ID NO: 79 - protein, 6 aa, Artificial Sequence
  Synthetic construct
FILAPW

SEQ ID NO: 80 - protein, 6 aa, Artificial Sequence
  Synthetic construct
FIWAPW

SEQ ID NO: 81 - protein, 6 aa, Artificial Sequence
  Synthetic construct
FIYAPW

SEQ ID NO: 82 - protein, 6 aa, Artificial Sequence
  Synthetic construct
FLQAPW

SEQ ID NO: 83 - protein, 6 aa, Artificial Sequence
  Synthetic construct
FLLAPW

SEQ ID NO: 84 - protein, 6 aa, Artificial Sequence
  Synthetic construct
FLWAPW

SEQ ID NO: 85 - protein, 6 aa, Artificial Sequence
  Synthetic construct
FLYAPW

SEQ ID NO: 86 - protein, 6 aa, Artificial Sequence
  Synthetic construct
FFQAPW

SEQ ID NO: 87 - protein, 6 aa, Artificial Sequence
  Synthetic construct
FFLAPW

SEQ ID NO: 88 - protein, 6 aa, Artificial Sequence
  Synthetic construct
FFWAPW

SEQ ID NO: 89 - protein, 6 aa, Artificial Sequence
  Synthetic construct
FFYAPW

SEQ ID NO: 90 - protein, 6 aa, Artificial Sequence
  Synthetic construct
FPQAPW

SEQ ID NO: 91 - protein, 6 aa, Artificial Sequence
  Synthetic construct
FPLAPW

SEQ ID NO: 92 - protein, 6 aa, Artificial Sequence
  Synthetic construct
FPWAPW

SEQ ID NO: 93 - protein, 6 aa, Artificial Sequence
  Synthetic construct
FPYAPW

SEQ ID NO: 94 - protein, 6 aa, Artificial Sequence
  Synthetic construct
FTQAPW

SEQ ID NO: 95 - protein, 6 aa, Artificial Sequence
  Synthetic construct
FTLAPW

SEQ ID NO: 96 - protein, 6 aa, Artificial Sequence
  Synthetic construct
FTWAPW

SEQ ID NO: 97 - protein, 6 aa, Artificial Sequence
  Synthetic construct
FTYAPW

SEQ ID NO: 98 - protein, 6 aa, Artificial Sequence
  Synthetic construct
FYQAPW

SEQ ID NO: 99 - protein, 6 aa, Artificial Sequence
  Synthetic construct
FYLAPW

SEQ ID NO: 100 - protein, 6 aa, Artificial Sequence
  Synthetic construct
FYWAPW

SEQ ID NO: 101 - protein, 6 aa, Artificial Sequence
  Synthetic construct
FYYAPW

SEQ ID NO: 102 - protein, 6 aa, Artificial Sequence
  Synthetic construct
WDQAPW

SEQ ID NO: 103 - protein, 6 aa, Artificial Sequence
  Synthetic construct
WDLAPW

SEQ ID NO: 104 - protein, 6 aa, Artificial Sequence
  Synthetic construct
WDWAPW

SEQ ID NO: 105 - protein, 6 aa, Artificial Sequence
  Synthetic construct
WDYAPW

SEQ ID NO: 106 - protein, 6 aa, Artificial Sequence
  Synthetic construct
WAQAPW

SEQ ID NO: 107 - protein, 6 aa, Artificial Sequence
  Synthetic construct
WALAPW

SEQ ID NO: 108 - protein, 6 aa, Artificial Sequence
  Synthetic construct
WAWAPW

SEQ ID NO: 109 - protein, 6 aa, Artificial Sequence
  Synthetic construct
WAYAPW

SEQ ID NO: 110 - protein, 6 aa, Artificial Sequence
  Synthetic construct
WQQAPW

SEQ ID NO: 111 - protein, 6 aa, Artificial Sequence
  Synthetic construct
WQLAPW

SEQ ID NO: 112 - protein, 6 aa, Artificial Sequence
  Synthetic construct
WQWAPW

SEQ ID NO: 113 - protein, 6 aa, Artificial Sequence
  Synthetic construct
WQYAPW

SEQ ID NO: 114 - protein, 6 aa, Artificial Sequence
  Synthetic construct
WEQAPW

SEQ ID NO: 115 - protein, 6 aa, Artificial Sequence
  Synthetic construct
WELAPW

SEQ ID NO: 116 - protein, 6 aa, Artificial Sequence
  Synthetic construct
WEWAPW

SEQ ID NO: 117 - protein, 6 aa, Artificial Sequence
  Synthetic construct
WEYAPW

SEQ ID NO: 118 - protein, 6 aa, Artificial Sequence
  Synthetic construct
WGQAPW

SEQ ID NO: 119 - protein, 6 aa, Artificial Sequence
  Synthetic construct
WGLAPW

SEQ ID NO: 120 - protein, 6 aa, Artificial Sequence
  Synthetic construct
WGWAPW

SEQ ID NO: 121 - protein, 6 aa, Artificial Sequence
  Synthetic construct
WGYAPW

SEQ ID NO: 122 - protein, 6 aa, Artificial Sequence
  Synthetic construct
WHQAPW

SEQ ID NO: 123 - protein, 6 aa, Artificial Sequence
  Synthetic construct
WHLAPW

SEQ ID NO: 124 - protein, 6 aa, Artificial Sequence
  Synthetic construct
WHWAPW

SEQ ID NO: 125 - protein, 6 aa, Artificial Sequence
  Synthetic construct
WHYAPW

SEQ ID NO: 126 - protein, 6 aa, Artificial Sequence
  Synthetic construct
WIQAPW

SEQ ID NO: 127 - protein, 6 aa, Artificial Sequence
  Synthetic construct
WILAPW

SEQ ID NO: 128 - protein, 6 aa, Artificial Sequence
  Synthetic construct
WIWAPW

SEQ ID NO: 129 - protein, 6 aa, Artificial Sequence
  Synthetic construct
WIYAPW

SEQ ID NO: 130 - protein, 6 aa, Artificial Sequence
  Synthetic construct
WLQAPW

SEQ ID NO: 131 - protein, 6 aa, Artificial Sequence
  Synthetic construct
WLLAPW

SEQ ID NO: 132 - protein, 6 aa, Artificial Sequence
  Synthetic construct
WLWAPW

SEQ ID NO: 133 - protein, 6 aa, Artificial Sequence
  Synthetic construct
WLYAPW

SEQ ID NO: 134 - protein, 6 aa, Artificial Sequence
  Synthetic construct
WFQAPW

SEQ ID NO: 135 - protein, 6 aa, Artificial Sequence
  Synthetic construct
WFLAPW

SEQ ID NO: 136 - protein, 6 aa, Artificial Sequence
  Synthetic construct
WFWAPW

SEQ ID NO: 137 - protein, 6 aa, Artificial Sequence
  Synthetic construct
WFYAPW

SEQ ID NO: 138 - protein, 6 aa, Artificial Sequence
  Synthetic construct
WPQAPW

SEQ ID NO: 139 - protein, 6 aa, Artificial Sequence
  Synthetic construct
WPLAPW

SEQ ID NO: 140 - protein, 6 aa, Artificial Sequence
  Synthetic construct
WPWAPW

SEQ ID NO: 141 - protein, 6 aa, Artificial Sequence
  Synthetic construct
WPYAPW

SEQ ID NO: 142 - protein, 6 aa, Artificial Sequence
  Synthetic construct
WTQAPW

SEQ ID NO: 143 - protein, 6 aa, Artificial Sequence
  Synthetic construct
WTLAPW

SEQ ID NO: 144 - protein, 6 aa, Artificial Sequence
  Synthetic construct
WTWAPW

SEQ ID NO: 145 - protein, 6 aa, Artificial Sequence
  Synthetic construct
WTYAPW

SEQ ID NO: 146 - protein, 6 aa, Artificial Sequence
  Synthetic construct
WYQAPW

SEQ ID NO: 147 - protein, 6 aa, Artificial Sequence
  Synthetic construct
WYLAPW

SEQ ID NO: 148 - protein, 6 aa, Artificial Sequence
  Synthetic construct
WYWAPW

SEQ ID NO: 149 - protein, 6 aa, Artificial Sequence
  Synthetic construct
WYYAPW

SEQ ID NO: 150 - protein, 6 aa, Artificial Sequence
  Synthetic construct
YDQAPW

SEQ ID NO: 151 - protein, 6 aa, Artificial Sequence
  Synthetic construct
YDLAPW

SEQ ID NO: 152 - protein, 6 aa, Artificial Sequence
  Synthetic construct
YDWAPW

SEQ ID NO: 153 - protein, 6 aa, Artificial Sequence
  Synthetic construct
YDYAPW

SEQ ID NO: 154 - protein, 6 aa, Artificial Sequence
  Synthetic construct
YAQAPW

SEQ ID NO: 155 - protein, 6 aa, Artificial Sequence
  Synthetic construct
YALAPW

SEQ ID NO: 156 - protein, 6 aa, Artificial Sequence
  Synthetic construct
YAWAPW

SEQ ID NO: 157 - protein, 6 aa, Artificial Sequence
  Synthetic construct
YAYAPW

SEQ ID NO: 158 - protein, 6 aa, Artificial Sequence
  Synthetic construct
YQQAPW

SEQ ID NO: 159 - protein, 6 aa, Artificial Sequence
  Synthetic construct
YQLAPW

SEQ ID NO: 160 - protein, 6 aa, Artificial Sequence
  Synthetic construct
YQWAPW

SEQ ID NO: 161 - protein, 6 aa, Artificial Sequence
  Synthetic construct
YQYAPW

SEQ ID NO: 162 - protein, 6 aa, Artificial Sequence
  Synthetic construct
YEQAPW

SEQ ID NO: 163 - protein, 6 aa, Artificial Sequence
  Synthetic construct
YELAPW

SEQ ID NO: 164 - protein, 6 aa, Artificial Sequence
  Synthetic construct
YEWAPW

SEQ ID NO: 165 - protein, 6 aa, Artificial Sequence
  Synthetic construct
YEYAPW

SEQ ID NO: 166 - protein, 6 aa, Artificial Sequence
  Synthetic construct
YGQAPW

SEQ ID NO: 167 - protein, 6 aa, Artificial Sequence
  Synthetic construct
YGLAPW

SEQ ID NO: 168 - protein, 6 aa, Artificial Sequence
  Synthetic construct
YGWAPW

SEQ ID NO: 169 - protein, 6 aa, Artificial Sequence
  Synthetic construct
YGYAPW

SEQ ID NO: 170 - protein, 6 aa, Artificial Sequence
  Synthetic construct
YHQAPW

SEQ ID NO: 171 - protein, 6 aa, Artificial Sequence
  Synthetic construct
YHLAPW

SEQ ID NO: 172 - protein, 6 aa, Artificial Sequence
  Synthetic construct
YHWAPW

SEQ ID NO: 173 - protein, 6 aa, Artificial Sequence
  Synthetic construct
YHYAPW

SEQ ID NO: 174 - protein, 6 aa, Artificial Sequence
  Synthetic construct
YIQAPW

SEQ ID NO: 175 - protein, 6 aa, Artificial Sequence
  Synthetic construct
YILAPW

SEQ ID NO: 176 - protein, 6 aa, Artificial Sequence
  Synthetic construct
YIWAPW

SEQ ID NO: 177 - protein, 6 aa, Artificial Sequence
  Synthetic construct
YIYAPW

SEQ ID NO: 178 - protein, 6 aa, Artificial Sequence
  Synthetic construct
YLQAPW

SEQ ID NO: 179 - protein, 6 aa, Artificial Sequence
  Synthetic construct
YLLAPW

SEQ ID NO: 180 - protein, 6 aa, Artificial Sequence
  Synthetic construct
YLWAPW

SEQ ID NO: 181 - protein, 6 aa, Artificial Sequence
  Synthetic construct
YLYAPW

SEQ ID NO: 182 - protein, 6 aa, Artificial Sequence
  Synthetic construct
YFQAPW

SEQ ID NO: 183 - protein, 6 aa, Artificial Sequence
  Synthetic construct
YFLAPW

SEQ ID NO: 184 - protein, 6 aa, Artificial Sequence
  Synthetic construct
YFWAPW

SEQ ID NO: 185 - protein, 6 aa, Artificial Sequence
  Synthetic construct
YFYAPW

SEQ ID NO: 186 - protein, 6 aa, Artificial Sequence
  Synthetic construct
YPQAPW

SEQ ID NO: 187 - protein, 6 aa, Artificial Sequence
  Synthetic construct
YPLAPW

SEQ ID NO: 188 - protein, 6 aa, Artificial Sequence
  Synthetic construct
YPWAPW

SEQ ID NO: 189 - protein, 6 aa, Artificial Sequence
  Synthetic construct
YPYAPW

SEQ ID NO: 190 - protein, 6 aa, Artificial Sequence
  Synthetic construct
YTQAPW

SEQ ID NO: 191 - protein, 6 aa, Artificial Sequence
  Synthetic construct
YTLAPW

SEQ ID NO: 192 - protein, 6 aa, Artificial Sequence
  Synthetic construct
YTWAPW

SEQ ID NO: 193 - protein, 6 aa, Artificial Sequence
  Synthetic construct
YTYAPW

SEQ ID NO: 194 - protein, 6 aa, Artificial Sequence
  Synthetic construct
YYQAPW

SEQ ID NO: 195 - protein, 6 aa, Artificial Sequence
  Synthetic construct
YYLAPW

SEQ ID NO: 196 - protein, 6 aa, Artificial Sequence
  Synthetic construct
YYWAPW

SEQ ID NO: 197 - protein, 6 aa, Artificial Sequence
  Synthetic construct
YYYAPW

SEQ ID NO: 198 - protein, 6 aa, Artificial Sequence
  Synthetic construct
ADQAPW

SEQ ID NO: 199 - protein, 6 aa, Artificial Sequence
  Synthetic construct
ADLAPW

SEQ ID NO: 200 - protein, 6 aa, Artificial Sequence
  Synthetic construct
ADWAPW

SEQ ID NO: 201 - protein, 6 aa, Artificial Sequence
  Synthetic construct
ADYAPW

SEQ ID NO: 202 - protein, 6 aa, Artificial Sequence
  Synthetic construct
AAQAPW

SEQ ID NO: 203 - protein, 6 aa, Artificial Sequence
  Synthetic construct
AALAPW

SEQ ID NO: 204 - protein, 6 aa, Artificial Sequence
  Synthetic construct
AAWAPW

SEQ ID NO: 205 - protein, 6 aa, Artificial Sequence
  Synthetic construct
AAYAPW

SEQ ID NO: 206 - protein, 6 aa, Artificial Sequence
  Synthetic construct
AQQAPW

SEQ ID NO: 207 - protein, 6 aa, Artificial Sequence
  Synthetic construct
AQLAPW

SEQ ID NO: 208 - protein, 6 aa, Artificial Sequence
  Synthetic construct
AQWAPW

SEQ ID NO: 209 - protein, 6 aa, Artificial Sequence
  Synthetic construct
AQYAPW

SEQ ID NO: 210 - protein, 6 aa, Artificial Sequence
  Synthetic construct
AEQAPW

SEQ ID NO: 211 - protein, 6 aa, Artificial Sequence
  Synthetic construct
AELAPW

SEQ ID NO: 212 - protein, 6 aa, Artificial Sequence
  Synthetic construct
AEWAPW

SEQ ID NO: 213 - protein, 6 aa, Artificial Sequence
  Synthetic construct
AEYAPW

SEQ ID NO: 214 - protein, 6 aa, Artificial Sequence
  Synthetic construct
AGQAPW

SEQ ID NO: 215 - protein, 6 aa, Artificial Sequence
  Synthetic construct
AGLAPW

SEQ ID NO: 216 - protein, 6 aa, Artificial Sequence
  Synthetic construct
AGWAPW

SEQ ID NO: 217 - protein, 6 aa, Artificial Sequence
  Synthetic construct
AGYAPW

SEQ ID NO: 218 - protein, 6 aa, Artificial Sequence
  Synthetic construct
AHQAPW

SEQ ID NO: 219 - protein, 6 aa, Artificial Sequence
  Synthetic construct
AHLAPW

SEQ ID NO: 220 - protein, 6 aa, Artificial Sequence
  Synthetic construct
AHWAPW

SEQ ID NO: 221 - protein, 6 aa, Artificial Sequence
  Synthetic construct
AHYAPW

SEQ ID NO: 222 - protein, 6 aa, Artificial Sequence
  Synthetic construct
AIQAPW

SEQ ID NO: 223 - protein, 6 aa, Artificial Sequence
  Synthetic construct
AILAPW

SEQ ID NO: 224 - protein, 6 aa, Artificial Sequence
  Synthetic construct
AIWAPW

SEQ ID NO: 225 - protein, 6 aa, Artificial Sequence
  Synthetic construct
AIYAPW

SEQ ID NO: 226 - protein, 6 aa, Artificial Sequence
  Synthetic construct
ALQAPW

SEQ ID NO: 227 - protein, 6 aa, Artificial Sequence
  Synthetic construct
ALLAPW

SEQ ID NO: 228 - protein, 6 aa, Artificial Sequence
  Synthetic construct
ALWAPW

SEQ ID NO: 229 - protein, 6 aa, Artificial Sequence
  Synthetic construct
ALYAPW

SEQ ID NO: 230 - protein, 6 aa, Artificial Sequence
  Synthetic construct
AFQAPW

SEQ ID NO: 231 - protein, 6 aa, Artificial Sequence
  Synthetic construct
AFLAPW

SEQ ID NO: 232 - protein, 6 aa, Artificial Sequence
  Synthetic construct
AFWAPW

SEQ ID NO: 233 - protein, 6 aa, Artificial Sequence
  Synthetic construct
AFYAPW

SEQ ID NO: 234 - protein, 6 aa, Artificial Sequence
  Synthetic construct
APQAPW

SEQ ID NO: 235 - protein, 6 aa, Artificial Sequence
  Synthetic construct
APLAPW

SEQ ID NO: 236 - protein, 6 aa, Artificial Sequence
  Synthetic construct
APWAPW

SEQ ID NO: 237 - protein, 6 aa, Artificial Sequence
  Synthetic construct
APYAPW

SEQ ID NO: 238 - protein, 6 aa, Artificial Sequence
  Synthetic construct
ATQAPW

SEQ ID NO: 239 - protein, 6 aa, Artificial Sequence
  Synthetic construct
ATLAPW

SEQ ID NO: 240 - protein, 6 aa, Artificial Sequence
  Synthetic construct
ATWAPW

SEQ ID NO: 241 - protein, 6 aa, Artificial Sequence
  Synthetic construct
ATYAPW

SEQ ID NO: 242 - protein, 6 aa, Artificial Sequence
  Synthetic construct
AYQAPW

SEQ ID NO: 243 - protein, 6 aa, Artificial Sequence
  Synthetic construct
AYLAPW

SEQ ID NO: 244 - protein, 6 aa, Artificial Sequence
  Synthetic construct
AYWAPW

SEQ ID NO: 245 - protein, 6 aa, Artificial Sequence
  Synthetic construct
AYYAPW

SEQ ID NO: 246 - protein, 7 aa, Artificial Sequence
  Synthetic construct
PPYWWGP

SEQ ID NO: 247 - protein, 7 aa, Artificial Sequence
  Synthetic construct
PPYWWNP

SEQ ID NO: 248 - protein, 7 aa, Artificial Sequence
  Synthetic construct
PPYWIGP

SEQ ID NO: 249 - protein, 7 aa, Artificial Sequence
  Synthetic construct
PPYWINP

SEQ ID NO: 250 - protein, 7 aa, Artificial Sequence
  Synthetic construct
PPYWFGP

SEQ ID NO: 251 - protein, 7 aa, Artificial Sequence
  Synthetic construct
PPYWFNP

SEQ ID NO: 252 - protein, 7 aa, Artificial Sequence
  Synthetic construct
PPYWPGP

SEQ ID NO: 253 - protein, 7 aa, Artificial Sequence
  Synthetic construct
PPYWPNP

SEQ ID NO: 254 - protein, 7 aa, Artificial Sequence
  Synthetic construct
PPYWDGP

SEQ ID NO: 255 - protein, 7 aa, Artificial Sequence
  Synthetic construct
PPYWDNP

SEQ ID NO: 256 - protein, 7 aa, Artificial Sequence
  Synthetic construct
PPYWGGP

SEQ ID NO: 257 - protein, 7 aa, Artificial Sequence
  Synthetic construct
PPYWGNP

SEQ ID NO: 258 - protein, 7 aa, Artificial Sequence
  Synthetic construct
PPYWCGP

SEQ ID NO: 259 - protein, 7 aa, Artificial Sequence
  Synthetic construct
PPYWCNP

SEQ ID NO: 260 - protein, 7 aa, Artificial Sequence
  Synthetic construct
PPYWAGP

SEQ ID NO: 261 - protein, 7 aa, Artificial Sequence
  Synthetic construct
PPYWANP

SEQ ID NO: 262 - protein, 7 aa, Artificial Sequence
  Synthetic construct
PPYYWGP

SEQ ID NO: 263 - protein, 7 aa, Artificial Sequence
  Synthetic construct
PPYYWNP

SEQ ID NO: 264 - protein, 7 aa, Artificial Sequence
  Synthetic construct
PPYYIGP

SEQ ID NO: 265 - protein, 7 aa, Artificial Sequence
  Synthetic construct
PPYYINP

SEQ ID NO: 266 - protein, 7 aa, Artificial Sequence
  Synthetic construct
PPYYFGP

SEQ ID NO: 267 - protein, 7 aa, Artificial Sequence
  Synthetic construct
PPYYFNP

SEQ ID NO: 268 - protein, 7 aa, Artificial Sequence
  Synthetic construct
PPYYPGP

SEQ ID NO: 269 - protein, 7 aa, Artificial Sequence
  Synthetic construct
PPYYPNP

SEQ ID NO: 270 - protein, 7 aa, Artificial Sequence
  Synthetic construct
PPYYDGP

SEQ ID NO: 271 - protein, 7 aa, Artificial Sequence
  Synthetic construct
PPYYDNP

SEQ ID NO: 272 - protein, 7 aa, Artificial Sequence
  Synthetic construct
PPYYGGP

SEQ ID NO: 273 - protein, 7 aa, Artificial Sequence
  Synthetic construct
PPYYGNP

SEQ ID NO: 274 - protein, 7 aa, Artificial Sequence
  Synthetic construct
PPYYCGP

SEQ ID NO: 275 - protein, 7 aa, Artificial Sequence
  Synthetic construct
PPYYCNP

SEQ ID NO: 276 - protein, 7 aa, Artificial Sequence
  Synthetic construct
PPYYAGP

SEQ ID NO: 277 - protein, 7 aa, Artificial Sequence
  Synthetic construct
PPYYANP

SEQ ID NO: 278 - protein, 7 aa, Artificial Sequence
  Synthetic construct
PPYFWGP

SEQ ID NO: 279 - protein, 7 aa, Artificial Sequence
  Synthetic construct
PPYFWNP

SEQ ID NO: 280 - protein, 7 aa, Artificial Sequence
  Synthetic construct
PPYFIGP

SEQ ID NO: 281 - protein, 7 aa, Artificial Sequence
  Synthetic construct
PPYFINP

SEQ ID NO: 282 - protein, 7 aa, Artificial Sequence
  Synthetic construct
PPYFFGP

SEQ ID NO: 283 - protein, 7 aa, Artificial Sequence
  Synthetic construct
PPYFFNP

SEQ ID NO: 284 - protein, 7 aa, Artificial Sequence
  Synthetic construct
PPYFPGP

SEQ ID NO: 285 - protein, 7 aa, Artificial Sequence
  Synthetic construct
PPYFPNP

SEQ ID NO: 286 - protein, 7 aa, Artificial Sequence
  Synthetic construct
PPYFDGP

SEQ ID NO: 287 - protein, 7 aa, Artificial Sequence
  Synthetic construct
PPYFDNP

SEQ ID NO: 288 - protein, 7 aa, Artificial Sequence
  Synthetic construct
PPYFGGP

SEQ ID NO: 289 - protein, 7 aa, Artificial Sequence
  Synthetic construct
PPYFGNP

SEQ ID NO: 290 - protein, 7 aa, Artificial Sequence
  Synthetic construct
PPYFCGP

SEQ ID NO: 291 - protein, 7 aa, Artificial Sequence
  Synthetic construct
PPYFCNP

SEQ ID NO: 292 - protein, 7 aa, Artificial Sequence
  Synthetic construct
PPYFAGP

SEQ ID NO: 293 - protein, 7 aa, Artificial Sequence
  Synthetic construct
PPYFANP

SEQ ID NO: 294 - protein, 7 aa, Artificial Sequence
  Synthetic construct
PPYAWGP

SEQ ID NO: 295 - protein, 7 aa, Artificial Sequence
  Synthetic construct
PPYAWNP

SEQ ID NO: 296 - protein, 7 aa, Artificial Sequence
  Synthetic construct
PPYAIGP

SEQ ID NO: 297 - protein, 7 aa, Artificial Sequence
  Synthetic construct
PPYAINP

SEQ ID NO: 298 - protein, 7 aa, Artificial Sequence
  Synthetic construct
PPYAFGP

SEQ ID NO: 299 - protein, 7 aa, Artificial Sequence
  Synthetic construct
PPYAFNP

SEQ ID NO: 300 - protein, 7 aa, Artificial Sequence
  Synthetic construct
PPYAPGP

SEQ ID NO: 301 - protein, 7 aa, Artificial Sequence
  Synthetic construct
PPYAPNP

SEQ ID NO: 302 - protein, 7 aa, Artificial Sequence
  Synthetic construct
PPYADGP

SEQ ID NO: 303 - protein, 7 aa, Artificial Sequence
  Synthetic construct
PPYADNP

SEQ ID NO: 304 - protein, 7 aa, Artificial Sequence
  Synthetic construct
PPYAGGP

SEQ ID NO: 305 - protein, 7 aa, Artificial Sequence
  Synthetic construct
PPYAGNP

SEQ ID NO: 306 - protein, 7 aa, Artificial Sequence
  Synthetic construct
PPYACGP

SEQ ID NO: 307 - protein, 7 aa, Artificial Sequence
  Synthetic construct
PPYACNP

SEQ ID NO: 308 - protein, 7 aa, Artificial Sequence
  Synthetic construct
PPYAAGP

SEQ ID NO: 309 - protein, 7 aa, Artificial Sequence
  Synthetic construct
PPYAANP

SEQ ID NO: 310 - protein, 7 aa, Artificial Sequence
  Synthetic construct
PPYVWGP

SEQ ID NO: 311 - protein, 7 aa, Artificial Sequence
  Synthetic construct
PPYVWNP

SEQ ID NO: 312 - protein, 7 aa, Artificial Sequence
  Synthetic construct
PPYVIGP

SEQ ID NO: 313 - protein, 7 aa, Artificial Sequence
  Synthetic construct
PPYVINP

SEQ ID NO: 314 - protein, 7 aa, Artificial Sequence
  Synthetic construct
PPYVFGP

SEQ ID NO: 315 - protein, 7 aa, Artificial Sequence
  Synthetic construct
PPYVFNP

SEQ ID NO: 316 - protein, 7 aa, Artificial Sequence
  Synthetic construct
PPYVPGP

SEQ ID NO: 317 - protein, 7 aa, Artificial Sequence
  Synthetic construct
PPYVPNP

SEQ ID NO: 318 - protein, 7 aa, Artificial Sequence
  Synthetic construct
PPYVDGP

SEQ ID NO: 319 - protein, 7 aa, Artificial Sequence
  Synthetic construct
PPYVDNP

SEQ ID NO: 320 - protein, 7 aa, Artificial Sequence
  Synthetic construct
PPYVGGP

SEQ ID NO: 321 - protein, 7 aa, Artificial Sequence
  Synthetic construct
PPYVGNP

SEQ ID NO: 322 - protein, 7 aa, Artificial Sequence
  Synthetic construct
PPYVCGP

SEQ ID NO: 323 - protein, 7 aa, Artificial Sequence
  Synthetic construct
PPYVCNP

SEQ ID NO: 324 - protein, 7 aa, Artificial Sequence
  Synthetic construct
PPYVAGP

SEQ ID NO: 325 - protein, 7 aa, Artificial Sequence
  Synthetic construct
PPYVANP

SEQ ID NO: 326 - protein, 7 aa, Artificial Sequence
  Synthetic construct
PPYCWGP

SEQ ID NO: 327 - protein, 7 aa, Artificial Sequence
  Synthetic construct
PPYCWNP

SEQ ID NO: 328 - protein, 7 aa, Artificial Sequence
  Synthetic construct
PPYCIGP

SEQ ID NO: 329 - protein, 7 aa, Artificial Sequence
  Synthetic construct
PPYCINP

SEQ ID NO: 330 - protein, 7 aa, Artificial Sequence
  Synthetic construct
PPYCFGP

SEQ ID NO: 331 - protein, 7 aa, Artificial Sequence
  Synthetic construct
PPYCFNP

SEQ ID NO: 332 - protein, 7 aa, Artificial Sequence
  Synthetic construct
PPYCPGP

SEQ ID NO: 333 - protein, 7 aa, Artificial Sequence
  Synthetic construct
PPYCPNP

SEQ ID NO: 334 - protein, 7 aa, Artificial Sequence
  Synthetic construct
PPYCDGP

SEQ ID NO: 335 - protein, 7 aa, Artificial Sequence
  Synthetic construct
PPYCDNP

SEQ ID NO: 336 - protein, 7 aa, Artificial Sequence
  Synthetic construct
PPYCGGP

SEQ ID NO: 337 - protein, 7 aa, Artificial Sequence
  Synthetic construct
PPYCGNP

SEQ ID NO: 338 - protein, 7 aa, Artificial Sequence
  Synthetic construct
PPYCCGP

SEQ ID NO: 339 - protein, 7 aa, Artificial Sequence
  Synthetic construct
PPYCCNP

SEQ ID NO: 340 - protein, 7 aa, Artificial Sequence
  Synthetic construct
PPYCAGP

SEQ ID NO: 341 - protein, 7 aa, Artificial Sequence
  Synthetic construct
PPYCANP

SEQ ID NO: 342 - protein, 7 aa, Artificial Sequence
  Synthetic construct
PPYTWGP

SEQ ID NO: 343 - protein, 7 aa, Artificial Sequence
  Synthetic construct
PPYTWNP

SEQ ID NO: 344 - protein, 7 aa, Artificial Sequence
  Synthetic construct
PPYTIGP

SEQ ID NO: 345 - protein, 7 aa, Artificial Sequence
  Synthetic construct
PPYTINP

SEQ ID NO: 346 - protein, 7 aa, Artificial Sequence
  Synthetic construct
PPYTFGP

SEQ ID NO: 347 - protein, 7 aa, Artificial Sequence
  Synthetic construct
PPYTFNP

SEQ ID NO: 348 - protein, 7 aa, Artificial Sequence
  Synthetic construct
PPYTPGP

SEQ ID NO: 349 - protein, 7 aa, Artificial Sequence
  Synthetic construct
PPYTPNP

SEQ ID NO: 350 - protein, 7 aa, Artificial Sequence
  Synthetic construct
PPYTDGP

SEQ ID NO: 351 - protein, 7 aa, Artificial Sequence
  Synthetic construct
PPYTDNP

SEQ ID NO: 352 - protein, 7 aa, Artificial Sequence
  Synthetic construct
PPYTGGP

SEQ ID NO: 353 - protein, 7 aa, Artificial Sequence
  Synthetic construct
PPYTGNP

SEQ ID NO: 354 - protein, 7 aa, Artificial Sequence
  Synthetic construct
PPYTCGP

SEQ ID NO: 355 - protein, 7 aa, Artificial Sequence
  Synthetic construct
PPYTCNP

SEQ ID NO: 356 - protein, 7 aa, Artificial Sequence
  Synthetic construct
PPYTAGP

SEQ ID NO: 357 - protein, 7 aa, Artificial Sequence
  Synthetic construct
PPYTANP

SEQ ID NO: 358 - protein, 7 aa, Artificial Sequence
  Synthetic construct
PPYLWGP

SEQ ID NO: 359 - protein, 7 aa, Artificial Sequence
  Synthetic construct
PPYLWNP

SEQ ID NO: 360 - protein, 7 aa, Artificial Sequence
  Synthetic construct
PPYLIGP

SEQ ID NO: 361 - protein, 7 aa, Artificial Sequence
  Synthetic construct
PPYLINP

SEQ ID NO: 362 - protein, 7 aa, Artificial Sequence
  Synthetic construct
PPYLFGP

SEQ ID NO: 363 - protein, 7 aa, Artificial Sequence
  Synthetic construct
PPYLFNP

SEQ ID NO: 364 - protein, 7 aa, Artificial Sequence
  Synthetic construct
PPYLPGP

SEQ ID NO: 365 - protein, 7 aa, Artificial Sequence
  Synthetic construct
PPYLPNP

SEQ ID NO: 366 - protein, 7 aa, Artificial Sequence
  Synthetic construct
PPYLDGP

SEQ ID NO: 367 - protein, 7 aa, Artificial Sequence
  Synthetic construct
PPYLDNP

SEQ ID NO: 368 - protein, 7 aa, Artificial Sequence
  Synthetic construct
PPYLGGP

SEQ ID NO: 369 - protein, 7 aa, Artificial Sequence
  Synthetic construct
PPYLGNP

SEQ ID NO: 370 - protein, 7 aa, Artificial Sequence
  Synthetic construct
PPYLCGP

SEQ ID NO: 371 - protein, 7 aa, Artificial Sequence
  Synthetic construct
PPYLCNP

SEQ ID NO: 372 - protein, 7 aa, Artificial Sequence
  Synthetic construct
PPYLAGP

SEQ ID NO: 373 - protein, 7 aa, Artificial Sequence
  Synthetic construct
PPYLANP

SEQ ID NO: 374 - protein, 7 aa, Artificial Sequence
  Synthetic construct
PPYSWGP

SEQ ID NO: 375 - protein, 7 aa, Artificial Sequence
  Synthetic construct
PPYSWNP

SEQ ID NO: 376 - protein, 7 aa, Artificial Sequence
  Synthetic construct
PPYSIGP

SEQ ID NO: 377 - protein, 7 aa, Artificial Sequence
  Synthetic construct
PPYSINP

SEQ ID NO: 378 - protein, 7 aa, Artificial Sequence
  Synthetic construct
PPYSFGP

SEQ ID NO: 379 - protein, 7 aa, Artificial Sequence
  Synthetic construct
PPYSFNP

SEQ ID NO: 380 - protein, 7 aa, Artificial Sequence
  Synthetic construct
PPYSPGP

SEQ ID NO: 381 - protein, 7 aa, Artificial Sequence
  Synthetic construct
PPYSPNP

SEQ ID NO: 382 - protein, 7 aa, Artificial Sequence
  Synthetic construct
PPYSDGP

SEQ ID NO: 383 - protein, 7 aa, Artificial Sequence
  Synthetic construct
PPYSDNP

SEQ ID NO: 384 - protein, 7 aa, Artificial Sequence
  Synthetic construct
PPYSGGP

SEQ ID NO: 385 - protein, 7 aa, Artificial Sequence
  Synthetic construct
PPYSGNP

SEQ ID NO: 386 - protein, 7 aa, Artificial Sequence
  Synthetic construct
PPYSCGP

SEQ ID NO: 387 - protein, 7 aa, Artificial Sequence
  Synthetic construct
PPYSCNP

SEQ ID NO: 388 - protein, 7 aa, Artificial Sequence
  Synthetic construct
PPYSAGP

SEQ ID NO: 389 - protein, 7 aa, Artificial Sequence
  Synthetic construct
PPYSANP

SEQ ID NO: 390 - protein, 7 aa, Artificial Sequence
  Synthetic construct
PPYHWGP

SEQ ID NO: 391 - protein, 7 aa, Artificial Sequence
  Synthetic construct
PPYHWNP

SEQ ID NO: 392 - protein, 7 aa, Artificial Sequence
  Synthetic construct
PPYHIGP

SEQ ID NO: 393 - protein, 7 aa, Artificial Sequence
  Synthetic construct
PPYHINP

SEQ ID NO: 394 - protein, 7 aa, Artificial Sequence
  Synthetic construct
PPYHFGP

SEQ ID NO: 395 - protein, 7 aa, Artificial Sequence
  Synthetic construct
PPYHFNP

SEQ ID NO: 396 - protein, 7 aa, Artificial Sequence
  Synthetic construct
PPYHPGP

SEQ ID NO: 397 - protein, 7 aa, Artificial Sequence
  Synthetic construct
PPYHPNP

SEQ ID NO: 398 - protein, 7 aa, Artificial Sequence
  Synthetic construct
PPYHDGP

SEQ ID NO: 399 - protein, 7 aa, Artificial Sequence
  Synthetic construct
PPYHDNP

SEQ ID NO: 400 - protein, 7 aa, Artificial Sequence
  Synthetic construct
PPYHGGP

SEQ ID NO: 401 - protein, 7 aa, Artificial Sequence
  Synthetic construct
PPYHGNP

SEQ ID NO: 402 - protein, 7 aa, Artificial Sequence
  Synthetic construct
PPYHCGP

SEQ ID NO: 403 - protein, 7 aa, Artificial Sequence
  Synthetic construct
PPYHCNP

SEQ ID NO: 404 - protein, 7 aa, Artificial Sequence
  Synthetic construct
PPYHAGP

SEQ ID NO: 405 - protein, 7 aa, Artificial Sequence
  Synthetic construct
PPYHANP

SEQ ID NO: 406 - protein, 7 aa, Artificial Sequence
  Synthetic construct
PPYQWGP

SEQ ID NO: 407 - protein, 7 aa, Artificial Sequence
  Synthetic construct
PPYQWNP

SEQ ID NO: 408 - protein, 7 aa, Artificial Sequence
  Synthetic construct
PPYQIGP

SEQ ID NO: 409 - protein, 7 aa, Artificial Sequence
  Synthetic construct
PPYQINP

SEQ ID NO: 410 - protein, 7 aa, Artificial Sequence
  Synthetic construct
PPYQFGP

SEQ ID NO: 411 - protein, 7 aa, Artificial Sequence
  Synthetic construct
PPYQFNP

SEQ ID NO: 412 - protein, 7 aa, Artificial Sequence
  Synthetic construct
PPYQPGP

SEQ ID NO: 413 - protein, 7 aa, Artificial Sequence
  Synthetic construct
PPYQPNP

SEQ ID NO: 414 - protein, 7 aa, Artificial Sequence
  Synthetic construct
PPYQDGP

SEQ ID NO: 415 - protein, 7 aa, Artificial Sequence
  Synthetic construct
PPYQDNP

SEQ ID NO: 416 - protein, 7 aa, Artificial Sequence
  Synthetic construct
PPYQGGP

SEQ ID NO: 417 - protein, 7 aa, Artificial Sequence
  Synthetic construct
PPYQGNP

SEQ ID NO: 418 - protein, 7 aa, Artificial Sequence
  Synthetic construct
PPYQCGP

SEQ ID NO: 419 - protein, 7 aa, Artificial Sequence
  Synthetic construct
PPYQCNP

SEQ ID NO: 420 - protein, 7 aa, Artificial Sequence
  Synthetic construct
PPYQAGP

SEQ ID NO: 421 - protein, 7 aa, Artificial Sequence
  Synthetic construct
PPYQANP

SEQ ID NO: 422 - protein, 7 aa, Artificial Sequence
  Synthetic construct
PPYEWGP

SEQ ID NO: 423 - protein, 7 aa, Artificial Sequence
  Synthetic construct
PPYEWNP

SEQ ID NO: 424 - protein, 7 aa, Artificial Sequence
  Synthetic construct
PPYEIGP

SEQ ID NO: 425 - protein, 7 aa, Artificial Sequence
  Synthetic construct
PPYEINP

SEQ ID NO: 426 - protein, 7 aa, Artificial Sequence
  Synthetic construct
PPYEFGP

SEQ ID NO: 427 - protein, 7 aa, Artificial Sequence
  Synthetic construct
PPYEFNP

SEQ ID NO: 428 - protein, 7 aa, Artificial Sequence
  Synthetic construct
PPYEPGP

SEQ ID NO: 429 - protein, 7 aa, Artificial Sequence
  Synthetic construct
PPYEPNP

SEQ ID NO: 430 - protein, 7 aa, Artificial Sequence
  Synthetic construct
PPYEDGP

SEQ ID NO: 431 - protein, 7 aa, Artificial Sequence
  Synthetic construct
PPYEDNP

SEQ ID NO: 432 - protein, 7 aa, Artificial Sequence
  Synthetic construct
PPYEGGP

SEQ ID NO: 433 - protein, 7 aa, Artificial Sequence
  Synthetic construct
PPYEGNP

SEQ ID NO: 434 - protein, 7 aa, Artificial Sequence
  Synthetic construct
PPYECGP

SEQ ID NO: 435 - protein, 7 aa, Artificial Sequence
  Synthetic construct
PPYECNP

SEQ ID NO: 436 - protein, 7 aa, Artificial Sequence
  Synthetic construct
PPYEAGP

SEQ ID NO: 437 - protein, 7 aa, Artificial Sequence
  Synthetic construct
PPYEANP

SEQ ID NO: 438 - protein, 7 aa, Artificial Sequence
  Synthetic construct
PPYGWGP

SEQ ID NO: 439 - protein, 7 aa, Artificial Sequence
  Synthetic construct
PPYGWNP

SEQ ID NO: 440 - protein, 7 aa, Artificial Sequence
  Synthetic construct
PPYGIGP

SEQ ID NO: 441 - protein, 7 aa, Artificial Sequence
  Synthetic construct
PPYGINP

SEQ ID NO: 442 - protein, 7 aa, Artificial Sequence
  Synthetic construct
PPYGFGP

SEQ ID NO: 443 - protein, 7 aa, Artificial Sequence
  Synthetic construct
PPYGFNP

SEQ ID NO: 444 - protein, 7 aa, Artificial Sequence
  Synthetic construct
PPYGPGP

SEQ ID NO: 445 - protein, 7 aa, Artificial Sequence
  Synthetic construct
PPYGPNP

SEQ ID NO: 446 - protein, 7 aa, Artificial Sequence
  Synthetic construct
PPYGDGP

SEQ ID NO: 447 - protein, 7 aa, Artificial Sequence
  Synthetic construct
PPYGDNP

SEQ ID NO: 448 - protein, 7 aa, Artificial Sequence
  Synthetic construct
PPYGGGP

SEQ ID NO: 449 - protein, 7 aa, Artificial Sequence
  Synthetic construct
PPYGGNP

SEQ ID NO: 450 - protein, 7 aa, Artificial Sequence
  Synthetic construct
PPYGCGP

SEQ ID NO: 451 - protein, 7 aa, Artificial Sequence
  Synthetic construct
PPYGCNP

SEQ ID NO: 452 - protein, 7 aa, Artificial Sequence
  Synthetic construct
PPYGAGP

SEQ ID NO: 453 - protein, 7 aa, Artificial Sequence
  Synthetic construct
PPYGANP

SEQ ID NO: 454 - protein, 7 aa, Artificial Sequence
  Synthetic construct
PPYIWGP

SEQ ID NO: 455 - protein, 7 aa, Artificial Sequence
  Synthetic construct
PPYIWNP

SEQ ID NO: 456 - protein, 7 aa, Artificial Sequence
  Synthetic construct
PPYIIGP

SEQ ID NO: 457 - protein, 7 aa, Artificial Sequence
  Synthetic construct
PPYIINP

SEQ ID NO: 458 - protein, 7 aa, Artificial Sequence
  Synthetic construct
PPYIFGP

SEQ ID NO: 459 - protein, 7 aa, Artificial Sequence
  Synthetic construct
PPYIFNP

SEQ ID NO: 460 - protein, 7 aa, Artificial Sequence
  Synthetic construct
PPYIPGP

SEQ ID NO: 461 - protein, 7 aa, Artificial Sequence
  Synthetic construct
PPYIPNP

SEQ ID NO: 462 - protein, 7 aa, Artificial Sequence
  Synthetic construct
PPYIDGP

SEQ ID NO: 463 - protein, 7 aa, Artificial Sequence
  Synthetic construct
PPYIDNP

SEQ ID NO: 464 - protein, 7 aa, Artificial Sequence
  Synthetic construct
PPYIGGP

SEQ ID NO: 465 - protein, 7 aa, Artificial Sequence
  Synthetic construct
PPYIGNP

SEQ ID NO: 466 - protein, 7 aa, Artificial Sequence
  Synthetic construct
PPYICGP

SEQ ID NO: 467 - protein, 7 aa, Artificial Sequence
  Synthetic construct
PPYICNP

SEQ ID NO: 468 - protein, 7 aa, Artificial Sequence
  Synthetic construct
PPYIAGP

SEQ ID NO: 469 - protein, 7 aa, Artificial Sequence
  Synthetic construct
PPYIANP

SEQ ID NO: 470 - protein, 7 aa, Artificial Sequence
  Synthetic construct
PPPWWGP

SEQ ID NO: 471 - protein, 7 aa, Artificial Sequence
  Synthetic construct
PPPWWNP

SEQ ID NO: 472 - protein, 7 aa, Artificial Sequence
  Synthetic construct
PPPWIGP

SEQ ID NO: 473 - protein, 7 aa, Artificial Sequence
  Synthetic construct
PPPWINP

SEQ ID NO: 474 - protein, 7 aa, Artificial Sequence
  Synthetic construct
PPPWFGP

SEQ ID NO: 475 - protein, 7 aa, Artificial Sequence
  Synthetic construct
PPPWFNP

SEQ ID NO: 476 - protein, 7 aa, Artificial Sequence
  Synthetic construct
PPPWPGP

SEQ ID NO: 477 - protein, 7 aa, Artificial Sequence
  Synthetic construct
PPPWPNP

SEQ ID NO: 478 - protein, 7 aa, Artificial Sequence
  Synthetic construct
PPPWDGP

SEQ ID NO: 479 - protein, 7 aa, Artificial Sequence
  Synthetic construct
PPPWDNP

SEQ ID NO: 480 - protein, 7 aa, Artificial Sequence
  Synthetic construct
PPPWGGP

SEQ ID NO: 481 - protein, 7 aa, Artificial Sequence
  Synthetic construct
PPPWGNP

SEQ ID NO: 482 - protein, 7 aa, Artificial Sequence
  Synthetic construct
PPPWCGP

SEQ ID NO: 483 - protein, 7 aa, Artificial Sequence
  Synthetic construct
PPPWCNP

SEQ ID NO: 484 - protein, 7 aa, Artificial Sequence
  Synthetic construct
PPPWAGP

SEQ ID NO: 485 - protein, 7 aa, Artificial Sequence
  Synthetic construct
PPPWANP

SEQ ID NO: 486 - protein, 7 aa, Artificial Sequence
  Synthetic construct
PPPYWGP

SEQ ID NO: 487 - protein, 7 aa, Artificial Sequence
  Synthetic construct
PPPYWNP

SEQ ID NO: 488 - protein, 7 aa, Artificial Sequence
  Synthetic construct
PPPYIGP

SEQ ID NO: 489 - protein, 7 aa, Artificial Sequence
  Synthetic construct
PPPYINP

SEQ ID NO: 490 - protein, 7 aa, Artificial Sequence
  Synthetic construct
PPPYFGP

SEQ ID NO: 491 - protein, 7 aa, Artificial Sequence
  Synthetic construct
PPPYFNP

SEQ ID NO: 492 - protein, 7 aa, Artificial Sequence
  Synthetic construct
PPPYPGP

SEQ ID NO: 493 - protein, 7 aa, Artificial Sequence
  Synthetic construct
PPPYPNP

SEQ ID NO: 494 - protein, 7 aa, Artificial Sequence
  Synthetic construct
PPPYDGP

SEQ ID NO: 495 - protein, 7 aa, Artificial Sequence
  Synthetic construct
PPPYDNP

SEQ ID NO: 496 - protein, 7 aa, Artificial Sequence
  Synthetic construct
PPPYGGP

SEQ ID NO: 497 - protein, 7 aa, Artificial Sequence
  Synthetic construct
PPPYGNP

SEQ ID NO: 498 - protein, 7 aa, Artificial Sequence
  Synthetic construct
PPPYCGP

SEQ ID NO: 499 - protein, 7 aa, Artificial Sequence
  Synthetic construct
PPPYCNP

SEQ ID NO: 500 - protein, 7 aa, Artificial Sequence
  Synthetic construct
PPPYAGP

SEQ ID NO: 501 - protein, 7 aa, Artificial Sequence
  Synthetic construct
PPPYANP

SEQ ID NO: 502 - protein, 7 aa, Artificial Sequence
  Synthetic construct
PPPFWGP

SEQ ID NO: 503 - protein, 7 aa, Artificial Sequence
  Synthetic construct
PPPFWNP

SEQ ID NO: 504 - protein, 7 aa, Artificial Sequence
  Synthetic construct
PPPFIGP

SEQ ID NO: 505 - protein, 7 aa, Artificial Sequence
  Synthetic construct
PPPFINP

SEQ ID NO: 506 - protein, 7 aa, Artificial Sequence
  Synthetic construct
PPPFFGP

SEQ ID NO: 507 - protein, 7 aa, Artificial Sequence
  Synthetic construct
PPPFFNP

SEQ ID NO: 508 - protein, 7 aa, Artificial Sequence
  Synthetic construct
PPPFPGP

SEQ ID NO: 509 - protein, 7 aa, Artificial Sequence
  Synthetic construct
PPPFPNP

SEQ ID NO: 510 - protein, 7 aa, Artificial Sequence
  Synthetic construct
PPPFDGP

SEQ ID NO: 511 - protein, 7 aa, Artificial Sequence
  Synthetic construct
PPPFDNP

SEQ ID NO: 512 - protein, 7 aa, Artificial Sequence
  Synthetic construct
PPPFGGP

SEQ ID NO: 513 - protein, 7 aa, Artificial Sequence
  Synthetic construct
PPPFGNP

SEQ ID NO: 514 - protein, 7 aa, Artificial Sequence
  Synthetic construct
PPPFCGP

SEQ ID NO: 515 - protein, 7 aa, Artificial Sequence
  Synthetic construct
PPPFCNP

SEQ ID NO: 516 - protein, 7 aa, Artificial Sequence
  Synthetic construct
PPPFAGP

SEQ ID NO: 517 - protein, 7 aa, Artificial Sequence
  Synthetic construct
PPPFANP

SEQ ID NO: 518 - protein, 7 aa, Artificial Sequence
  Synthetic construct
PPPAWGP

SEQ ID NO: 519 - protein, 7 aa, Artificial Sequence
  Synthetic construct
PPPAWNP

SEQ ID NO: 520 - protein, 7 aa, Artificial Sequence
  Synthetic construct
PPPAIGP

SEQ ID NO: 521 - protein, 7 aa, Artificial Sequence
  Synthetic construct
PPPAINP

SEQ ID NO: 522 - protein, 7 aa, Artificial Sequence
  Synthetic construct
PPPAFGP

SEQ ID NO: 523 - protein, 7 aa, Artificial Sequence
  Synthetic construct
PPPAFNP

SEQ ID NO: 524 - protein, 7 aa, Artificial Sequence
  Synthetic construct
PPPAPGP

SEQ ID NO: 525 - protein, 7 aa, Artificial Sequence
  Synthetic construct
PPPAPNP

SEQ ID NO: 526 - protein, 7 aa, Artificial Sequence
  Synthetic construct
PPPADGP

SEQ ID NO: 527 - protein, 7 aa, Artificial Sequence
  Synthetic construct
PPPADNP

SEQ ID NO: 528 - protein, 7 aa, Artificial Sequence
  Synthetic construct
PPPAGGP

SEQ ID NO: 529 - protein, 7 aa, Artificial Sequence
  Synthetic construct
PPPAGNP

SEQ ID NO: 530 - protein, 7 aa, Artificial Sequence
  Synthetic construct
PPPACGP

SEQ ID NO: 531 - protein, 7 aa, Artificial Sequence
  Synthetic construct
PPPACNP

SEQ ID NO: 532 - protein, 7 aa, Artificial Sequence
  Synthetic construct
PPPAAGP

SEQ ID NO: 533 - protein, 7 aa, Artificial Sequence
  Synthetic construct
PPPAANP

SEQ ID NO: 534 - protein, 7 aa, Artificial Sequence
  Synthetic construct
PPPVWGP

SEQ ID NO: 535 - protein, 7 aa, Artificial Sequence
  Synthetic construct
PPPVWNP

SEQ ID NO: 536 - protein, 7 aa, Artificial Sequence
  Synthetic construct
PPPVIGP

SEQ ID NO: 537 - protein, 7 aa, Artificial Sequence
  Synthetic construct
PPPVINP

SEQ ID NO: 538 - protein, 7 aa, Artificial Sequence
  Synthetic construct
PPPVFGP

SEQ ID NO: 539 - protein, 7 aa, Artificial Sequence
  Synthetic construct
PPPVFNP

SEQ ID NO: 540 - protein, 7 aa, Artificial Sequence
  Synthetic construct
PPPVPGP

SEQ ID NO: 541 - protein, 7 aa, Artificial Sequence
  Synthetic construct
PPPVPNP

SEQ ID NO: 542 - protein, 7 aa, Artificial Sequence
  Synthetic construct
PPPVDGP

SEQ ID NO: 543 - protein, 7 aa, Artificial Sequence
  Synthetic construct
PPPVDNP

SEQ ID NO: 544 - protein, 7 aa, Artificial Sequence
  Synthetic construct
PPPVGGP

SEQ ID NO: 545 - protein, 7 aa, Artificial Sequence
  Synthetic construct
PPPVGNP

SEQ ID NO: 546 - protein, 7 aa, Artificial Sequence
  Synthetic construct
PPPVCGP

SEQ ID NO: 547 - protein, 7 aa, Artificial Sequence
  Synthetic construct
PPPVCNP

SEQ ID NO: 548 - protein, 7 aa, Artificial Sequence
  Synthetic construct
PPPVAGP

SEQ ID NO: 549 - protein, 7 aa, Artificial Sequence
  Synthetic construct
PPPVANP

SEQ ID NO: 550 - protein, 7 aa, Artificial Sequence
  Synthetic construct
PPPCWGP

SEQ ID NO: 551 - protein, 7 aa, Artificial Sequence
  Synthetic construct
PPPCWNP

SEQ ID NO: 552 - protein, 7 aa, Artificial Sequence
  Synthetic construct
PPPCIGP

SEQ ID NO: 553 - protein, 7 aa, Artificial Sequence
  Synthetic construct
PPPCINP

SEQ ID NO: 554 - protein, 7 aa, Artificial Sequence
  Synthetic construct
PPPCFGP

SEQ ID NO: 555 - protein, 7 aa, Artificial Sequence
  Synthetic construct
PPPCFNP

SEQ ID NO: 556 - protein, 7 aa, Artificial Sequence
  Synthetic construct
PPPCPGP

SEQ ID NO: 557 - protein, 7 aa, Artificial Sequence
  Synthetic construct
PPPCPNP

SEQ ID NO: 558 - protein, 7 aa, Artificial Sequence
  Synthetic construct
PPPCDGP

SEQ ID NO: 559 - protein, 7 aa, Artificial Sequence
  Synthetic construct
PPPCDNP

SEQ ID NO: 560 - protein, 7 aa, Artificial Sequence
  Synthetic construct
PPPCGGP

SEQ ID NO: 561 - protein, 7 aa, Artificial Sequence
  Synthetic construct
PPPCGNP

SEQ ID NO: 562 - protein, 7 aa, Artificial Sequence
  Synthetic construct
PPPCCGP

SEQ ID NO: 563 - protein, 7 aa, Artificial Sequence
  Synthetic construct
PPPCCNP

SEQ ID NO: 564 - protein, 7 aa, Artificial Sequence
  Synthetic construct
PPPCAGP

SEQ ID NO: 565 - protein, 7 aa, Artificial Sequence
  Synthetic construct
PPPCANP

SEQ ID NO: 566 - protein, 7 aa, Artificial Sequence
  Synthetic construct
PPPTWGP

SEQ ID NO: 567 - protein, 7 aa, Artificial Sequence
  Synthetic construct
PPPTWNP

SEQ ID NO: 568 - protein, 7 aa, Artificial Sequence
  Synthetic construct
PPPTIGP

SEQ ID NO: 569 - protein, 7 aa, Artificial Sequence
  Synthetic construct
PPPTINP

SEQ ID NO: 570 - protein, 7 aa, Artificial Sequence
  Synthetic construct
PPPTFGP

SEQ ID NO: 571 - protein, 7 aa, Artificial Sequence
  Synthetic construct
PPPTFNP

SEQ ID NO: 572 - protein, 7 aa, Artificial Sequence
  Synthetic construct
PPPTPGP

SEQ ID NO: 573 - protein, 7 aa, Artificial Sequence
  Synthetic construct
PPPTPNP

SEQ ID NO: 574 - protein, 7 aa, Artificial Sequence
  Synthetic construct
PPPTDGP

SEQ ID NO: 575 - protein, 7 aa, Artificial Sequence
  Synthetic construct
PPPTDNP

SEQ ID NO: 576 - protein, 7 aa, Artificial Sequence
  Synthetic construct
PPPTGGP

SEQ ID NO: 577 - protein, 7 aa, Artificial Sequence
  Synthetic construct
PPPTGNP

SEQ ID NO: 578 - protein, 7 aa, Artificial Sequence
  Synthetic construct
PPPTCGP

SEQ ID NO: 579 - protein, 7 aa, Artificial Sequence
  Synthetic construct
PPPTCNP

SEQ ID NO: 580 - protein, 7 aa, Artificial Sequence
  Synthetic construct
PPPTAGP

SEQ ID NO: 581 - protein, 7 aa, Artificial Sequence
  Synthetic construct
PPPTANP

SEQ ID NO: 582 - protein, 7 aa, Artificial Sequence
  Synthetic construct
PPPLWGP

SEQ ID NO: 583 - protein, 7 aa, Artificial Sequence
  Synthetic construct
PPPLWNP

SEQ ID NO: 584 - protein, 7 aa, Artificial Sequence
  Synthetic construct
PPPLIGP

SEQ ID NO: 585 - protein, 7 aa, Artificial Sequence
  Synthetic construct
PPPLINP

SEQ ID NO: 586 - protein, 7 aa, Artificial Sequence
  Synthetic construct
PPPLFGP

SEQ ID NO: 587 - protein, 7 aa, Artificial Sequence
  Synthetic construct
PPPLFNP

SEQ ID NO: 588 - protein, 7 aa, Artificial Sequence
  Synthetic construct
PPPLPGP

SEQ ID NO: 589 - protein, 7 aa, Artificial Sequence
  Synthetic construct
PPPLPNP

SEQ ID NO: 590 - protein, 7 aa, Artificial Sequence
  Synthetic construct
PPPLDGP

SEQ ID NO: 591 - protein, 7 aa, Artificial Sequence
  Synthetic construct
PPPLDNP

SEQ ID NO: 592 - protein, 7 aa, Artificial Sequence
  Synthetic construct
PPPLGGP

SEQ ID NO: 593 - protein, 7 aa, Artificial Sequence
  Synthetic construct
PPPLGNP

SEQ ID NO: 594 - protein, 7 aa, Artificial Sequence
  Synthetic construct
PPPLCGP

SEQ ID NO: 595 - protein, 7 aa, Artificial Sequence
  Synthetic construct
PPPLCNP

SEQ ID NO: 596 - protein, 7 aa, Artificial Sequence
  Synthetic construct
PPPLAGP

SEQ ID NO: 597 - protein, 7 aa, Artificial Sequence
  Synthetic construct
PPPLANP

SEQ ID NO: 598 - protein, 7 aa, Artificial Sequence
  Synthetic construct
PPPSWGP

SEQ ID NO: 599 - protein, 7 aa, Artificial Sequence
  Synthetic construct
PPPSWNP

SEQ ID NO: 600 - protein, 7 aa, Artificial Sequence
  Synthetic construct
PPPSIGP

SEQ ID NO: 601 - protein, 7 aa, Artificial Sequence
  Synthetic construct
PPPSINP

SEQ ID NO: 602 - protein, 7 aa, Artificial Sequence
  Synthetic construct
PPPSFGP

SEQ ID NO: 603 - protein, 7 aa, Artificial Sequence
  Synthetic construct
PPPSFNP

SEQ ID NO: 604 - protein, 7 aa, Artificial Sequence
  Synthetic construct
PPPSPGP

SEQ ID NO: 605 - protein, 7 aa, Artificial Sequence
  Synthetic construct
PPPSPNP

SEQ ID NO: 606 - protein, 7 aa, Artificial Sequence
  Synthetic construct
PPPSDGP

SEQ ID NO: 607 - protein, 7 aa, Artificial Sequence
  Synthetic construct
PPPSDNP

SEQ ID NO: 608 - protein, 7 aa, Artificial Sequence
  Synthetic construct
PPPSGGP

SEQ ID NO: 609 - protein, 7 aa, Artificial Sequence
  Synthetic construct
PPPSGNP

SEQ ID NO: 610 - protein, 7 aa, Artificial Sequence
  Synthetic construct
PPPSCGP

SEQ ID NO: 611 - protein, 7 aa, Artificial Sequence
  Synthetic construct
PPPSCNP

SEQ ID NO: 612 - protein, 7 aa, Artificial Sequence
  Synthetic construct
PPPSAGP

SEQ ID NO: 613 - protein, 7 aa, Artificial Sequence
  Synthetic construct
PPPSANP

SEQ ID NO: 614 - protein, 7 aa, Artificial Sequence
  Synthetic construct
PPPHWGP

SEQ ID NO: 615 - protein, 7 aa, Artificial Sequence
  Synthetic construct
PPPHWNP

SEQ ID NO: 616 - protein, 7 aa, Artificial Sequence
  Synthetic construct
PPPHIGP

SEQ ID NO: 617 - protein, 7 aa, Artificial Sequence
  Synthetic construct
PPPHINP

SEQ ID NO: 618 - protein, 7 aa, Artificial Sequence
  Synthetic construct
PPPHFGP

SEQ ID NO: 619 - protein, 7 aa, Artificial Sequence
  Synthetic construct
PPPHFNP

SEQ ID NO: 620 - protein, 7 aa, Artificial Sequence
  Synthetic construct
PPPHPGP

SEQ ID NO: 621 - protein, 7 aa, Artificial Sequence
  Synthetic construct
PPPHPNP

SEQ ID NO: 622 - protein, 7 aa, Artificial Sequence
  Synthetic construct
PPPHDGP

SEQ ID NO: 623 - protein, 7 aa, Artificial Sequence
  Synthetic construct
PPPHDNP

SEQ ID NO: 624 - protein, 7 aa, Artificial Sequence
  Synthetic construct
PPPHGGP

SEQ ID NO: 625 - protein, 7 aa, Artificial Sequence
  Synthetic construct
PPPHGNP

SEQ ID NO: 626 - protein, 7 aa, Artificial Sequence
  Synthetic construct
PPPHCGP

SEQ ID NO: 627 - protein, 7 aa, Artificial Sequence
  Synthetic construct
PPPHCNP

SEQ ID NO: 628 - protein, 7 aa, Artificial Sequence
  Synthetic construct
PPPHAGP

SEQ ID NO: 629 - protein, 7 aa, Artificial Sequence
  Synthetic construct
PPPHANP

SEQ ID NO: 630 - protein, 7 aa, Artificial Sequence
  Synthetic construct
PPPQWGP

SEQ ID NO: 631 - protein, 7 aa, Artificial Sequence
  Synthetic construct
PPPQWNP

SEQ ID NO: 632 - protein, 7 aa, Artificial Sequence
  Synthetic construct
PPPQIGP

SEQ ID NO: 633 - protein, 7 aa, Artificial Sequence
  Synthetic construct
PPPQINP

SEQ ID NO: 634 - protein, 7 aa, Artificial Sequence
  Synthetic construct
PPPQFGP

SEQ ID NO: 635 - protein, 7 aa, Artificial Sequence
  Synthetic construct
PPPQFNP

SEQ ID NO: 636 - protein, 7 aa, Artificial Sequence
  Synthetic construct
PPPQPGP

SEQ ID NO: 637 - protein, 7 aa, Artificial Sequence
  Synthetic construct
PPPQPNP

SEQ ID NO: 638 - protein, 7 aa, Artificial Sequence
  Synthetic construct
PPPQDGP

SEQ ID NO: 639 - protein, 7 aa, Artificial Sequence
  Synthetic construct
PPPQDNP

SEQ ID NO: 640 - protein, 7 aa, Artificial Sequence
  Synthetic construct
PPPQGGP

SEQ ID NO: 641 - protein, 7 aa, Artificial Sequence
  Synthetic construct
PPPQGNP

SEQ ID NO: 642 - protein, 7 aa, Artificial Sequence
  Synthetic construct
PPPQCGP

SEQ ID NO: 643 - protein, 7 aa, Artificial Sequence
  Synthetic construct
PPPQCNP

SEQ ID NO: 644 - protein, 7 aa, Artificial Sequence
  Synthetic construct
PPPQAGP

SEQ ID NO: 645 - protein, 7 aa, Artificial Sequence
  Synthetic construct
PPPQANP

SEQ ID NO: 646 - protein, 7 aa, Artificial Sequence
  Synthetic construct
PPPEWGP

SEQ ID NO: 647 - protein, 7 aa, Artificial Sequence
  Synthetic construct
PPPEWNP

SEQ ID NO: 648 - protein, 7 aa, Artificial Sequence
  Synthetic construct
PPPEIGP

SEQ ID NO: 649 - protein, 7 aa, Artificial Sequence
  Synthetic construct
PPPEINP

SEQ ID NO: 650 - protein, 7 aa, Artificial Sequence
  Synthetic construct
PPPEFGP

SEQ ID NO: 651 - protein, 7 aa, Artificial Sequence
  Synthetic construct
PPPEFNP

SEQ ID NO: 652 - protein, 7 aa, Artificial Sequence
  Synthetic construct
PPPEPGP

SEQ ID NO: 653 - protein, 7 aa, Artificial Sequence
  Synthetic construct
PPPEPNP

SEQ ID NO: 654 - protein, 7 aa, Artificial Sequence
  Synthetic construct
PPPEDGP

SEQ ID NO: 655 - protein, 7 aa, Artificial Sequence
  Synthetic construct
PPPEDNP

SEQ ID NO: 656 - protein, 7 aa, Artificial Sequence
  Synthetic construct
PPPEGGP

SEQ ID NO: 657 - protein, 7 aa, Artificial Sequence
  Synthetic construct
PPPEGNP

SEQ ID NO: 658 - protein, 7 aa, Artificial Sequence
  Synthetic construct
PPPECGP

SEQ ID NO: 659 - protein, 7 aa, Artificial Sequence
  Synthetic construct
PPPECNP

SEQ ID NO: 660 - protein, 7 aa, Artificial Sequence
  Synthetic construct
PPPEAGP

SEQ ID NO: 661 - protein, 7 aa, Artificial Sequence
  Synthetic construct
PPPEANP

SEQ ID NO: 662 - protein, 7 aa, Artificial Sequence
  Synthetic construct
PPPGWGP

SEQ ID NO: 663 - protein, 7 aa, Artificial Sequence
  Synthetic construct
PPPGWNP

SEQ ID NO: 664 - protein, 7 aa, Artificial Sequence
  Synthetic construct
PPPGIGP

SEQ ID NO: 665 - protein, 7 aa, Artificial Sequence
  Synthetic construct
PPPGINP

SEQ ID NO: 666 - protein, 7 aa, Artificial Sequence
  Synthetic construct
PPPGFGP

SEQ ID NO: 667 - protein, 7 aa, Artificial Sequence
  Synthetic construct
PPPGFNP

SEQ ID NO: 668 - protein, 7 aa, Artificial Sequence
  Synthetic construct
PPPGPGP

SEQ ID NO: 669 - protein, 7 aa, Artificial Sequence
  Synthetic construct
PPPGPNP

SEQ ID NO: 670 - protein, 7 aa, Artificial Sequence
  Synthetic construct
PPPGDGP

SEQ ID NO: 671 - protein, 7 aa, Artificial Sequence
  Synthetic construct
PPPGDNP

SEQ ID NO: 672 - protein, 7 aa, Artificial Sequence
  Synthetic construct
PPPGGGP

SEQ ID NO: 673 - protein, 7 aa, Artificial Sequence
  Synthetic construct
PPPGGNP

SEQ ID NO: 674 - protein, 7 aa, Artificial Sequence
  Synthetic construct
PPPGCGP

SEQ ID NO: 675 - protein, 7 aa, Artificial Sequence
  Synthetic construct
PPPGCNP

SEQ ID NO: 676 - protein, 7 aa, Artificial Sequence
  Synthetic construct
PPPGAGP

SEQ ID NO: 677 - protein, 7 aa, Artificial Sequence
  Synthetic construct
PPPGANP

SEQ ID NO: 678 - protein, 7 aa, Artificial Sequence
  Synthetic construct
PPPIWGP

SEQ ID NO: 679 - protein, 7 aa, Artificial Sequence
  Synthetic construct
PPPIWNP

SEQ ID NO: 680 - protein, 7 aa, Artificial Sequence
  Synthetic construct
PPPIIGP

SEQ ID NO: 681 - protein, 7 aa, Artificial Sequence
  Synthetic construct
PPPIINP

SEQ ID NO: 682 - protein, 7 aa, Artificial Sequence
  Synthetic construct
PPPIFGP

SEQ ID NO: 683 - protein, 7 aa, Artificial Sequence
  Synthetic construct
PPPIFNP

SEQ ID NO: 684 - protein, 7 aa, Artificial Sequence
  Synthetic construct
PPPIPGP

SEQ ID NO: 685 - protein, 7 aa, Artificial Sequence
  Synthetic construct
PPPIPNP

SEQ ID NO: 686 - protein, 7 aa, Artificial Sequence
  Synthetic construct
PPPIDGP

SEQ ID NO: 687 - protein, 7 aa, Artificial Sequence
  Synthetic construct
PPPIDNP

SEQ ID NO: 688 - protein, 7 aa, Artificial Sequence
  Synthetic construct
PPPIGGP

SEQ ID NO: 689 - protein, 7 aa, Artificial Sequence
  Synthetic construct
PPPIGNP

SEQ ID NO: 690 - protein, 7 aa, Artificial Sequence
  Synthetic construct
PPPICGP

SEQ ID NO: 691 - protein, 7 aa, Artificial Sequence
  Synthetic construct
PPPICNP

SEQ ID NO: 692 - protein, 7 aa, Artificial Sequence
  Synthetic construct
PPPIAGP

SEQ ID NO: 693 - protein, 7 aa, Artificial Sequence
  Synthetic construct
PPPIANP

SEQ ID NO: 694 - protein, 7 aa, Artificial Sequence
  Synthetic construct
GWIYIFF

SEQ ID NO: 695 - protein, 7 aa, Artificial Sequence
  Synthetic construct
GWIYIFY

SEQ ID NO: 696 - protein, 7 aa, Artificial Sequence
  Synthetic construct
GWIYIRF

SEQ ID NO: 697 - protein, 7 aa, Artificial Sequence
  Synthetic construct
GWIYIRY

SEQ ID NO: 698 - protein, 7 aa, Artificial Sequence
  Synthetic construct
GWIYICF

SEQ ID NO: 699 - protein, 7 aa, Artificial Sequence
  Synthetic construct
GWIYICY

SEQ ID NO: 700 - protein, 7 aa, Artificial Sequence
  Synthetic construct
GWIYILF

SEQ ID NO: 701 - protein, 7 aa, Artificial Sequence
  Synthetic construct
GWIYILY

SEQ ID NO: 702 - protein, 7 aa, Artificial Sequence
  Synthetic construct
GWIYIAF

SEQ ID NO: 703 - protein, 7 aa, Artificial Sequence
  Synthetic construct
GWIYIAY

SEQ ID NO: 704 - protein, 7 aa, Artificial Sequence
  Synthetic construct
GWIYIQF

SEQ ID NO: 705 - protein, 7 aa, Artificial Sequence
  Synthetic construct
GWIYIQY

SEQ ID NO: 706 - protein, 7 aa, Artificial Sequence
  Synthetic construct
GWIYIDF

SEQ ID NO: 707 - protein, 7 aa, Artificial Sequence
  Synthetic construct
GWIYIDY

SEQ ID NO: 708 - protein, 7 aa, Artificial Sequence
  Synthetic construct
GWIYIVF

SEQ ID NO: 709 - protein, 7 aa, Artificial Sequence
  Synthetic construct
GWIYIVY

SEQ ID NO: 710 - protein, 7 aa, Artificial Sequence
  Synthetic construct
GWIYDFF

SEQ ID NO: 711 - protein, 7 aa, Artificial Sequence
  Synthetic construct
GWIYDFY

SEQ ID NO: 712 - protein, 7 aa, Artificial Sequence
  Synthetic construct
GWIYDRF

SEQ ID NO: 713 - protein, 7 aa, Artificial Sequence
  Synthetic construct
GWIYDRY

SEQ ID NO: 714 - protein, 7 aa, Artificial Sequence
  Synthetic construct
GWIYDCF

SEQ ID NO: 715 - protein, 7 aa, Artificial Sequence
  Synthetic construct
GWIYDCY

SEQ ID NO: 716 - protein, 7 aa, Artificial Sequence
  Synthetic construct
GWIYDLF

SEQ ID NO: 717 - protein, 7 aa, Artificial Sequence
  Synthetic construct
GWIYDLY

SEQ ID NO: 718 - protein, 7 aa, Artificial Sequence
  Synthetic construct
GWIYDAF

SEQ ID NO: 719 - protein, 7 aa, Artificial Sequence
  Synthetic construct
GWIYDAY

SEQ ID NO: 720 - protein, 7 aa, Artificial Sequence
  Synthetic construct
GWIYDQF

SEQ ID NO: 721 - protein, 7 aa, Artificial Sequence
  Synthetic construct
GWIYDQY

SEQ ID NO: 722 - protein, 7 aa, Artificial Sequence
  Synthetic construct
GWIYDDF

SEQ ID NO: 723 - protein, 7 aa, Artificial Sequence
  Synthetic construct
GWIYDDY

SEQ ID NO: 724 - protein, 7 aa, Artificial Sequence
  Synthetic construct
GWIYDVF

SEQ ID NO: 725 - protein, 7 aa, Artificial Sequence
  Synthetic construct
GWIYDVY

SEQ ID NO: 726 - protein, 7 aa, Artificial Sequence
  Synthetic construct
GWIYYFF

SEQ ID NO: 727 - protein, 7 aa, Artificial Sequence
  Synthetic construct
GWIYYFY

SEQ ID NO: 728 - protein, 7 aa, Artificial Sequence
  Synthetic construct
GWIYYRF

SEQ ID NO: 729 - protein, 7 aa, Artificial Sequence
  Synthetic construct
GWIYYRY

SEQ ID NO: 730 - protein, 7 aa, Artificial Sequence
  Synthetic construct
GWIYYCF

SEQ ID NO: 731 - protein, 7 aa, Artificial Sequence
  Synthetic construct
GWIYYCY

SEQ ID NO: 732 - protein, 7 aa, Artificial Sequence
  Synthetic construct
GWIYYLF

SEQ ID NO: 733 - protein, 7 aa, Artificial Sequence
  Synthetic construct
GWIYYLY

SEQ ID NO: 734 - protein, 7 aa, Artificial Sequence
  Synthetic construct
GWIYYAF

SEQ ID NO: 735 - protein, 7 aa, Artificial Sequence
  Synthetic construct
GWIYYAY

SEQ ID NO: 736 - protein, 7 aa, Artificial Sequence
  Synthetic construct
GWIYYQF

SEQ ID NO: 737 - protein, 7 aa, Artificial Sequence
  Synthetic construct
GWIYYQY

SEQ ID NO: 738 - protein, 7 aa, Artificial Sequence
  Synthetic construct
GWIYYDF

SEQ ID NO: 739 - protein, 7 aa, Artificial Sequence
  Synthetic construct
GWIYYDY

SEQ ID NO: 740 - protein, 7 aa, Artificial Sequence
  Synthetic construct
GWIYYVF

SEQ ID NO: 741 - protein, 7 aa, Artificial Sequence
  Synthetic construct
GWIYYVY

SEQ ID NO: 742 - protein, 7 aa, Artificial Sequence
  Synthetic construct
GWIYFFF

SEQ ID NO: 743 - protein, 7 aa, Artificial Sequence
  Synthetic construct
GWIYFFY

SEQ ID NO: 744 - protein, 7 aa, Artificial Sequence
  Synthetic construct
GWIYFRF

SEQ ID NO: 745 - protein, 7 aa, Artificial Sequence
  Synthetic construct
GWIYFRY

SEQ ID NO: 746 - protein, 7 aa, Artificial Sequence
  Synthetic construct
GWIYFCF

SEQ ID NO: 747 - protein, 7 aa, Artificial Sequence
  Synthetic construct
GWIYFCY

SEQ ID NO: 748 - protein, 7 aa, Artificial Sequence
  Synthetic construct
GWIYFLF

SEQ ID NO: 749 - protein, 7 aa, Artificial Sequence
  Synthetic construct
GWIYFLY

SEQ ID NO: 750 - protein, 7 aa, Artificial Sequence
  Synthetic construct
GWIYFAF

SEQ ID NO: 751 - protein, 7 aa, Artificial Sequence
  Synthetic construct
GWIYFAY

SEQ ID NO: 752 - protein, 7 aa, Artificial Sequence
  Synthetic construct
GWIYFQF

SEQ ID NO: 753 - protein, 7 aa, Artificial Sequence
  Synthetic construct
GWIYFQY

SEQ ID NO: 754 - protein, 7 aa, Artificial Sequence
  Synthetic construct
GWIYFDF

SEQ ID NO: 755 - protein, 7 aa, Artificial Sequence
  Synthetic construct
GWIYFDY

SEQ ID NO: 756 - protein, 7 aa, Artificial Sequence
  Synthetic construct
GWIYFVF

SEQ ID NO: 757 - protein, 7 aa, Artificial Sequence
  Synthetic construct
GWIYFVY

SEQ ID NO: 758 - protein, 7 aa, Artificial Sequence
  Synthetic construct
GWIYVFF

SEQ ID NO: 759 - protein, 7 aa, Artificial Sequence
  Synthetic construct
GWIYVFY

SEQ ID NO: 760 - protein, 7 aa, Artificial Sequence
  Synthetic construct
GWIYVRF

SEQ ID NO: 761 - protein, 7 aa, Artificial Sequence
  Synthetic construct
GWIYVRY

SEQ ID NO: 762 - protein, 7 aa, Artificial Sequence
  Synthetic construct
GWIYVCF

SEQ ID NO: 763 - protein, 7 aa, Artificial Sequence
  Synthetic construct
GWIYVCY

SEQ ID NO: 764 - protein, 7 aa, Artificial Sequence
  Synthetic construct
GWIYVLF

SEQ ID NO: 765 - protein, 7 aa, Artificial Sequence
  Synthetic construct
GWIYVLY

SEQ ID NO: 766 - protein, 7 aa, Artificial Sequence
  Synthetic construct
GWIYVAF

SEQ ID NO: 767 - protein, 7 aa, Artificial Sequence
  Synthetic construct
GWIYVAY

SEQ ID NO: 768 - protein, 7 aa, Artificial Sequence
  Synthetic construct
GWIYVQF

SEQ ID NO: 769 - protein, 7 aa, Artificial Sequence
  Synthetic construct
GWIYVQY

SEQ ID NO: 770 - protein, 7 aa, Artificial Sequence
  Synthetic construct
GWIYVDF

SEQ ID NO: 771 - protein, 7 aa, Artificial Sequence
  Synthetic construct
GWIYVDY

SEQ ID NO: 772 - protein, 7 aa, Artificial Sequence
  Synthetic construct
GWIYVVF

SEQ ID NO: 773 - protein, 7 aa, Artificial Sequence
  Synthetic construct
GWIYVVY

SEQ ID NO: 774 - protein, 7 aa, Artificial Sequence
  Synthetic construct
GWIYTFF

SEQ ID NO: 775 - protein, 7 aa, Artificial Sequence
  Synthetic construct
GWIYTFY

SEQ ID NO: 776 - protein, 7 aa, Artificial Sequence
  Synthetic construct
GWIYTRF

SEQ ID NO: 777 - protein, 7 aa, Artificial Sequence
  Synthetic construct
GWIYTRY

SEQ ID NO: 778 - protein, 7 aa, Artificial Sequence
  Synthetic construct
GWIYTCF

SEQ ID NO: 779 - protein, 7 aa, Artificial Sequence
  Synthetic construct
GWIYTCY

SEQ ID NO: 780 - protein, 7 aa, Artificial Sequence
  Synthetic construct
GWIYTLF

SEQ ID NO: 781 - protein, 7 aa, Artificial Sequence
  Synthetic construct
GWIYTLY

SEQ ID NO: 782 - protein, 7 aa, Artificial Sequence
  Synthetic construct
GWIYTAF

SEQ ID NO: 783 - protein, 7 aa, Artificial Sequence
  Synthetic construct
GWIYTAY

SEQ ID NO: 784 - protein, 7 aa, Artificial Sequence
  Synthetic construct
GWIYTQF

SEQ ID NO: 785 - protein, 7 aa, Artificial Sequence
  Synthetic construct
GWIYTQY

SEQ ID NO: 786 - protein, 7 aa, Artificial Sequence
  Synthetic construct
GWIYTDF

SEQ ID NO: 787 - protein, 7 aa, Artificial Sequence
  Synthetic construct
GWIYTDY

SEQ ID NO: 788 - protein, 7 aa, Artificial Sequence
  Synthetic construct
GWIYTVF

SEQ ID NO: 789 - protein, 7 aa, Artificial Sequence
  Synthetic construct
GWIYTVY

SEQ ID NO: 790 - protein, 7 aa, Artificial Sequence
  Synthetic construct
GWIYGFF

SEQ ID NO: 791 - protein, 7 aa, Artificial Sequence
  Synthetic construct
GWIYGFY

SEQ ID NO: 792 - protein, 7 aa, Artificial Sequence
  Synthetic construct
GWIYGRF

SEQ ID NO: 793 - protein, 7 aa, Artificial Sequence
  Synthetic construct
GWIYGRY

SEQ ID NO: 794 - protein, 7 aa, Artificial Sequence
  Synthetic construct
GWIYGCF

SEQ ID NO: 795 - protein, 7 aa, Artificial Sequence
  Synthetic construct
GWIYGCY

SEQ ID NO: 796 - protein, 7 aa, Artificial Sequence
  Synthetic construct
GWIYGLF

SEQ ID NO: 797 - protein, 7 aa, Artificial Sequence
  Synthetic construct
GWIYGLY

SEQ ID NO: 798 - protein, 7 aa, Artificial Sequence
  Synthetic construct
GWIYGAF

SEQ ID NO: 799 - protein, 7 aa, Artificial Sequence
  Synthetic construct
GWIYGAY

SEQ ID NO: 800 - protein, 7 aa, Artificial Sequence
  Synthetic construct
GWIYGQF

SEQ ID NO: 801 - protein, 7 aa, Artificial Sequence
  Synthetic construct
GWIYGQY

SEQ ID NO: 802 - protein, 7 aa, Artificial Sequence
  Synthetic construct
GWIYGDF

SEQ ID NO: 803 - protein, 7 aa, Artificial Sequence
  Synthetic construct
GWIYGDY

SEQ ID NO: 804 - protein, 7 aa, Artificial Sequence
  Synthetic construct
GWIYGVF

SEQ ID NO: 805 - protein, 7 aa, Artificial Sequence
  Synthetic construct
GWIYGVY

SEQ ID NO: 806 - protein, 7 aa, Artificial Sequence
  Synthetic construct
GWIYAFF

SEQ ID NO: 807 - protein, 7 aa, Artificial Sequence
  Synthetic construct
GWIYAFY

SEQ ID NO: 808 - protein, 7 aa, Artificial Sequence
  Synthetic construct
GWIYARF

SEQ ID NO: 809 - protein, 7 aa, Artificial Sequence
  Synthetic construct
GWIYARY

SEQ ID NO: 810 - protein, 7 aa, Artificial Sequence
  Synthetic construct
GWIYACF

SEQ ID NO: 811 - protein, 7 aa, Artificial Sequence
  Synthetic construct
GWIYACY

SEQ ID NO: 812 - protein, 7 aa, Artificial Sequence
  Synthetic construct
GWIYALF

SEQ ID NO: 813 - protein, 7 aa, Artificial Sequence
  Synthetic construct
GWIYALY

SEQ ID NO: 814 - protein, 7 aa, Artificial Sequence
  Synthetic construct
GWIYAAF

SEQ ID NO: 815 - protein, 7 aa, Artificial Sequence
  Synthetic construct
GWIYAAY

SEQ ID NO: 816 - protein, 7 aa, Artificial Sequence
  Synthetic construct
GWIYAQF

SEQ ID NO: 817 - protein, 7 aa, Artificial Sequence
  Synthetic construct
GWIYAQY

SEQ ID NO: 818 - protein, 7 aa, Artificial Sequence
  Synthetic construct
GWIYADF

SEQ ID NO: 819 - protein, 7 aa, Artificial Sequence
  Synthetic construct
GWIYADY

SEQ ID NO: 820 - protein, 7 aa, Artificial Sequence
  Synthetic construct
GWIYAVF

SEQ ID NO: 821 - protein, 7 aa, Artificial Sequence
  Synthetic construct
GWIYAVY

SEQ ID NO: 822 - protein, 7 aa, Artificial Sequence
  Synthetic construct
GWIYQFF

SEQ ID NO: 823 - protein, 7 aa, Artificial Sequence
  Synthetic construct
GWIYQFY

SEQ ID NO: 824 - protein, 7 aa, Artificial Sequence
  Synthetic construct
GWIYQRF

SEQ ID NO: 825 - protein, 7 aa, Artificial Sequence
  Synthetic construct
GWIYQRY

SEQ ID NO: 826 - protein, 7 aa, Artificial Sequence
  Synthetic construct
GWIYQCF

SEQ ID NO: 827 - protein, 7 aa, Artificial Sequence
  Synthetic construct
GWIYQCY

SEQ ID NO: 828 - protein, 7 aa, Artificial Sequence
  Synthetic construct
GWIYQLF

SEQ ID NO: 829 - protein, 7 aa, Artificial Sequence
  Synthetic construct
GWIYQLY

SEQ ID NO: 830 - protein, 7 aa, Artificial Sequence
  Synthetic construct
GWIYQAF

SEQ ID NO: 831 - protein, 7 aa, Artificial Sequence
  Synthetic construct
GWIYQAY

SEQ ID NO: 832 - protein, 7 aa, Artificial Sequence
  Synthetic construct
GWIYQQF

SEQ ID NO: 833 - protein, 7 aa, Artificial Sequence
  Synthetic construct
GWIYQQY

SEQ ID NO: 834 - protein, 7 aa, Artificial Sequence
  Synthetic construct
GWIYQDF

SEQ ID NO: 835 - protein, 7 aa, Artificial Sequence
  Synthetic construct
GWIYQDY

SEQ ID NO: 836 - protein, 7 aa, Artificial Sequence
  Synthetic construct
GWIYQVF

SEQ ID NO: 837 - protein, 7 aa, Artificial Sequence
  Synthetic construct
GWIYQVY

SEQ ID NO: 838 - protein, 7 aa, Artificial Sequence
  Synthetic construct
GWIPIFF

SEQ ID NO: 839 - protein, 7 aa, Artificial Sequence
  Synthetic construct
GWIPIFY

SEQ ID NO: 840 - protein, 7 aa, Artificial Sequence
  Synthetic construct
GWIPIRF

SEQ ID NO: 841 - protein, 7 aa, Artificial Sequence
  Synthetic construct
GWIPIRY

SEQ ID NO: 842 - protein, 7 aa, Artificial Sequence
  Synthetic construct
GWIPICF

SEQ ID NO: 843 - protein, 7 aa, Artificial Sequence
  Synthetic construct
GWIPICY

SEQ ID NO: 844 - protein, 7 aa, Artificial Sequence
  Synthetic construct
GWIPILF

SEQ ID NO: 845 - protein, 7 aa, Artificial Sequence
  Synthetic construct
GWIPILY

SEQ ID NO: 846 - protein, 7 aa, Artificial Sequence
  Synthetic construct
GWIPIAF

SEQ ID NO: 847 - protein, 7 aa, Artificial Sequence
  Synthetic construct
GWIPIAY

SEQ ID NO: 848 - protein, 7 aa, Artificial Sequence
  Synthetic construct
GWIPIQF

SEQ ID NO: 849 - protein, 7 aa, Artificial Sequence
  Synthetic construct
GWIPIQY

SEQ ID NO: 850 - protein, 7 aa, Artificial Sequence
  Synthetic construct
GWIPIDF

SEQ ID NO: 851 - protein, 7 aa, Artificial Sequence
  Synthetic construct
GWIPIDY

SEQ ID NO: 852 - protein, 7 aa, Artificial Sequence
  Synthetic construct
GWIPIVF

SEQ ID NO: 853 - protein, 7 aa, Artificial Sequence
  Synthetic construct
GWIPIVY

SEQ ID NO: 854 - protein, 7 aa, Artificial Sequence
  Synthetic construct
GWIPDFF

SEQ ID NO: 855 - protein, 7 aa, Artificial Sequence
  Synthetic construct
GWIPDFY

SEQ ID NO: 856 - protein, 7 aa, Artificial Sequence
  Synthetic construct
GWIPDRF

SEQ ID NO: 857 - protein, 7 aa, Artificial Sequence
  Synthetic construct
GWIPDRY

SEQ ID NO: 858 - protein, 7 aa, Artificial Sequence
  Synthetic construct
GWIPDCF

SEQ ID NO: 859 - protein, 7 aa, Artificial Sequence
  Synthetic construct
GWIPDCY

SEQ ID NO: 860 - protein, 7 aa, Artificial Sequence
  Synthetic construct
GWIPDLF

SEQ ID NO: 861 - protein, 7 aa, Artificial Sequence
  Synthetic construct
GWIPDLY

SEQ ID NO: 862 - protein, 7 aa, Artificial Sequence
  Synthetic construct
GWIPDAF

SEQ ID NO: 863 - protein, 7 aa, Artificial Sequence
  Synthetic construct
GWIPDAY

SEQ ID NO: 864 - protein, 7 aa, Artificial Sequence
  Synthetic construct
GWIPDQF

SEQ ID NO: 865 - protein, 7 aa, Artificial Sequence
  Synthetic construct
GWIPDQY

SEQ ID NO: 866 - protein, 7 aa, Artificial Sequence
  Synthetic construct
GWIPDDF

SEQ ID NO: 867 - protein, 7 aa, Artificial Sequence
  Synthetic construct
GWIPDDY

SEQ ID NO: 868 - protein, 7 aa, Artificial Sequence
  Synthetic construct
GWIPDVF

SEQ ID NO: 869 - protein, 7 aa, Artificial Sequence
  Synthetic construct
GWIPDVY

SEQ ID NO: 870 - protein, 7 aa, Artificial Sequence
  Synthetic construct
GWIPYFF

SEQ ID NO: 871 - protein, 7 aa, Artificial Sequence
  Synthetic construct
GWIPYFY

SEQ ID NO: 872 - protein, 7 aa, Artificial Sequence
  Synthetic construct
GWIPYRF

SEQ ID NO: 873 - protein, 7 aa, Artificial Sequence
  Synthetic construct
GWIPYRY

SEQ ID NO: 874 - protein, 7 aa, Artificial Sequence
  Synthetic construct
GWIPYCF

SEQ ID NO: 875 - protein, 7 aa, Artificial Sequence
  Synthetic construct
GWIPYCY

SEQ ID NO: 876 - protein, 7 aa, Artificial Sequence
  Synthetic construct
GWIPYLF

SEQ ID NO: 877 - protein, 7 aa, Artificial Sequence
  Synthetic construct
GWIPYLY

SEQ ID NO: 878 - protein, 7 aa, Artificial Sequence
  Synthetic construct
GWIPYAF

SEQ ID NO: 879 - protein, 7 aa, Artificial Sequence
  Synthetic construct
GWIPYAY

SEQ ID NO: 880 - protein, 7 aa, Artificial Sequence
  Synthetic construct
GWIPYQF

SEQ ID NO: 881 - protein, 7 aa, Artificial Sequence
  Synthetic construct
GWIPYQY

SEQ ID NO: 882 - protein, 7 aa, Artificial Sequence
  Synthetic construct
GWIPYDF

SEQ ID NO: 883 - protein, 7 aa, Artificial Sequence
  Synthetic construct
GWIPYDY

SEQ ID NO: 884 - protein, 7 aa, Artificial Sequence
  Synthetic construct
GWIPYVF

SEQ ID NO: 885 - protein, 7 aa, Artificial Sequence
  Synthetic construct
GWIPYVY

SEQ ID NO: 886 - protein, 7 aa, Artificial Sequence
  Synthetic construct
GWIPFFF

SEQ ID NO: 887 - protein, 7 aa, Artificial Sequence
  Synthetic construct
GWIPFFY

SEQ ID NO: 888 - protein, 7 aa, Artificial Sequence
  Synthetic construct
GWIPFRF

SEQ ID NO: 889 - protein, 7 aa, Artificial Sequence
  Synthetic construct
GWIPFRY

SEQ ID NO: 890 - protein, 7 aa, Artificial Sequence
  Synthetic construct
GWIPFCF

SEQ ID NO: 891 - protein, 7 aa, Artificial Sequence
  Synthetic construct
GWIPFCY

SEQ ID NO: 892 - protein, 7 aa, Artificial Sequence
  Synthetic construct
GWIPFLF

SEQ ID NO: 893 - protein, 7 aa, Artificial Sequence
  Synthetic construct
GWIPFLY

SEQ ID NO: 894 - protein, 7 aa, Artificial Sequence
  Synthetic construct
GWIPFAF

SEQ ID NO: 895 - protein, 7 aa, Artificial Sequence
  Synthetic construct
GWIPFAY

SEQ ID NO: 896 - protein, 7 aa, Artificial Sequence
  Synthetic construct
GWIPFQF

SEQ ID NO: 897 - protein, 7 aa, Artificial Sequence
  Synthetic construct
GWIPFQY

SEQ ID NO: 898 - protein, 7 aa, Artificial Sequence
  Synthetic construct
GWIPFDF

SEQ ID NO: 899 - protein, 7 aa, Artificial Sequence
  Synthetic construct
GWIPFDY

SEQ ID NO: 900 - protein, 7 aa, Artificial Sequence
  Synthetic construct
GWIPFVF

SEQ ID NO: 901 - protein, 7 aa, Artificial Sequence
  Synthetic construct
GWIPFVY

SEQ ID NO: 902 - protein, 7 aa, Artificial Sequence
  Synthetic construct
GWIPVFF

SEQ ID NO: 903 - protein, 7 aa, Artificial Sequence
  Synthetic construct
GWIPVFY

SEQ ID NO: 904 - protein, 7 aa, Artificial Sequence
  Synthetic construct
GWIPVRF

SEQ ID NO: 905 - protein, 7 aa, Artificial Sequence
  Synthetic construct
GWIPVRY

SEQ ID NO: 906 - protein, 7 aa, Artificial Sequence
  Synthetic construct
GWIPVCF

SEQ ID NO: 907 - protein, 7 aa, Artificial Sequence
  Synthetic construct
GWIPVCY

SEQ ID NO: 908 - protein, 7 aa, Artificial Sequence
  Synthetic construct
GWIPVLF

SEQ ID NO: 909 - protein, 7 aa, Artificial Sequence
  Synthetic construct
GWIPVLY

SEQ ID NO: 910 - protein, 7 aa, Artificial Sequence
  Synthetic construct
GWIPVAF

SEQ ID NO: 911 - protein, 7 aa, Artificial Sequence
  Synthetic construct
GWIPVAY

SEQ ID NO: 912 - protein, 7 aa, Artificial Sequence
  Synthetic construct
GWIPVQF

SEQ ID NO: 913 - protein, 7 aa, Artificial Sequence
  Synthetic construct
GWIPVQY

SEQ ID NO: 914 - protein, 7 aa, Artificial Sequence
  Synthetic construct
GWIPVDF

SEQ ID NO: 915 - protein, 7 aa, Artificial Sequence
  Synthetic construct
GWIPVDY

SEQ ID NO: 916 - protein, 7 aa, Artificial Sequence
  Synthetic construct
GWIPVVF

SEQ ID NO: 917 - protein, 7 aa, Artificial Sequence
  Synthetic construct
GWIPVVY

SEQ ID NO: 918 - protein, 7 aa, Artificial Sequence
  Synthetic construct
GWIPTFF

SEQ ID NO: 919 - protein, 7 aa, Artificial Sequence
  Synthetic construct
GWIPTFY

SEQ ID NO: 920 - protein, 7 aa, Artificial Sequence
  Synthetic construct
GWIPTRF

SEQ ID NO: 921 - protein, 7 aa, Artificial Sequence
  Synthetic construct
GWIPTRY

SEQ ID NO: 922 - protein, 7 aa, Artificial Sequence
  Synthetic construct
GWIPTCF

SEQ ID NO: 923 - protein, 7 aa, Artificial Sequence
  Synthetic construct
GWIPTCY

SEQ ID NO: 924 - protein, 7 aa, Artificial Sequence
  Synthetic construct
GWIPTLF

SEQ ID NO: 925 - protein, 7 aa, Artificial Sequence
  Synthetic construct
GWIPTLY

SEQ ID NO: 926 - protein, 7 aa, Artificial Sequence
  Synthetic construct
GWIPTAF

SEQ ID NO: 927 - protein, 7 aa, Artificial Sequence
  Synthetic construct
GWIPTAY

SEQ ID NO: 928 - protein, 7 aa, Artificial Sequence
  Synthetic construct
GWIPTQF

SEQ ID NO: 929 - protein, 7 aa, Artificial Sequence
  Synthetic construct
GWIPTQY

SEQ ID NO: 930 - protein, 7 aa, Artificial Sequence
  Synthetic construct
GWIPTDF

SEQ ID NO: 931 - protein, 7 aa, Artificial Sequence
  Synthetic construct
GWIPTDY

SEQ ID NO: 932 - protein, 7 aa, Artificial Sequence
  Synthetic construct
GWIPTVF

SEQ ID NO: 933 - protein, 7 aa, Artificial Sequence
  Synthetic construct
GWIPTVY

SEQ ID NO: 934 - protein, 7 aa, Artificial Sequence
  Synthetic construct
GWIPGFF

SEQ ID NO: 935 - protein, 7 aa, Artificial Sequence
  Synthetic construct
GWIPGFY

SEQ ID NO: 936 - protein, 7 aa, Artificial Sequence
  Synthetic construct
GWIPGRF

SEQ ID NO: 937 - protein, 7 aa, Artificial Sequence
  Synthetic construct
GWIPGRY

SEQ ID NO: 938 - protein, 7 aa, Artificial Sequence
  Synthetic construct
GWIPGCF

SEQ ID NO: 939 - protein, 7 aa, Artificial Sequence
  Synthetic construct
GWIPGCY

SEQ ID NO: 940 - protein, 7 aa, Artificial Sequence
  Synthetic construct
GWIPGLF

SEQ ID NO: 941 - protein, 7 aa, Artificial Sequence
  Synthetic construct
GWIPGLY

SEQ ID NO: 942 - protein, 7 aa, Artificial Sequence
  Synthetic construct
GWIPGAF

SEQ ID NO: 943 - protein, 7 aa, Artificial Sequence
  Synthetic construct
GWIPGAY

SEQ ID NO: 944 - protein, 7 aa, Artificial Sequence
  Synthetic construct
GWIPGQF

SEQ ID NO: 945 - protein, 7 aa, Artificial Sequence
  Synthetic construct
GWIPGQY

SEQ ID NO: 946 - protein, 7 aa, Artificial Sequence
  Synthetic construct
GWIPGDF

SEQ ID NO: 947 - protein, 7 aa, Artificial Sequence
  Synthetic construct
GWIPGDY

SEQ ID NO: 948 - protein, 7 aa, Artificial Sequence
  Synthetic construct
GWIPGVF

SEQ ID NO: 949 - protein, 7 aa, Artificial Sequence
  Synthetic construct
GWIPGVY

SEQ ID NO: 950 - protein, 7 aa, Artificial Sequence
  Synthetic construct
GWIPAFF

SEQ ID NO: 951 - protein, 7 aa, Artificial Sequence
  Synthetic construct
GWIPAFY

SEQ ID NO: 952 - protein, 7 aa, Artificial Sequence
  Synthetic construct
GWIPARF

SEQ ID NO: 953 - protein, 7 aa, Artificial Sequence
  Synthetic construct
GWIPARY

SEQ ID NO: 954 - protein, 7 aa, Artificial Sequence
  Synthetic construct
GWIPACF

SEQ ID NO: 955 - protein, 7 aa, Artificial Sequence
  Synthetic construct
GWIPACY

SEQ ID NO: 956 - protein, 7 aa, Artificial Sequence
  Synthetic construct
GWIPALF

SEQ ID NO: 957 - protein, 7 aa, Artificial Sequence
  Synthetic construct
GWIPALY

SEQ ID NO: 958 - protein, 7 aa, Artificial Sequence
  Synthetic construct
GWIPAAF

SEQ ID NO: 959 - protein, 7 aa, Artificial Sequence
  Synthetic construct
GWIPAAY

SEQ ID NO: 960 - protein, 7 aa, Artificial Sequence
  Synthetic construct
GWIPAQF

SEQ ID NO: 961 - protein, 7 aa, Artificial Sequence
  Synthetic construct
GWIPAQY

SEQ ID NO: 962 - protein, 7 aa, Artificial Sequence
  Synthetic construct
GWIPADF

SEQ ID NO: 963 - protein, 7 aa, Artificial Sequence
  Synthetic construct
GWIPADY

SEQ ID NO: 964 - protein, 7 aa, Artificial Sequence
  Synthetic construct
GWIPAVF

SEQ ID NO: 965 - protein, 7 aa, Artificial Sequence
  Synthetic construct
GWIPAVY

SEQ ID NO: 966 - protein, 7 aa, Artificial Sequence
  Synthetic construct
GWIPQFF

SEQ ID NO: 967 - protein, 7 aa, Artificial Sequence
  Synthetic construct
GWIPQFY

SEQ ID NO: 968 - protein, 7 aa, Artificial Sequence
  Synthetic construct
GWIPQRF

SEQ ID NO: 969 - protein, 7 aa, Artificial Sequence
  Synthetic construct
GWIPQRY

SEQ ID NO: 970 - protein, 7 aa, Artificial Sequence
  Synthetic construct
GWIPQCF

SEQ ID NO: 971 - protein, 7 aa, Artificial Sequence
  Synthetic construct
GWIPQCY

SEQ ID NO: 972 - protein, 7 aa, Artificial Sequence
  Synthetic construct
GWIPQLF

SEQ ID NO: 973 - protein, 7 aa, Artificial Sequence
  Synthetic construct
GWIPQLY

SEQ ID NO: 974 - protein, 7 aa, Artificial Sequence
  Synthetic construct
GWIPQAF

SEQ ID NO: 975 - protein, 7 aa, Artificial Sequence
  Synthetic construct
GWIPQAY

SEQ ID NO: 976 - protein, 7 aa, Artificial Sequence
  Synthetic construct
GWIPQQF

SEQ ID NO: 977 - protein, 7 aa, Artificial Sequence
  Synthetic construct
GWIPQQY

SEQ ID NO: 978 - protein, 7 aa, Artificial Sequence
  Synthetic construct
GWIPQDF

SEQ ID NO: 979 - protein, 7 aa, Artificial Sequence
  Synthetic construct
GWIPQDY

SEQ ID NO: 980 - protein, 7 aa, Artificial Sequence
  Synthetic construct
GWIPQVF

SEQ ID NO: 981 - protein, 7 aa, Artificial Sequence
  Synthetic construct
GWIPQVY

SEQ ID NO: 982 - protein, 7 aa, Artificial Sequence
  Synthetic construct
GWIHIFF

SEQ ID NO: 983 - protein, 7 aa, Artificial Sequence
  Synthetic construct
GWIHIFY

SEQ ID NO: 984 - protein, 7 aa, Artificial Sequence
  Synthetic construct
GWIHIRF

SEQ ID NO: 985 - protein, 7 aa, Artificial Sequence
  Synthetic construct
GWIHIRY

SEQ ID NO: 986 - protein, 7 aa, Artificial Sequence
  Synthetic construct
GWIHICF

SEQ ID NO: 987 - protein, 7 aa, Artificial Sequence
  Synthetic construct
GWIHICY

SEQ ID NO: 988 - protein, 7 aa, Artificial Sequence
  Synthetic construct
GWIHILF

SEQ ID NO: 989 - protein, 7 aa, Artificial Sequence
  Synthetic construct
GWIHILY

SEQ ID NO: 990 - protein, 7 aa, Artificial Sequence
  Synthetic construct
GWIHIAF

SEQ ID NO: 991 - protein, 7 aa, Artificial Sequence
  Synthetic construct
GWIHIAY

SEQ ID NO: 992 - protein, 7 aa, Artificial Sequence
  Synthetic construct
GWIHIQF

SEQ ID NO: 993 - protein, 7 aa, Artificial Sequence
  Synthetic construct
GWIHIQY

SEQ ID NO: 994 - protein, 7 aa, Artificial Sequence
  Synthetic construct
GWIHIDF

SEQ ID NO: 995 - protein, 7 aa, Artificial Sequence
  Synthetic construct
GWIHIDY

SEQ ID NO: 996 - protein, 7 aa, Artificial Sequence
  Synthetic construct
GWIHIVF

SEQ ID NO: 997 - protein, 7 aa, Artificial Sequence
  Synthetic construct
GWIHIVY

SEQ ID NO: 998 - protein, 7 aa, Artificial Sequence
  Synthetic construct
GWIHDFF

SEQ ID NO: 999 - protein, 7 aa, Artificial Sequence
  Synthetic construct
GWIHDFY

SEQ ID NO: 1000 - protein, 7 aa, Artificial Sequence
  Synthetic construct
GWIHDRF

SEQ ID NO: 1001 - protein, 7 aa, Artificial Sequence
  Synthetic construct
GWIHDRY

SEQ ID NO: 1002 - protein, 7 aa, Artificial Sequence
  Synthetic construct
GWIHDCF

SEQ ID NO: 1003 - protein, 7 aa, Artificial Sequence
  Synthetic construct
GWIHDCY

SEQ ID NO: 1004 - protein, 7 aa, Artificial Sequence
  Synthetic construct
GWIHDLF

SEQ ID NO: 1005 - protein, 7 aa, Artificial Sequence
  Synthetic construct
GWIHDLY

SEQ ID NO: 1006 - protein, 7 aa, Artificial Sequence
  Synthetic construct
GWIHDAF

SEQ ID NO: 1007 - protein, 7 aa, Artificial Sequence
  Synthetic construct
GWIHDAY

SEQ ID NO: 1008 - protein, 7 aa, Artificial Sequence
  Synthetic construct
GWIHDQF

SEQ ID NO: 1009 - protein, 7 aa, Artificial Sequence
  Synthetic construct
GWIHDQY

SEQ ID NO: 1010 - protein, 7 aa, Artificial Sequence
  Synthetic construct
GWIHDDF

SEQ ID NO: 1011 - protein, 7 aa, Artificial Sequence
  Synthetic construct
GWIHDDY

SEQ ID NO: 1012 - protein, 7 aa, Artificial Sequence
  Synthetic construct
GWIHDVF

SEQ ID NO: 1013 - protein, 7 aa, Artificial Sequence
  Synthetic construct
GWIHDVY

SEQ ID NO: 1014 - protein, 7 aa, Artificial Sequence
  Synthetic construct
GWIHYFF

SEQ ID NO: 1015 - protein, 7 aa, Artificial Sequence
  Synthetic construct
GWIHYFY

SEQ ID NO: 1016 - protein, 7 aa, Artificial Sequence
  Synthetic construct
GWIHYRF

SEQ ID NO: 1017 - protein, 7 aa, Artificial Sequence
  Synthetic construct
GWIHYRY

SEQ ID NO: 1018 - protein, 7 aa, Artificial Sequence
  Synthetic construct
GWIHYCF

SEQ ID NO: 1019 - protein, 7 aa, Artificial Sequence
  Synthetic construct
GWIHYCY

SEQ ID NO: 1020 - protein, 7 aa, Artificial Sequence
  Synthetic construct
GWIHYLF

SEQ ID NO: 1021 - protein, 7 aa, Artificial Sequence
  Synthetic construct
GWIHYLY

SEQ ID NO: 1022 - protein, 7 aa, Artificial Sequence
  Synthetic construct
GWIHYAF

SEQ ID NO: 1023 - protein, 7 aa, Artificial Sequence
  Synthetic construct
GWIHYAY

SEQ ID NO: 1024 - protein, 7 aa, Artificial Sequence
  Synthetic construct
GWIHYQF

SEQ ID NO: 1025 - protein, 7 aa, Artificial Sequence
  Synthetic construct
GWIHYQY

SEQ ID NO: 1026 - protein, 7 aa, Artificial Sequence
  Synthetic construct
GWIHYDF

SEQ ID NO: 1027 - protein, 7 aa, Artificial Sequence
  Synthetic construct
GWIHYDY

SEQ ID NO: 1028 - protein, 7 aa, Artificial Sequence
  Synthetic construct
GWIHYVF

SEQ ID NO: 1029 - protein, 7 aa, Artificial Sequence
  Synthetic construct
GWIHYVY

SEQ ID NO: 1030 - protein, 7 aa, Artificial Sequence
  Synthetic construct
GWIHFFF

SEQ ID NO: 1031 - protein, 7 aa, Artificial Sequence
  Synthetic construct
GWIHFFY

SEQ ID NO: 1032 - protein, 7 aa, Artificial Sequence
  Synthetic construct
GWIHFRF

SEQ ID NO: 1033 - protein, 7 aa, Artificial Sequence
  Synthetic construct
GWIHFRY

SEQ ID NO: 1034 - protein, 7 aa, Artificial Sequence
  Synthetic construct
GWIHFCF

SEQ ID NO: 1035 - protein, 7 aa, Artificial Sequence
  Synthetic construct
GWIHFCY

SEQ ID NO: 1036 - protein, 7 aa, Artificial Sequence
  Synthetic construct
GWIHFLF

SEQ ID NO: 1037 - protein, 7 aa, Artificial Sequence
  Synthetic construct
GWIHFLY

SEQ ID NO: 1038 - protein, 7 aa, Artificial Sequence
  Synthetic construct
GWIHFAF

SEQ ID NO: 1039 - protein, 7 aa, Artificial Sequence
  Synthetic construct
GWIHFAY

SEQ ID NO: 1040 - protein, 7 aa, Artificial Sequence
  Synthetic construct
GWIHFQF

SEQ ID NO: 1041 - protein, 7 aa, Artificial Sequence
  Synthetic construct
GWIHFQY

SEQ ID NO: 1042 - protein, 7 aa, Artificial Sequence
  Synthetic construct
GWIHFDF

SEQ ID NO: 1043 - protein, 7 aa, Artificial Sequence
  Synthetic construct
GWIHFDY

SEQ ID NO: 1044 - protein, 7 aa, Artificial Sequence
  Synthetic construct
GWIHFVF

SEQ ID NO: 1045 - protein, 7 aa, Artificial Sequence
  Synthetic construct
GWIHFVY

SEQ ID NO: 1046 - protein, 7 aa, Artificial Sequence
  Synthetic construct
GWIHVFF

SEQ ID NO: 1047 - protein, 7 aa, Artificial Sequence
  Synthetic construct
GWIHVFY

SEQ ID NO: 1048 - protein, 7 aa, Artificial Sequence
  Synthetic construct
GWIHVRF

SEQ ID NO: 1049 - protein, 7 aa, Artificial Sequence
  Synthetic construct
GWIHVRY

SEQ ID NO: 1050 - protein, 7 aa, Artificial Sequence
  Synthetic construct
GWIHVCF

SEQ ID NO: 1051 - protein, 7 aa, Artificial Sequence
  Synthetic construct
GWIHVCY

SEQ ID NO: 1052 - protein, 7 aa, Artificial Sequence
  Synthetic construct
GWIHVLF

SEQ ID NO: 1053 - protein, 7 aa, Artificial Sequence
  Synthetic construct
GWIHVLY

SEQ ID NO: 1054 - protein, 7 aa, Artificial Sequence
  Synthetic construct
GWIHVAF

SEQ ID NO: 1055 - protein, 7 aa, Artificial Sequence
  Synthetic construct
GWIHVAY

SEQ ID NO: 1056 - protein, 7 aa, Artificial Sequence
  Synthetic construct
GWIHVQF

SEQ ID NO: 1057 - protein, 7 aa, Artificial Sequence
  Synthetic construct
GWIHVQY

SEQ ID NO: 1058 - protein, 7 aa, Artificial Sequence
  Synthetic construct
GWIHVDF

SEQ ID NO: 1059 - protein, 7 aa, Artificial Sequence
  Synthetic construct
GWIHVDY

SEQ ID NO: 1060 - protein, 7 aa, Artificial Sequence
  Synthetic construct
GWIHVVF

SEQ ID NO: 1061 - protein, 7 aa, Artificial Sequence
  Synthetic construct
GWIHVVY

SEQ ID NO: 1062 - protein, 7 aa, Artificial Sequence
  Synthetic construct
GWIHTFF

SEQ ID NO: 1063 - protein, 7 aa, Artificial Sequence
  Synthetic construct
GWIHTFY

SEQ ID NO: 1064 - protein, 7 aa, Artificial Sequence
  Synthetic construct
GWIHTRF

SEQ ID NO: 1065 - protein, 7 aa, Artificial Sequence
  Synthetic construct
GWIHTRY

SEQ ID NO: 1066 - protein, 7 aa, Artificial Sequence
  Synthetic construct
GWIHTCF

SEQ ID NO: 1067 - protein, 7 aa, Artificial Sequence
  Synthetic construct
GWIHTCY

SEQ ID NO: 1068 - protein, 7 aa, Artificial Sequence
  Synthetic construct
GWIHTLF

SEQ ID NO: 1069 - protein, 7 aa, Artificial Sequence
  Synthetic construct
GWIHTLY

SEQ ID NO: 1070 - protein, 7 aa, Artificial Sequence
  Synthetic construct
GWIHTAF

SEQ ID NO: 1071 - protein, 7 aa, Artificial Sequence
  Synthetic construct
GWIHTAY

SEQ ID NO: 1072 - protein, 7 aa, Artificial Sequence
  Synthetic construct
GWIHTQF

SEQ ID NO: 1073 - protein, 7 aa, Artificial Sequence
  Synthetic construct
GWIHTQY

SEQ ID NO: 1074 - protein, 7 aa, Artificial Sequence
  Synthetic construct
GWIHTDF

SEQ ID NO: 1075 - protein, 7 aa, Artificial Sequence
  Synthetic construct
GWIHTDY

SEQ ID NO: 1076 - protein, 7 aa, Artificial Sequence
  Synthetic construct
GWIHTVF

SEQ ID NO: 1077 - protein, 7 aa, Artificial Sequence
  Synthetic construct
GWIHTVY

SEQ ID NO: 1078 - protein, 7 aa, Artificial Sequence
  Synthetic construct
GWIHGFF

SEQ ID NO: 1079 - protein, 7 aa, Artificial Sequence
  Synthetic construct
GWIHGFY

SEQ ID NO: 1080 - protein, 7 aa, Artificial Sequence
  Synthetic construct
GWIHGRF

SEQ ID NO: 1081 - protein, 7 aa, Artificial Sequence
  Synthetic construct
GWIHGRY

SEQ ID NO: 1082 - protein, 7 aa, Artificial Sequence
  Synthetic construct
GWIHGCF

SEQ ID NO: 1083 - protein, 7 aa, Artificial Sequence
  Synthetic construct
GWIHGCY

SEQ ID NO: 1084 - protein, 7 aa, Artificial Sequence
  Synthetic construct
GWIHGLF

SEQ ID NO: 1085 - protein, 7 aa, Artificial Sequence
  Synthetic construct
GWIHGLY

SEQ ID NO: 1086 - protein, 7 aa, Artificial Sequence
  Synthetic construct
GWIHGAF

SEQ ID NO: 1087 - protein, 7 aa, Artificial Sequence
  Synthetic construct
GWIHGAY

SEQ ID NO: 1088 - protein, 7 aa, Artificial Sequence
  Synthetic construct
GWIHGQF

SEQ ID NO: 1089 - protein, 7 aa, Artificial Sequence
  Synthetic construct
GWIHGQY

SEQ ID NO: 1090 - protein, 7 aa, Artificial Sequence
  Synthetic construct
GWIHGDF

SEQ ID NO: 1091 - protein, 7 aa, Artificial Sequence
  Synthetic construct
GWIHGDY

SEQ ID NO: 1092 - protein, 7 aa, Artificial Sequence
  Synthetic construct
GWIHGVF

SEQ ID NO: 1093 - protein, 7 aa, Artificial Sequence
  Synthetic construct
GWIHGVY

SEQ ID NO: 1094 - protein, 7 aa, Artificial Sequence
  Synthetic construct
GWIHAFF

SEQ ID NO: 1095 - protein, 7 aa, Artificial Sequence
  Synthetic construct
GWIHAFY

SEQ ID NO: 1096 - protein, 7 aa, Artificial Sequence
  Synthetic construct
GWIHARF

SEQ ID NO: 1097 - protein, 7 aa, Artificial Sequence
  Synthetic construct
GWIHARY

SEQ ID NO: 1098 - protein, 7 aa, Artificial Sequence
  Synthetic construct
GWIHACF

SEQ ID NO: 1099 - protein, 7 aa, Artificial Sequence
  Synthetic construct
GWIHACY

SEQ ID NO: 1100 - protein, 7 aa, Artificial Sequence
  Synthetic construct
GWIHALF

SEQ ID NO: 1101 - protein, 7 aa, Artificial Sequence
  Synthetic construct
GWIHALY

SEQ ID NO: 1102 - protein, 7 aa, Artificial Sequence
  Synthetic construct
GWIHAAF

SEQ ID NO: 1103 - protein, 7 aa, Artificial Sequence
  Synthetic construct
GWIHAAY

SEQ ID NO: 1104 - protein, 7 aa, Artificial Sequence
  Synthetic construct
GWIHAQF

SEQ ID NO: 1105 - protein, 7 aa, Artificial Sequence
  Synthetic construct
GWIHAQY

SEQ ID NO: 1106 - protein, 7 aa, Artificial Sequence
  Synthetic construct
GWIHADF

SEQ ID NO: 1107 - protein, 7 aa, Artificial Sequence
  Synthetic construct
GWIHADY

SEQ ID NO: 1108 - protein, 7 aa, Artificial Sequence
  Synthetic construct
GWIHAVF

SEQ ID NO: 1109 - protein, 7 aa, Artificial Sequence
  Synthetic construct
GWIHAVY

SEQ ID NO: 1110 - protein, 7 aa, Artificial Sequence
  Synthetic construct
GWIHQFF

SEQ ID NO: 1111 - protein, 7 aa, Artificial Sequence
  Synthetic construct
GWIHQFY

SEQ ID NO: 1112 - protein, 7 aa, Artificial Sequence
  Synthetic construct
GWIHQRF

SEQ ID NO: 1113 - protein, 7 aa, Artificial Sequence
  Synthetic construct
GWIHQRY

SEQ ID NO: 1114 - protein, 7 aa, Artificial Sequence
  Synthetic construct
GWIHQCF

SEQ ID NO: 1115 - protein, 7 aa, Artificial Sequence
  Synthetic construct
GWIHQCY

SEQ ID NO: 1116 - protein, 7 aa, Artificial Sequence
  Synthetic construct
GWIHQLF

SEQ ID NO: 1117 - protein, 7 aa, Artificial Sequence
  Synthetic construct
GWIHQLY

SEQ ID NO: 1118 - protein, 7 aa, Artificial Sequence
  Synthetic construct
GWIHQAF

SEQ ID NO: 1119 - protein, 7 aa, Artificial Sequence
  Synthetic construct
GWIHQAY

SEQ ID NO: 1120 - protein, 7 aa, Artificial Sequence
  Synthetic construct
GWIHQQF

SEQ ID NO: 1121 - protein, 7 aa, Artificial Sequence
  Synthetic construct
GWIHQQY

SEQ ID NO: 1122 - protein, 7 aa, Artificial Sequence
  Synthetic construct
GWIHQDF

SEQ ID NO: 1123 - protein, 7 aa, Artificial Sequence
  Synthetic construct
GWIHQDY

SEQ ID NO: 1124 - protein, 7 aa, Artificial Sequence
  Synthetic construct
GWIHQVF

SEQ ID NO: 1125 - protein, 7 aa, Artificial Sequence
  Synthetic construct
GWIHQVY

SEQ ID NO: 1126 - protein, 7 aa, Artificial Sequence
  Synthetic construct
GWILIFF

SEQ ID NO: 1127 - protein, 7 aa, Artificial Sequence
  Synthetic construct
GWILIFY

SEQ ID NO: 1128 - protein, 7 aa, Artificial Sequence
  Synthetic construct
GWILIRF

SEQ ID NO: 1129 - protein, 7 aa, Artificial Sequence
  Synthetic construct
GWILIRY

SEQ ID NO: 1130 - protein, 7 aa, Artificial Sequence
  Synthetic construct
GWILICF

SEQ ID NO: 1131 - protein, 7 aa, Artificial Sequence
  Synthetic construct
GWILICY

SEQ ID NO: 1132 - protein, 7 aa, Artificial Sequence
  Synthetic construct
GWILILF

SEQ ID NO: 1133 - protein, 7 aa, Artificial Sequence
  Synthetic construct
GWILILY

SEQ ID NO: 1134 - protein, 7 aa, Artificial Sequence
  Synthetic construct
GWILIAF

SEQ ID NO: 1135 - protein, 7 aa, Artificial Sequence
  Synthetic construct
GWILIAY

SEQ ID NO: 1136 - protein, 7 aa, Artificial Sequence
  Synthetic construct
GWILIQF

SEQ ID NO: 1137 - protein, 7 aa, Artificial Sequence
  Synthetic construct
GWILIQY

SEQ ID NO: 1138 - protein, 7 aa, Artificial Sequence
  Synthetic construct
GWILIDF

SEQ ID NO: 1139 - protein, 7 aa, Artificial Sequence
  Synthetic construct
GWILIDY

SEQ ID NO: 1140 - protein, 7 aa, Artificial Sequence
  Synthetic construct
GWILIVF

SEQ ID NO: 1141 - protein, 7 aa, Artificial Sequence
  Synthetic construct
GWILIVY

SEQ ID NO: 1142 - protein, 7 aa, Artificial Sequence
  Synthetic construct
GWILDFF

SEQ ID NO: 1143 - protein, 7 aa, Artificial Sequence
  Synthetic construct
GWILDFY

SEQ ID NO: 1144 - protein, 7 aa, Artificial Sequence
  Synthetic construct
GWILDRF

SEQ ID NO: 1145 - protein, 7 aa, Artificial Sequence
  Synthetic construct
GWILDRY

SEQ ID NO: 1146 - protein, 7 aa, Artificial Sequence
  Synthetic construct
GWILDCF

SEQ ID NO: 1147 - protein, 7 aa, Artificial Sequence
  Synthetic construct
GWILDCY

SEQ ID NO: 1148 - protein, 7 aa, Artificial Sequence
  Synthetic construct
GWILDLF

SEQ ID NO: 1149 - protein, 7 aa, Artificial Sequence
  Synthetic construct
GWILDLY

SEQ ID NO: 1150 - protein, 7 aa, Artificial Sequence
  Synthetic construct
GWILDAF

SEQ ID NO: 1151 - protein, 7 aa, Artificial Sequence
  Synthetic construct
GWILDAY

SEQ ID NO: 1152 - protein, 7 aa, Artificial Sequence
  Synthetic construct
GWILDQF

SEQ ID NO: 1153 - protein, 7 aa, Artificial Sequence
  Synthetic construct
GWILDQY

SEQ ID NO: 1154 - protein, 7 aa, Artificial Sequence
  Synthetic construct
GWILDDF

SEQ ID NO: 1155 - protein, 7 aa, Artificial Sequence
  Synthetic construct
GWILDDY

SEQ ID NO: 1156 - protein, 7 aa, Artificial Sequence
  Synthetic construct
GWILDVF

SEQ ID NO: 1157 - protein, 7 aa, Artificial Sequence
  Synthetic construct
GWILDVY

SEQ ID NO: 1158 - protein, 7 aa, Artificial Sequence
  Synthetic construct
GWILYFF

SEQ ID NO: 1159 - protein, 7 aa, Artificial Sequence
  Synthetic construct
GWILYFY

SEQ ID NO: 1160 - protein, 7 aa, Artificial Sequence
  Synthetic construct
GWILYRF

SEQ ID NO: 1161 - protein, 7 aa, Artificial Sequence
  Synthetic construct
GWILYRY

SEQ ID NO: 1162 - protein, 7 aa, Artificial Sequence
  Synthetic construct
GWILYCF

SEQ ID NO: 1163 - protein, 7 aa, Artificial Sequence
  Synthetic construct
GWILYCY

SEQ ID NO: 1164 - protein, 7 aa, Artificial Sequence
  Synthetic construct
GWILYLF

SEQ ID NO: 1165 - protein, 7 aa, Artificial Sequence
  Synthetic construct
GWILYLY

SEQ ID NO: 1166 - protein, 7 aa, Artificial Sequence
  Synthetic construct
GWILYAF

SEQ ID NO: 1167 - protein, 7 aa, Artificial Sequence
  Synthetic construct
GWILYAY

SEQ ID NO: 1168 - protein, 7 aa, Artificial Sequence
  Synthetic construct
GWILYQF

SEQ ID NO: 1169 - protein, 7 aa, Artificial Sequence
  Synthetic construct
GWILYQY

SEQ ID NO: 1170 - protein, 7 aa, Artificial Sequence
  Synthetic construct
GWILYDF

SEQ ID NO: 1171 - protein, 7 aa, Artificial Sequence
  Synthetic construct
GWILYDY

SEQ ID NO: 1172 - protein, 7 aa, Artificial Sequence
  Synthetic construct
GWILYVF

SEQ ID NO: 1173 - protein, 7 aa, Artificial Sequence
  Synthetic construct
GWILYVY

SEQ ID NO: 1174 - protein, 7 aa, Artificial Sequence
  Synthetic construct
GWILFFF

SEQ ID NO: 1175 - protein, 7 aa, Artificial Sequence
  Synthetic construct
GWILFFY

SEQ ID NO: 1176 - protein, 7 aa, Artificial Sequence
  Synthetic construct
GWILFRF

SEQ ID NO: 1177 - protein, 7 aa, Artificial Sequence
  Synthetic construct
GWILFRY

SEQ ID NO: 1178 - protein, 7 aa, Artificial Sequence
  Synthetic construct
GWILFCF

SEQ ID NO: 1179 - protein, 7 aa, Artificial Sequence
  Synthetic construct
GWILFCY

SEQ ID NO: 1180 - protein, 7 aa, Artificial Sequence
  Synthetic construct
GWILFLF

SEQ ID NO: 1181 - protein, 7 aa, Artificial Sequence
  Synthetic construct
GWILFLY

SEQ ID NO: 1182 - protein, 7 aa, Artificial Sequence
  Synthetic construct
GWILFAF

SEQ ID NO: 1183 - protein, 7 aa, Artificial Sequence
  Synthetic construct
GWILFAY

SEQ ID NO: 1184 - protein, 7 aa, Artificial Sequence
  Synthetic construct
GWILFQF

SEQ ID NO: 1185 - protein, 7 aa, Artificial Sequence
  Synthetic construct
GWILFQY

SEQ ID NO: 1186 - protein, 7 aa, Artificial Sequence
  Synthetic construct
GWILFDF

SEQ ID NO: 1187 - protein, 7 aa, Artificial Sequence
  Synthetic construct
GWILFDY

SEQ ID NO: 1188 - protein, 7 aa, Artificial Sequence
  Synthetic construct
GWILFVF

SEQ ID NO: 1189 - protein, 7 aa, Artificial Sequence
  Synthetic construct
GWILFVY

SEQ ID NO: 1190 - protein, 7 aa, Artificial Sequence
  Synthetic construct
GWILVFF

SEQ ID NO: 1191 - protein, 7 aa, Artificial Sequence
  Synthetic construct
GWILVFY

SEQ ID NO: 1192 - protein, 7 aa, Artificial Sequence
  Synthetic construct
GWILVRF

SEQ ID NO: 1193 - protein, 7 aa, Artificial Sequence
  Synthetic construct
GWILVRY

SEQ ID NO: 1194 - protein, 7 aa, Artificial Sequence
  Synthetic construct
GWILVCF

SEQ ID NO: 1195 - protein, 7 aa, Artificial Sequence
  Synthetic construct
GWILVCY

SEQ ID NO: 1196 - protein, 7 aa, Artificial Sequence
  Synthetic construct
GWILVLF

SEQ ID NO: 1197 - protein, 7 aa, Artificial Sequence
  Synthetic construct
GWILVLY

SEQ ID NO: 1198 - protein, 7 aa, Artificial Sequence
  Synthetic construct
GWILVAF

SEQ ID NO: 1199 - protein, 7 aa, Artificial Sequence
  Synthetic construct
GWILVAY

SEQ ID NO: 1200 - protein, 7 aa, Artificial Sequence
  Synthetic construct
GWILVQF

SEQ ID NO: 1201 - protein, 7 aa, Artificial Sequence
  Synthetic construct
GWILVQY

SEQ ID NO: 1202 - protein, 7 aa, Artificial Sequence
  Synthetic construct
GWILVDF

SEQ ID NO: 1203 - protein, 7 aa, Artificial Sequence
  Synthetic construct
GWILVDY

SEQ ID NO: 1204 - protein, 7 aa, Artificial Sequence
  Synthetic construct
GWILVVF

SEQ ID NO: 1205 - protein, 7 aa, Artificial Sequence
  Synthetic construct
GWILVVY

SEQ ID NO: 1206 - protein, 7 aa, Artificial Sequence
  Synthetic construct
GWILTFF

SEQ ID NO: 1207 - protein, 7 aa, Artificial Sequence
  Synthetic construct
GWILTFY

SEQ ID NO: 1208 - protein, 7 aa, Artificial Sequence
  Synthetic construct
GWILTRF

SEQ ID NO: 1209 - protein, 7 aa, Artificial Sequence
  Synthetic construct
GWILTRY

SEQ ID NO: 1210 - protein, 7 aa, Artificial Sequence
  Synthetic construct
GWILTCF

SEQ ID NO: 1211 - protein, 7 aa, Artificial Sequence
  Synthetic construct
GWILTCY

SEQ ID NO: 1212 - protein, 7 aa, Artificial Sequence
  Synthetic construct
GWILTLF

SEQ ID NO: 1213 - protein, 7 aa, Artificial Sequence
  Synthetic construct
GWILTLY

SEQ ID NO: 1214 - protein, 7 aa, Artificial Sequence
  Synthetic construct
GWILTAF

SEQ ID NO: 1215 - protein, 7 aa, Artificial Sequence
  Synthetic construct
GWILTAY

SEQ ID NO: 1216 - protein, 7 aa, Artificial Sequence
  Synthetic construct
GWILTQF

SEQ ID NO: 1217 - protein, 7 aa, Artificial Sequence
  Synthetic construct
GWILTQY

SEQ ID NO: 1218 - protein, 7 aa, Artificial Sequence
  Synthetic construct
GWILTDF

SEQ ID NO: 1219 - protein, 7 aa, Artificial Sequence
  Synthetic construct
GWILTDY

SEQ ID NO: 1220 - protein, 7 aa, Artificial Sequence
  Synthetic construct
GWILTVF

SEQ ID NO: 1221 - protein, 7 aa, Artificial Sequence
  Synthetic construct
GWILTVY

SEQ ID NO: 1222 - protein, 7 aa, Artificial Sequence
  Synthetic construct
GWILGFF

SEQ ID NO: 1223 - protein, 7 aa, Artificial Sequence
  Synthetic construct
GWILGFY

SEQ ID NO: 1224 - protein, 7 aa, Artificial Sequence
  Synthetic construct
GWILGRF

SEQ ID NO: 1225 - protein, 7 aa, Artificial Sequence
  Synthetic construct
GWILGRY

SEQ ID NO: 1226 - protein, 7 aa, Artificial Sequence
  Synthetic construct
GWILGCF

SEQ ID NO: 1227 - protein, 7 aa, Artificial Sequence
  Synthetic construct
GWILGCY

SEQ ID NO: 1228 - protein, 7 aa, Artificial Sequence
  Synthetic construct
GWILGLF

SEQ ID NO: 1229 - protein, 7 aa, Artificial Sequence
  Synthetic construct
GWILGLY

SEQ ID NO: 1230 - protein, 7 aa, Artificial Sequence
  Synthetic construct
GWILGAF

SEQ ID NO: 1231 - protein, 7 aa, Artificial Sequence
  Synthetic construct
GWILGAY

SEQ ID NO: 1232 - protein, 7 aa, Artificial Sequence
  Synthetic construct
GWILGQF

SEQ ID NO: 1233 - protein, 7 aa, Artificial Sequence
  Synthetic construct
GWILGQY

SEQ ID NO: 1234 - protein, 7 aa, Artificial Sequence
  Synthetic construct
GWILGDF

SEQ ID NO: 1235 - protein, 7 aa, Artificial Sequence
  Synthetic construct
GWILGDY

SEQ ID NO: 1236 - protein, 7 aa, Artificial Sequence
  Synthetic construct
GWILGVF

SEQ ID NO: 1237 - protein, 7 aa, Artificial Sequence
  Synthetic construct
GWILGVY

SEQ ID NO: 1238 - protein, 7 aa, Artificial Sequence
  Synthetic construct
GWILAFF

SEQ ID NO: 1239 - protein, 7 aa, Artificial Sequence
  Synthetic construct
GWILAFY

SEQ ID NO: 1240 - protein, 7 aa, Artificial Sequence
  Synthetic construct
GWILARF

SEQ ID NO: 1241 - protein, 7 aa, Artificial Sequence
  Synthetic construct
GWILARY

SEQ ID NO: 1242 - protein, 7 aa, Artificial Sequence
  Synthetic construct
GWILACF

SEQ ID NO: 1243 - protein, 7 aa, Artificial Sequence
  Synthetic construct
GWILACY

SEQ ID NO: 1244 - protein, 7 aa, Artificial Sequence
  Synthetic construct
GWILALF

SEQ ID NO: 1245 - protein, 7 aa, Artificial Sequence
  Synthetic construct
GWILALY

SEQ ID NO: 1246 - protein, 7 aa, Artificial Sequence
  Synthetic construct
GWILAAF

SEQ ID NO: 1247 - protein, 7 aa, Artificial Sequence
  Synthetic construct
GWILAAY

SEQ ID NO: 1248 - protein, 7 aa, Artificial Sequence
  Synthetic construct
GWILAQF

SEQ ID NO: 1249 - protein, 7 aa, Artificial Sequence
  Synthetic construct
GWILAQY

SEQ ID NO: 1250 - protein, 7 aa, Artificial Sequence
  Synthetic construct
GWILADF

SEQ ID NO: 1251 - protein, 7 aa, Artificial Sequence
  Synthetic construct
GWILADY

SEQ ID NO: 1252 - protein, 7 aa, Artificial Sequence
  Synthetic construct
GWILAVF

SEQ ID NO: 1253 - protein, 7 aa, Artificial Sequence
  Synthetic construct
GWILAVY

SEQ ID NO: 1254 - protein, 7 aa, Artificial Sequence
  Synthetic construct
GWILQFF

SEQ ID NO: 1255 - protein, 7 aa, Artificial Sequence
  Synthetic construct
GWILQFY

SEQ ID NO: 1256 - protein, 7 aa, Artificial Sequence
  Synthetic construct
GWILQRF

SEQ ID NO: 1257 - protein, 7 aa, Artificial Sequence
  Synthetic construct
GWILQRY

SEQ ID NO: 1258 - protein, 7 aa, Artificial Sequence
  Synthetic construct
GWILQCF

SEQ ID NO: 1259 - protein, 7 aa, Artificial Sequence
  Synthetic construct
GWILQCY

SEQ ID NO: 1260 - protein, 7 aa, Artificial Sequence
  Synthetic construct
GWILQLF

SEQ ID NO: 1261 - protein, 7 aa, Artificial Sequence
  Synthetic construct
GWILQLY

SEQ ID NO: 1262 - protein, 7 aa, Artificial Sequence
  Synthetic construct
GWILQAF

SEQ ID NO: 1263 - protein, 7 aa, Artificial Sequence
  Synthetic construct
GWILQAY

SEQ ID NO: 1264 - protein, 7 aa, Artificial Sequence
  Synthetic construct
GWILQQF

SEQ ID NO: 1265 - protein, 7 aa, Artificial Sequence
  Synthetic construct
GWILQQY

SEQ ID NO: 1266 - protein, 7 aa, Artificial Sequence
  Synthetic construct
GWILQDF

SEQ ID NO: 1267 - protein, 7 aa, Artificial Sequence
  Synthetic construct
GWILQDY

SEQ ID NO: 1268 - protein, 7 aa, Artificial Sequence
  Synthetic construct
GWILQVF

SEQ ID NO: 1269 - protein, 7 aa, Artificial Sequence
  Synthetic construct
GWILQVY

SEQ ID NO: 1270 - protein, 7 aa, Artificial Sequence
  Synthetic construct
GWIFIFF

SEQ ID NO: 1271 - protein, 7 aa, Artificial Sequence
  Synthetic construct
GWIFIFY

SEQ ID NO: 1272 - protein, 7 aa, Artificial Sequence
  Synthetic construct
GWIFIRF

SEQ ID NO: 1273 - protein, 7 aa, Artificial Sequence
  Synthetic construct
GWIFIRY

SEQ ID NO: 1274 - protein, 7 aa, Artificial Sequence
  Synthetic construct
GWIFICF

SEQ ID NO: 1275 - protein, 7 aa, Artificial Sequence
  Synthetic construct
GWIFICY

SEQ ID NO: 1276 - protein, 7 aa, Artificial Sequence
  Synthetic construct
GWIFILF

SEQ ID NO: 1277 - protein, 7 aa, Artificial Sequence
  Synthetic construct
GWIFILY

SEQ ID NO: 1278 - protein, 7 aa, Artificial Sequence
  Synthetic construct
GWIFIAF

SEQ ID NO: 1279 - protein, 7 aa, Artificial Sequence
  Synthetic construct
GWIFIAY

SEQ ID NO: 1280 - protein, 7 aa, Artificial Sequence
  Synthetic construct
GWIFIQF

SEQ ID NO: 1281 - protein, 7 aa, Artificial Sequence
  Synthetic construct
GWIFIQY

SEQ ID NO: 1282 - protein, 7 aa, Artificial Sequence
  Synthetic construct
GWIFIDF

SEQ ID NO: 1283 - protein, 7 aa, Artificial Sequence
  Synthetic construct
GWIFIDY

SEQ ID NO: 1284 - protein, 7 aa, Artificial Sequence
  Synthetic construct
GWIFIVF

SEQ ID NO: 1285 - protein, 7 aa, Artificial Sequence
  Synthetic construct
GWIFIVY

SEQ ID NO: 1286 - protein, 7 aa, Artificial Sequence
  Synthetic construct
GWIFDFF

SEQ ID NO: 1287 - protein, 7 aa, Artificial Sequence
  Synthetic construct
GWIFDFY

SEQ ID NO: 1288 - protein, 7 aa, Artificial Sequence
  Synthetic construct
GWIFDRF

SEQ ID NO: 1289 - protein, 7 aa, Artificial Sequence
  Synthetic construct
GWIFDRY

SEQ ID NO: 1290 - protein, 7 aa, Artificial Sequence
  Synthetic construct
GWIFDCF

SEQ ID NO: 1291 - protein, 7 aa, Artificial Sequence
  Synthetic construct
GWIFDCY

SEQ ID NO: 1292 - protein, 7 aa, Artificial Sequence
  Synthetic construct
GWIFDLF

SEQ ID NO: 1293 - protein, 7 aa, Artificial Sequence
  Synthetic construct
GWIFDLY

SEQ ID NO: 1294 - protein, 7 aa, Artificial Sequence
  Synthetic construct
GWIFDAF

SEQ ID NO: 1295 - protein, 7 aa, Artificial Sequence
  Synthetic construct
GWIFDAY

SEQ ID NO: 1296 - protein, 7 aa, Artificial Sequence
  Synthetic construct
GWIFDQF

SEQ ID NO: 1297 - protein, 7 aa, Artificial Sequence
  Synthetic construct
GWIFDQY

SEQ ID NO: 1298 - protein, 7 aa, Artificial Sequence
  Synthetic construct
GWIFDDF

SEQ ID NO: 1299 - protein, 7 aa, Artificial Sequence
  Synthetic construct
GWIFDDY

SEQ ID NO: 1300 - protein, 7 aa, Artificial Sequence
  Synthetic construct
GWIFDVF

SEQ ID NO: 1301 - protein, 7 aa, Artificial Sequence
  Synthetic construct
GWIFDVY

SEQ ID NO: 1302 - protein, 7 aa, Artificial Sequence
  Synthetic construct
GWIFYFF

SEQ ID NO: 1303 - protein, 7 aa, Artificial Sequence
  Synthetic construct
GWIFYFY

SEQ ID NO: 1304 - protein, 7 aa, Artificial Sequence
  Synthetic construct
GWIFYRF

SEQ ID NO: 1305 - protein, 7 aa, Artificial Sequence
  Synthetic construct
GWIFYRY

SEQ ID NO: 1306 - protein, 7 aa, Artificial Sequence
  Synthetic construct
GWIFYCF

SEQ ID NO: 1307 - protein, 7 aa, Artificial Sequence
  Synthetic construct
GWIFYCY

SEQ ID NO: 1308 - protein, 7 aa, Artificial Sequence
  Synthetic construct
GWIFYLF

SEQ ID NO: 1309 - protein, 7 aa, Artificial Sequence
  Synthetic construct
GWIFYLY

SEQ ID NO: 1310 - protein, 7 aa, Artificial Sequence
  Synthetic construct
GWIFYAF

SEQ ID NO: 1311 - protein, 7 aa, Artificial Sequence
  Synthetic construct
GWIFYAY

SEQ ID NO: 1312 - protein, 7 aa, Artificial Sequence
  Synthetic construct
GWIFYQF

SEQ ID NO: 1313 - protein, 7 aa, Artificial Sequence
  Synthetic construct
GWIFYQY

SEQ ID NO: 1314 - protein, 7 aa, Artificial Sequence
  Synthetic construct
GWIFYDF

SEQ ID NO: 1315 - protein, 7 aa, Artificial Sequence
  Synthetic construct
GWIFYDY

SEQ ID NO: 1316 - protein, 7 aa, Artificial Sequence
  Synthetic construct
GWIFYVF

SEQ ID NO: 1317 - protein, 7 aa, Artificial Sequence
  Synthetic construct
GWIFYVY

SEQ ID NO: 1318 - protein, 7 aa, Artificial Sequence
  Synthetic construct
GWIFFFF

SEQ ID NO: 1319 - protein, 7 aa, Artificial Sequence
  Synthetic construct
GWIFFFY

SEQ ID NO: 1320 - protein, 7 aa, Artificial Sequence
  Synthetic construct
GWIFFRF

SEQ ID NO: 1321 - protein, 7 aa, Artificial Sequence
  Synthetic construct
GWIFFRY

SEQ ID NO: 1322 - protein, 7 aa, Artificial Sequence
  Synthetic construct
GWIFFCF

SEQ ID NO: 1323 - protein, 7 aa, Artificial Sequence
  Synthetic construct
GWIFFCY

SEQ ID NO: 1324 - protein, 7 aa, Artificial Sequence
  Synthetic construct
GWIFFLF

SEQ ID NO: 1325 - protein, 7 aa, Artificial Sequence
  Synthetic construct
GWIFFLY

SEQ ID NO: 1326 - protein, 7 aa, Artificial Sequence
  Synthetic construct
GWIFFAF

SEQ ID NO: 1327 - protein, 7 aa, Artificial Sequence
  Synthetic construct
GWIFFAY

SEQ ID NO: 1328 - protein, 7 aa, Artificial Sequence
  Synthetic construct
GWIFFQF

SEQ ID NO: 1329 - protein, 7 aa, Artificial Sequence
  Synthetic construct
GWIFFQY

SEQ ID NO: 1330 - protein, 7 aa, Artificial Sequence
  Synthetic construct
GWIFFDF

SEQ ID NO: 1331 - protein, 7 aa, Artificial Sequence
  Synthetic construct
GWIFFDY

SEQ ID NO: 1332 - protein, 7 aa, Artificial Sequence
  Synthetic construct
GWIFFVF

SEQ ID NO: 1333 - protein, 7 aa, Artificial Sequence
  Synthetic construct
GWIFFVY

SEQ ID NO: 1334 - protein, 7 aa, Artificial Sequence
  Synthetic construct
GWIFVFF

SEQ ID NO: 1335 - protein, 7 aa, Artificial Sequence
  Synthetic construct
GWIFVFY

SEQ ID NO: 1336 - protein, 7 aa, Artificial Sequence
  Synthetic construct
GWIFVRF

SEQ ID NO: 1337 - protein, 7 aa, Artificial Sequence
  Synthetic construct
GWIFVRY

SEQ ID NO: 1338 - protein, 7 aa, Artificial Sequence
  Synthetic construct
GWIFVCF

SEQ ID NO: 1339 - protein, 7 aa, Artificial Sequence
  Synthetic construct
GWIFVCY

SEQ ID NO: 1340 - protein, 7 aa, Artificial Sequence
  Synthetic construct
GWIFVLF

SEQ ID NO: 1341 - protein, 7 aa, Artificial Sequence
  Synthetic construct
GWIFVLY

SEQ ID NO: 1342 - protein, 7 aa, Artificial Sequence
  Synthetic construct
GWIFVAF

SEQ ID NO: 1343 - protein, 7 aa, Artificial Sequence
  Synthetic construct
GWIFVAY

SEQ ID NO: 1344 - protein, 7 aa, Artificial Sequence
  Synthetic construct
GWIFVQF

SEQ ID NO: 1345 - protein, 7 aa, Artificial Sequence
  Synthetic construct
GWIFVQY

SEQ ID NO: 1346 - protein, 7 aa, Artificial Sequence
  Synthetic construct
GWIFVDF

SEQ ID NO: 1347 - protein, 7 aa, Artificial Sequence
  Synthetic construct
GWIFVDY

SEQ ID NO: 1348 - protein, 7 aa, Artificial Sequence
  Synthetic construct
GWIFVVF

SEQ ID NO: 1349 - protein, 7 aa, Artificial Sequence
  Synthetic construct
GWIFVVY

SEQ ID NO: 1350 - protein, 7 aa, Artificial Sequence
  Synthetic construct
GWIFTFF

SEQ ID NO: 1351 - protein, 7 aa, Artificial Sequence
  Synthetic construct
GWIFTFY

SEQ ID NO: 1352 - protein, 7 aa, Artificial Sequence
  Synthetic construct
GWIFTRF

SEQ ID NO: 1353 - protein, 7 aa, Artificial Sequence
  Synthetic construct
GWIFTRY

SEQ ID NO: 1354 - protein, 7 aa, Artificial Sequence
  Synthetic construct
GWIFTCF

SEQ ID NO: 1355 - protein, 7 aa, Artificial Sequence
  Synthetic construct
GWIFTCY

SEQ ID NO: 1356 - protein, 7 aa, Artificial Sequence
  Synthetic construct
GWIFTLF

SEQ ID NO: 1357 - protein, 7 aa, Artificial Sequence
  Synthetic construct
GWIFTLY

SEQ ID NO: 1358 - protein, 7 aa, Artificial Sequence
  Synthetic construct
GWIFTAF

SEQ ID NO: 1359 - protein, 7 aa, Artificial Sequence
  Synthetic construct
GWIFTAY

SEQ ID NO: 1360 - protein, 7 aa, Artificial Sequence
  Synthetic construct
GWIFTQF

SEQ ID NO: 1361 - protein, 7 aa, Artificial Sequence
  Synthetic construct
GWIFTQY

SEQ ID NO: 1362 - protein, 7 aa, Artificial Sequence
  Synthetic construct
GWIFTDF

SEQ ID NO: 1363 - protein, 7 aa, Artificial Sequence
  Synthetic construct
GWIFTDY

SEQ ID NO: 1364 - protein, 7 aa, Artificial Sequence
  Synthetic construct
GWIFTVF

SEQ ID NO: 1365 - protein, 7 aa, Artificial Sequence
  Synthetic construct
GWIFTVY

SEQ ID NO: 1366 - protein, 7 aa, Artificial Sequence
  Synthetic construct
GWIFGFF

SEQ ID NO: 1367 - protein, 7 aa, Artificial Sequence
  Synthetic construct
GWIFGFY

SEQ ID NO: 1368 - protein, 7 aa, Artificial Sequence
  Synthetic construct
GWIFGRF

SEQ ID NO: 1369 - protein, 7 aa, Artificial Sequence
  Synthetic construct
GWIFGRY

SEQ ID NO: 1370 - protein, 7 aa, Artificial Sequence
  Synthetic construct
GWIFGCF

SEQ ID NO: 1371 - protein, 7 aa, Artificial Sequence
  Synthetic construct
GWIFGCY

SEQ ID NO: 1372 - protein, 7 aa, Artificial Sequence
  Synthetic construct
GWIFGLF

SEQ ID NO: 1373 - protein, 7 aa, Artificial Sequence
  Synthetic construct
GWIFGLY

SEQ ID NO: 1374 - protein, 7 aa, Artificial Sequence
  Synthetic construct
GWIFGAF

SEQ ID NO: 1375 - protein, 7 aa, Artificial Sequence
  Synthetic construct
GWIFGAY

SEQ ID NO: 1376 - protein, 7 aa, Artificial Sequence
  Synthetic construct
GWIFGQF

SEQ ID NO: 1377 - protein, 7 aa, Artificial Sequence
  Synthetic construct
GWIFGQY

SEQ ID NO: 1378 - protein, 7 aa, Artificial Sequence
  Synthetic construct
GWIFGDF

SEQ ID NO: 1379 - protein, 7 aa, Artificial Sequence
  Synthetic construct
GWIFGDY

SEQ ID NO: 1380 - protein, 7 aa, Artificial Sequence
  Synthetic construct
GWIFGVF

SEQ ID NO: 1381 - protein, 7 aa, Artificial Sequence
  Synthetic construct
GWIFGVY

SEQ ID NO: 1382 - protein, 7 aa, Artificial Sequence
  Synthetic construct
GWIFAFF

SEQ ID NO: 1383 - protein, 7 aa, Artificial Sequence
  Synthetic construct
GWIFAFY

SEQ ID NO: 1384 - protein, 7 aa, Artificial Sequence
  Synthetic construct
GWIFARF

SEQ ID NO: 1385 - protein, 7 aa, Artificial Sequence
  Synthetic construct
GWIFARY

SEQ ID NO: 1386 - protein, 7 aa, Artificial Sequence
  Synthetic construct
GWIFACF

SEQ ID NO: 1387 - protein, 7 aa, Artificial Sequence
  Synthetic construct
GWIFACY

SEQ ID NO: 1388 - protein, 7 aa, Artificial Sequence
  Synthetic construct
GWIFALF

SEQ ID NO: 1389 - protein, 7 aa, Artificial Sequence
  Synthetic construct
GWIFALY

SEQ ID NO: 1390 - protein, 7 aa, Artificial Sequence
  Synthetic construct
GWIFAAF

SEQ ID NO: 1391 - protein, 7 aa, Artificial Sequence
  Synthetic construct
GWIFAAY

SEQ ID NO: 1392 - protein, 7 aa, Artificial Sequence
  Synthetic construct
GWIFAQF

SEQ ID NO: 1393 - protein, 7 aa, Artificial Sequence
  Synthetic construct
GWIFAQY

SEQ ID NO: 1394 - protein, 7 aa, Artificial Sequence
  Synthetic construct
GWIFADF

SEQ ID NO: 1395 - protein, 7 aa, Artificial Sequence
  Synthetic construct
GWIFADY

SEQ ID NO: 1396 - protein, 7 aa, Artificial Sequence
  Synthetic construct
GWIFAVF

SEQ ID NO: 1397 - protein, 7 aa, Artificial Sequence
  Synthetic construct
GWIFAVY

SEQ ID NO: 1398 - protein, 7 aa, Artificial Sequence
  Synthetic construct
GWIFQFF

SEQ ID NO: 1399 - protein, 7 aa, Artificial Sequence
  Synthetic construct
GWIFQFY

SEQ ID NO: 1400 - protein, 7 aa, Artificial Sequence
  Synthetic construct
GWIFQRF

SEQ ID NO: 1401 - protein, 7 aa, Artificial Sequence
  Synthetic construct
GWIFQRY

SEQ ID NO: 1402 - protein, 7 aa, Artificial Sequence
  Synthetic construct
GWIFQCF

SEQ ID NO: 1403 - protein, 7 aa, Artificial Sequence
  Synthetic construct
GWIFQCY

SEQ ID NO: 1404 - protein, 7 aa, Artificial Sequence
  Synthetic construct
GWIFQLF

SEQ ID NO: 1405 - protein, 7 aa, Artificial Sequence
  Synthetic construct
GWIFQLY

SEQ ID NO: 1406 - protein, 7 aa, Artificial Sequence
  Synthetic construct
GWIFQAF

SEQ ID NO: 1407 - protein, 7 aa, Artificial Sequence
  Synthetic construct
GWIFQAY

SEQ ID NO: 1408 - protein, 7 aa, Artificial Sequence
  Synthetic construct
GWIFQQF

SEQ ID NO: 1409 - protein, 7 aa, Artificial Sequence
  Synthetic construct
GWIFQQY

SEQ ID NO: 1410 - protein, 7 aa, Artificial Sequence
  Synthetic construct
GWIFQDF

SEQ ID NO: 1411 - protein, 7 aa, Artificial Sequence
  Synthetic construct
GWIFQDY

SEQ ID NO: 1412 - protein, 7 aa, Artificial Sequence
  Synthetic construct
GWIFQVF

SEQ ID NO: 1413 - protein, 7 aa, Artificial Sequence
  Synthetic construct
GWIFQVY

SEQ ID NO: 1414 - protein, 7 aa, Artificial Sequence
  Synthetic construct
GWGYIFF

SEQ ID NO: 1415 - protein, 7 aa, Artificial Sequence
  Synthetic construct
GWGYIFY

SEQ ID NO: 1416 - protein, 7 aa, Artificial Sequence
  Synthetic construct
GWGYIRF

SEQ ID NO: 1417 - protein, 7 aa, Artificial Sequence
  Synthetic construct
GWGYIRY

SEQ ID NO: 1418 - protein, 7 aa, Artificial Sequence
  Synthetic construct
GWGYICF

SEQ ID NO: 1419 - protein, 7 aa, Artificial Sequence
  Synthetic construct
GWGYICY

SEQ ID NO: 1420 - protein, 7 aa, Artificial Sequence
  Synthetic construct
GWGYILF

SEQ ID NO: 1421 - protein, 7 aa, Artificial Sequence
  Synthetic construct
GWGYILY

SEQ ID NO: 1422 - protein, 7 aa, Artificial Sequence
  Synthetic construct
GWGYIAF

SEQ ID NO: 1423 - protein, 7 aa, Artificial Sequence
  Synthetic construct
GWGYIAY

SEQ ID NO: 1424 - protein, 7 aa, Artificial Sequence
  Synthetic construct
GWGYIQF

SEQ ID NO: 1425 - protein, 7 aa, Artificial Sequence
  Synthetic construct
GWGYIQY

SEQ ID NO: 1426 - protein, 7 aa, Artificial Sequence
  Synthetic construct
GWGYIDF

SEQ ID NO: 1427 - protein, 7 aa, Artificial Sequence
  Synthetic construct
GWGYIDY

SEQ ID NO: 1428 - protein, 7 aa, Artificial Sequence
  Synthetic construct
GWGYIVF

SEQ ID NO: 1429 - protein, 7 aa, Artificial Sequence
  Synthetic construct
GWGYIVY

SEQ ID NO: 1430 - protein, 7 aa, Artificial Sequence
  Synthetic construct
GWGYDFF

SEQ ID NO: 1431 - protein, 7 aa, Artificial Sequence
  Synthetic construct
GWGYDFY

SEQ ID NO: 1432 - protein, 7 aa, Artificial Sequence
  Synthetic construct
GWGYDRF

SEQ ID NO: 1433 - protein, 7 aa, Artificial Sequence
  Synthetic construct
GWGYDRY

SEQ ID NO: 1434 - protein, 7 aa, Artificial Sequence
  Synthetic construct
GWGYDCF

SEQ ID NO: 1435 - protein, 7 aa, Artificial Sequence
  Synthetic construct
GWGYDCY

SEQ ID NO: 1436 - protein, 7 aa, Artificial Sequence
  Synthetic construct
GWGYDLF

SEQ ID NO: 1437 - protein, 7 aa, Artificial Sequence
  Synthetic construct
GWGYDLY

SEQ ID NO: 1438 - protein, 7 aa, Artificial Sequence
  Synthetic construct
GWGYDAF

SEQ ID NO: 1439 - protein, 7 aa, Artificial Sequence
  Synthetic construct
GWGYDAY

SEQ ID NO: 1440 - protein, 7 aa, Artificial Sequence
  Synthetic construct
GWGYDQF

SEQ ID NO: 1441 - protein, 7 aa, Artificial Sequence
  Synthetic construct
GWGYDQY

SEQ ID NO: 1442 - protein, 7 aa, Artificial Sequence
  Synthetic construct
GWGYDDF

SEQ ID NO: 1443 - protein, 7 aa, Artificial Sequence
  Synthetic construct
GWGYDDY

SEQ ID NO: 1444 - protein, 7 aa, Artificial Sequence
  Synthetic construct
GWGYDVF

SEQ ID NO: 1445 - protein, 7 aa, Artificial Sequence
  Synthetic construct
GWGYDVY

SEQ ID NO: 1446 - protein, 7 aa, Artificial Sequence
  Synthetic construct
GWGYYFF

SEQ ID NO: 1447 - protein, 7 aa, Artificial Sequence
  Synthetic construct
GWGYYFY

SEQ ID NO: 1448 - protein, 7 aa, Artificial Sequence
  Synthetic construct
GWGYYRF

SEQ ID NO: 1449 - protein, 7 aa, Artificial Sequence
  Synthetic construct
GWGYYRY

SEQ ID NO: 1450 - protein, 7 aa, Artificial Sequence
  Synthetic construct
GWGYYCF

SEQ ID NO: 1451 - protein, 7 aa, Artificial Sequence
  Synthetic construct
GWGYYCY

SEQ ID NO: 1452 - protein, 7 aa, Artificial Sequence
  Synthetic construct
GWGYYLF

SEQ ID NO: 1453 - protein, 7 aa, Artificial Sequence
  Synthetic construct
GWGYYLY

SEQ ID NO: 1454 - protein, 7 aa, Artificial Sequence
  Synthetic construct
GWGYYAF

SEQ ID NO: 1455 - protein, 7 aa, Artificial Sequence
  Synthetic construct
GWGYYAY

SEQ ID NO: 1456 - protein, 7 aa, Artificial Sequence
  Synthetic construct
GWGYYQF

SEQ ID NO: 1457 - protein, 7 aa, Artificial Sequence
  Synthetic construct
GWGYYQY

SEQ ID NO: 1458 - protein, 7 aa, Artificial Sequence
  Synthetic construct
GWGYYDF

SEQ ID NO: 1459 - protein, 7 aa, Artificial Sequence
  Synthetic construct
GWGYYDY

SEQ ID NO: 1460 - protein, 7 aa, Artificial Sequence
  Synthetic construct
GWGYYVF

SEQ ID NO: 1461 - protein, 7 aa, Artificial Sequence
  Synthetic construct
GWGYYVY

SEQ ID NO: 1462 - protein, 7 aa, Artificial Sequence
  Synthetic construct
GWGYFFF

SEQ ID NO: 1463 - protein, 7 aa, Artificial Sequence
  Synthetic construct
GWGYFFY

SEQ ID NO: 1464 - protein, 7 aa, Artificial Sequence
  Synthetic construct
GWGYFRF

SEQ ID NO: 1465 - protein, 7 aa, Artificial Sequence
  Synthetic construct
GWGYFRY

SEQ ID NO: 1466 - protein, 7 aa, Artificial Sequence
  Synthetic construct
GWGYFCF

SEQ ID NO: 1467 - protein, 7 aa, Artificial Sequence
  Synthetic construct
GWGYFCY

SEQ ID NO: 1468 - protein, 7 aa, Artificial Sequence
  Synthetic construct
GWGYFLF

SEQ ID NO: 1469 - protein, 7 aa, Artificial Sequence
  Synthetic construct
GWGYFLY

SEQ ID NO: 1470 - protein, 7 aa, Artificial Sequence
  Synthetic construct
GWGYFAF

SEQ ID NO: 1471 - protein, 7 aa, Artificial Sequence
  Synthetic construct
GWGYFAY

SEQ ID NO: 1472 - protein, 7 aa, Artificial Sequence
  Synthetic construct
GWGYFQF

SEQ ID NO: 1473 - protein, 7 aa, Artificial Sequence
  Synthetic construct
GWGYFQY

SEQ ID NO: 1474 - protein, 7 aa, Artificial Sequence
  Synthetic construct
GWGYFDF

SEQ ID NO: 1475 - protein, 7 aa, Artificial Sequence
  Synthetic construct
GWGYFDY

SEQ ID NO: 1476 - protein, 7 aa, Artificial Sequence
  Synthetic construct
GWGYFVF

SEQ ID NO: 1477 - protein, 7 aa, Artificial Sequence
  Synthetic construct
GWGYFVY

SEQ ID NO: 1478 - protein, 7 aa, Artificial Sequence
  Synthetic construct
GWGYVFF

SEQ ID NO: 1479 - protein, 7 aa, Artificial Sequence
  Synthetic construct
GWGYVFY

SEQ ID NO: 1480 - protein, 7 aa, Artificial Sequence
  Synthetic construct
GWGYVRF

SEQ ID NO: 1481 - protein, 7 aa, Artificial Sequence
  Synthetic construct
GWGYVRY

SEQ ID NO: 1482 - protein, 7 aa, Artificial Sequence
  Synthetic construct
GWGYVCF

SEQ ID NO: 1483 - protein, 7 aa, Artificial Sequence
  Synthetic construct
GWGYVCY

SEQ ID NO: 1484 - protein, 7 aa, Artificial Sequence
  Synthetic construct
GWGYVLF

SEQ ID NO: 1485 - protein, 7 aa, Artificial Sequence
  Synthetic construct
GWGYVLY

SEQ ID NO: 1486 - protein, 7 aa, Artificial Sequence
  Synthetic construct
GWGYVAF

SEQ ID NO: 1487 - protein, 7 aa, Artificial Sequence
  Synthetic construct
GWGYVAY

SEQ ID NO: 1488 - protein, 7 aa, Artificial Sequence
  Synthetic construct
GWGYVQF

SEQ ID NO: 1489 - protein, 7 aa, Artificial Sequence
  Synthetic construct
GWGYVQY

SEQ ID NO: 1490 - protein, 7 aa, Artificial Sequence
  Synthetic construct
GWGYVDF

SEQ ID NO: 1491 - protein, 7 aa, Artificial Sequence
  Synthetic construct
GWGYVDY

SEQ ID NO: 1492 - protein, 7 aa, Artificial Sequence
  Synthetic construct
GWGYVVF

SEQ ID NO: 1493 - protein, 7 aa, Artificial Sequence
  Synthetic construct
GWGYVVY

SEQ ID NO: 1494 - protein, 7 aa, Artificial Sequence
  Synthetic construct
GWGYTFF

SEQ ID NO: 1495 - protein, 7 aa, Artificial Sequence
  Synthetic construct
GWGYTFY

SEQ ID NO: 1496 - protein, 7 aa, Artificial Sequence
  Synthetic construct
GWGYTRF

SEQ ID NO: 1497 - protein, 7 aa, Artificial Sequence
  Synthetic construct
GWGYTRY

SEQ ID NO: 1498 - protein, 7 aa, Artificial Sequence
  Synthetic construct
GWGYTCF

SEQ ID NO: 1499 - protein, 7 aa, Artificial Sequence
  Synthetic construct
GWGYTCY

SEQ ID NO: 1500 - protein, 7 aa, Artificial Sequence
  Synthetic construct
GWGYTLF

SEQ ID NO: 1501 - protein, 7 aa, Artificial Sequence
  Synthetic construct
GWGYTLY

SEQ ID NO: 1502 - protein, 7 aa, Artificial Sequence
  Synthetic construct
GWGYTAF

SEQ ID NO: 1503 - protein, 7 aa, Artificial Sequence
  Synthetic construct
GWGYTAY

SEQ ID NO: 1504 - protein, 7 aa, Artificial Sequence
  Synthetic construct
GWGYTQF

SEQ ID NO: 1505 - protein, 7 aa, Artificial Sequence
  Synthetic construct
GWGYTQY

SEQ ID NO: 1506 - protein, 7 aa, Artificial Sequence
  Synthetic construct
GWGYTDF

SEQ ID NO: 1507 - protein, 7 aa, Artificial Sequence
  Synthetic construct
GWGYTDY

SEQ ID NO: 1508 - protein, 7 aa, Artificial Sequence
  Synthetic construct
GWGYTVF

SEQ ID NO: 1509 - protein, 7 aa, Artificial Sequence
  Synthetic construct
GWGYTVY

SEQ ID NO: 1510 - protein, 7 aa, Artificial Sequence
  Synthetic construct
GWGYGFF

SEQ ID NO: 1511 - protein, 7 aa, Artificial Sequence
  Synthetic construct
GWGYGFY

SEQ ID NO: 1512 - protein, 7 aa, Artificial Sequence
  Synthetic construct
GWGYGRF

SEQ ID NO: 1513 - protein, 7 aa, Artificial Sequence
  Synthetic construct
GWGYGRY

SEQ ID NO: 1514 - protein, 7 aa, Artificial Sequence
  Synthetic construct
GWGYGCF

SEQ ID NO: 1515 - protein, 7 aa, Artificial Sequence
  Synthetic construct
GWGYGCY

SEQ ID NO: 1516 - protein, 7 aa, Artificial Sequence
  Synthetic construct
GWGYGLF

SEQ ID NO: 1517 - protein, 7 aa, Artificial Sequence
  Synthetic construct
GWGYGLY

SEQ ID NO: 1518 - protein, 7 aa, Artificial Sequence
  Synthetic construct
GWGYGAF

SEQ ID NO: 1519 - protein, 7 aa, Artificial Sequence
  Synthetic construct
GWGYGAY

SEQ ID NO: 1520 - protein, 7 aa, Artificial Sequence
  Synthetic construct
GWGYGQF

SEQ ID NO: 1521 - protein, 7 aa, Artificial Sequence
  Synthetic construct
GWGYGQY

SEQ ID NO: 1522 - protein, 7 aa, Artificial Sequence
  Synthetic construct
GWGYGDF

SEQ ID NO: 1523 - protein, 7 aa, Artificial Sequence
  Synthetic construct
GWGYGDY

SEQ ID NO: 1524 - protein, 7 aa, Artificial Sequence
  Synthetic construct
GWGYGVF

SEQ ID NO: 1525 - protein, 7 aa, Artificial Sequence
  Synthetic construct
GWGYGVY

SEQ ID NO: 1526 - protein, 7 aa, Artificial Sequence
  Synthetic construct
GWGYAFF

SEQ ID NO: 1527 - protein, 7 aa, Artificial Sequence
  Synthetic construct
GWGYAFY

SEQ ID NO: 1528 - protein, 7 aa, Artificial Sequence
  Synthetic construct
GWGYARF

SEQ ID NO: 1529 - protein, 7 aa, Artificial Sequence
  Synthetic construct
GWGYARY

SEQ ID NO: 1530 - protein, 7 aa, Artificial Sequence
  Synthetic construct
GWGYACF

SEQ ID NO: 1531 - protein, 7 aa, Artificial Sequence
  Synthetic construct
GWGYACY

SEQ ID NO: 1532 - protein, 7 aa, Artificial Sequence
  Synthetic construct
GWGYALF

SEQ ID NO: 1533 - protein, 7 aa, Artificial Sequence
  Synthetic construct
GWGYALY

SEQ ID NO: 1534 - protein, 7 aa, Artificial Sequence
  Synthetic construct
GWGYAAF

SEQ ID NO: 1535 - protein, 7 aa, Artificial Sequence
  Synthetic construct
GWGYAAY

SEQ ID NO: 1536 - protein, 7 aa, Artificial Sequence
  Synthetic construct
GWGYAQF

SEQ ID NO: 1537 - protein, 7 aa, Artificial Sequence
  Synthetic construct
GWGYAQY

SEQ ID NO: 1538 - protein, 7 aa, Artificial Sequence
  Synthetic construct
GWGYADF

SEQ ID NO: 1539 - protein, 7 aa, Artificial Sequence
  Synthetic construct
GWGYADY

SEQ ID NO: 1540 - protein, 7 aa, Artificial Sequence
  Synthetic construct
GWGYAVF

SEQ ID NO: 1541 - protein, 7 aa, Artificial Sequence
  Synthetic construct
GWGYAVY

SEQ ID NO: 1542 - protein, 7 aa, Artificial Sequence
  Synthetic construct
GWGYQFF

SEQ ID NO: 1543 - protein, 7 aa, Artificial Sequence
  Synthetic construct
GWGYQFY

SEQ ID NO: 1544 - protein, 7 aa, Artificial Sequence
  Synthetic construct
GWGYQRF

SEQ ID NO: 1545 - protein, 7 aa, Artificial Sequence
  Synthetic construct
GWGYQRY

SEQ ID NO: 1546 - protein, 7 aa, Artificial Sequence
  Synthetic construct
GWGYQCF

SEQ ID NO: 1547 - protein, 7 aa, Artificial Sequence
  Synthetic construct
GWGYQCY

SEQ ID NO: 1548 - protein, 7 aa, Artificial Sequence
  Synthetic construct
GWGYQLF

SEQ ID NO: 1549 - protein, 7 aa, Artificial Sequence
  Synthetic construct
GWGYQLY

SEQ ID NO: 1550 - protein, 7 aa, Artificial Sequence
  Synthetic construct
GWGYQAF

SEQ ID NO: 1551 - protein, 7 aa, Artificial Sequence
  Synthetic construct
GWGYQAY

SEQ ID NO: 1552 - protein, 7 aa, Artificial Sequence
  Synthetic construct
GWGYQQF

SEQ ID NO: 1553 - protein, 7 aa, Artificial Sequence
  Synthetic construct
GWGYQQY

SEQ ID NO: 1554 - protein, 7 aa, Artificial Sequence
  Synthetic construct
GWGYQDF

SEQ ID NO: 1555 - protein, 7 aa, Artificial Sequence
  Synthetic construct
GWGYQDY

SEQ ID NO: 1556 - protein, 7 aa, Artificial Sequence
  Synthetic construct
GWGYQVF

SEQ ID NO: 1557 - protein, 7 aa, Artificial Sequence
  Synthetic construct
GWGYQVY

SEQ ID NO: 1558 - protein, 7 aa, Artificial Sequence
  Synthetic construct
GWGPIFF

SEQ ID NO: 1559 - protein, 7 aa, Artificial Sequence
  Synthetic construct
GWGPIFY

SEQ ID NO: 1560 - protein, 7 aa, Artificial Sequence
  Synthetic construct
GWGPIRF

SEQ ID NO: 1561 - protein, 7 aa, Artificial Sequence
  Synthetic construct
GWGPIRY

SEQ ID NO: 1562 - protein, 7 aa, Artificial Sequence
  Synthetic construct
GWGPICF

SEQ ID NO: 1563 - protein, 7 aa, Artificial Sequence
  Synthetic construct
GWGPICY

SEQ ID NO: 1564 - protein, 7 aa, Artificial Sequence
  Synthetic construct
GWGPILF

SEQ ID NO: 1565 - protein, 7 aa, Artificial Sequence
  Synthetic construct
GWGPILY

SEQ ID NO: 1566 - protein, 7 aa, Artificial Sequence
  Synthetic construct
GWGPIAF

SEQ ID NO: 1567 - protein, 7 aa, Artificial Sequence
  Synthetic construct
GWGPIAY

SEQ ID NO: 1568 - protein, 7 aa, Artificial Sequence
  Synthetic construct
GWGPIQF

SEQ ID NO: 1569 - protein, 7 aa, Artificial Sequence
  Synthetic construct
GWGPIQY

SEQ ID NO: 1570 - protein, 7 aa, Artificial Sequence
  Synthetic construct
GWGPIDF

SEQ ID NO: 1571 - protein, 7 aa, Artificial Sequence
  Synthetic construct
GWGPIDY

SEQ ID NO: 1572 - protein, 7 aa, Artificial Sequence
  Synthetic construct
GWGPIVF

SEQ ID NO: 1573 - protein, 7 aa, Artificial Sequence
  Synthetic construct
GWGPIVY

SEQ ID NO: 1574 - protein, 7 aa, Artificial Sequence
  Synthetic construct
GWGPDFF

SEQ ID NO: 1575 - protein, 7 aa, Artificial Sequence
  Synthetic construct
GWGPDFY

SEQ ID NO: 1576 - protein, 7 aa, Artificial Sequence
  Synthetic construct
GWGPDRF

SEQ ID NO: 1577 - protein, 7 aa, Artificial Sequence
  Synthetic construct
GWGPDRY

SEQ ID NO: 1578 - protein, 7 aa, Artificial Sequence
  Synthetic construct
GWGPDCF

SEQ ID NO: 1579 - protein, 7 aa, Artificial Sequence
  Synthetic construct
GWGPDCY

SEQ ID NO: 1580 - protein, 7 aa, Artificial Sequence
  Synthetic construct
GWGPDLF

SEQ ID NO: 1581 - protein, 7 aa, Artificial Sequence
  Synthetic construct
GWGPDLY

SEQ ID NO: 1582 - protein, 7 aa, Artificial Sequence
  Synthetic construct
GWGPDAF

SEQ ID NO: 1583 - protein, 7 aa, Artificial Sequence
  Synthetic construct
GWGPDAY

SEQ ID NO: 1584 - protein, 7 aa, Artificial Sequence
  Synthetic construct
GWGPDQF

SEQ ID NO: 1585 - protein, 7 aa, Artificial Sequence
  Synthetic construct
GWGPDQY

SEQ ID NO: 1586 - protein, 7 aa, Artificial Sequence
  Synthetic construct
GWGPDDF

SEQ ID NO: 1587 - protein, 7 aa, Artificial Sequence
  Synthetic construct
GWGPDDY

SEQ ID NO: 1588 - protein, 7 aa, Artificial Sequence
  Synthetic construct
GWGPDVF

SEQ ID NO: 1589 - protein, 7 aa, Artificial Sequence
  Synthetic construct
GWGPDVY

SEQ ID NO: 1590 - protein, 7 aa, Artificial Sequence
  Synthetic construct
GWGPYFF

SEQ ID NO: 1591 - protein, 7 aa, Artificial Sequence
  Synthetic construct
GWGPYFY

SEQ ID NO: 1592 - protein, 7 aa, Artificial Sequence
  Synthetic construct
GWGPYRF

SEQ ID NO: 1593 - protein, 7 aa, Artificial Sequence
  Synthetic construct
GWGPYRY

SEQ ID NO: 1594 - protein, 7 aa, Artificial Sequence
  Synthetic construct
GWGPYCF

SEQ ID NO: 1595 - protein, 7 aa, Artificial Sequence
  Synthetic construct
GWGPYCY

SEQ ID NO: 1596 - protein, 7 aa, Artificial Sequence
  Synthetic construct
GWGPYLF

SEQ ID NO: 1597 - protein, 7 aa, Artificial Sequence
  Synthetic construct
GWGPYLY

SEQ ID NO: 1598 - protein, 7 aa, Artificial Sequence
  Synthetic construct
GWGPYAF

SEQ ID NO: 1599 - protein, 7 aa, Artificial Sequence
  Synthetic construct
GWGPYAY

SEQ ID NO: 1600 - protein, 7 aa, Artificial Sequence
  Synthetic construct
GWGPYQF

SEQ ID NO: 1601 - protein, 7 aa, Artificial Sequence
  Synthetic construct
GWGPYQY

SEQ ID NO: 1602 - protein, 7 aa, Artificial Sequence
  Synthetic construct
GWGPYDF

SEQ ID NO: 1603 - protein, 7 aa, Artificial Sequence
  Synthetic construct
GWGPYDY

SEQ ID NO: 1604 - protein, 7 aa, Artificial Sequence
  Synthetic construct
GWGPYVF

SEQ ID NO: 1605 - protein, 7 aa, Artificial Sequence
  Synthetic construct
GWGPYVY

SEQ ID NO: 1606 - protein, 7 aa, Artificial Sequence
  Synthetic construct
GWGPFFF

SEQ ID NO: 1607 - protein, 7 aa, Artificial Sequence
  Synthetic construct
GWGPFFY

SEQ ID NO: 1608 - protein, 7 aa, Artificial Sequence
  Synthetic construct
GWGPFRF

SEQ ID NO: 1609 - protein, 7 aa, Artificial Sequence
  Synthetic construct
GWGPFRY

SEQ ID NO: 1610 - protein, 7 aa, Artificial Sequence
  Synthetic construct
GWGPFCF

SEQ ID NO: 1611 - protein, 7 aa, Artificial Sequence
  Synthetic construct
GWGPFCY

SEQ ID NO: 1612 - protein, 7 aa, Artificial Sequence
  Synthetic construct
GWGPFLF

SEQ ID NO: 1613 - protein, 7 aa, Artificial Sequence
  Synthetic construct
GWGPFLY

SEQ ID NO: 1614 - protein, 7 aa, Artificial Sequence
  Synthetic construct
GWGPFAF

SEQ ID NO: 1615 - protein, 7 aa, Artificial Sequence
  Synthetic construct
GWGPFAY

SEQ ID NO: 1616 - protein, 7 aa, Artificial Sequence
  Synthetic construct
GWGPFQF

SEQ ID NO: 1617 - protein, 7 aa, Artificial Sequence
  Synthetic construct
GWGPFQY

SEQ ID NO: 1618 - protein, 7 aa, Artificial Sequence
  Synthetic construct
GWGPFDF

SEQ ID NO: 1619 - protein, 7 aa, Artificial Sequence
  Synthetic construct
GWGPFDY

SEQ ID NO: 1620 - protein, 7 aa, Artificial Sequence
  Synthetic construct
GWGPFVF

SEQ ID NO: 1621 - protein, 7 aa, Artificial Sequence
  Synthetic construct
GWGPFVY

SEQ ID NO: 1622 - protein, 7 aa, Artificial Sequence
  Synthetic construct
GWGPVFF

SEQ ID NO: 1623 - protein, 7 aa, Artificial Sequence
  Synthetic construct
GWGPVFY

SEQ ID NO: 1624 - protein, 7 aa, Artificial Sequence
  Synthetic construct
GWGPVRF

SEQ ID NO: 1625 - protein, 7 aa, Artificial Sequence
  Synthetic construct
GWGPVRY

SEQ ID NO: 1626 - protein, 7 aa, Artificial Sequence
  Synthetic construct
GWGPVCF

SEQ ID NO: 1627 - protein, 7 aa, Artificial Sequence
  Synthetic construct
GWGPVCY

SEQ ID NO: 1628 - protein, 7 aa, Artificial Sequence
  Synthetic construct
GWGPVLF

SEQ ID NO: 1629 - protein, 7 aa, Artificial Sequence
  Synthetic construct
GWGPVLY

SEQ ID NO: 1630 - protein, 7 aa, Artificial Sequence
  Synthetic construct
GWGPVAF

SEQ ID NO: 1631 - protein, 7 aa, Artificial Sequence
  Synthetic construct
GWGPVAY

SEQ ID NO: 1632 - protein, 7 aa, Artificial Sequence
  Synthetic construct
GWGPVQF

SEQ ID NO: 1633 - protein, 7 aa, Artificial Sequence
  Synthetic construct
GWGPVQY

SEQ ID NO: 1634 - protein, 7 aa, Artificial Sequence
  Synthetic construct
GWGPVDF

SEQ ID NO: 1635 - protein, 7 aa, Artificial Sequence
  Synthetic construct
GWGPVDY

SEQ ID NO: 1636 - protein, 7 aa, Artificial Sequence
  Synthetic construct
GWGPVVF

SEQ ID NO: 1637 - protein, 7 aa, Artificial Sequence
  Synthetic construct
GWGPVVY

SEQ ID NO: 1638 - protein, 7 aa, Artificial Sequence
  Synthetic construct
GWGPTFF

SEQ ID NO: 1639 - protein, 7 aa, Artificial Sequence
  Synthetic construct
GWGPTFY

SEQ ID NO: 1640 - protein, 7 aa, Artificial Sequence
  Synthetic construct
GWGPTRF

SEQ ID NO: 1641 - protein, 7 aa, Artificial Sequence
  Synthetic construct
GWGPTRY

SEQ ID NO: 1642 - protein, 7 aa, Artificial Sequence
  Synthetic construct
GWGPTCF

SEQ ID NO: 1643 - protein, 7 aa, Artificial Sequence
  Synthetic construct
GWGPTCY

SEQ ID NO: 1644 - protein, 7 aa, Artificial Sequence
  Synthetic construct
GWGPTLF

SEQ ID NO: 1645 - protein, 7 aa, Artificial Sequence
  Synthetic construct
GWGPTLY

SEQ ID NO: 1646 - protein, 7 aa, Artificial Sequence
  Synthetic construct
GWGPTAF

SEQ ID NO: 1647 - protein, 7 aa, Artificial Sequence
  Synthetic construct
GWGPTAY

SEQ ID NO: 1648 - protein, 7 aa, Artificial Sequence
  Synthetic construct
GWGPTQF

SEQ ID NO: 1649 - protein, 7 aa, Artificial Sequence
  Synthetic construct
GWGPTQY

SEQ ID NO: 1650 - protein, 7 aa, Artificial Sequence
  Synthetic construct
GWGPTDF

SEQ ID NO: 1651 - protein, 7 aa, Artificial Sequence
  Synthetic construct
GWGPTDY

SEQ ID NO: 1652 - protein, 7 aa, Artificial Sequence
  Synthetic construct
GWGPTVF

SEQ ID NO: 1653 - protein, 7 aa, Artificial Sequence
  Synthetic construct
GWGPTVY

SEQ ID NO: 1654 - protein, 7 aa, Artificial Sequence
  Synthetic construct
GWGPGFF

SEQ ID NO: 1655 - protein, 7 aa, Artificial Sequence
  Synthetic construct
GWGPGFY

SEQ ID NO: 1656 - protein, 7 aa, Artificial Sequence
  Synthetic construct
GWGPGRF

SEQ ID NO: 1657 - protein, 7 aa, Artificial Sequence
  Synthetic construct
GWGPGRY

SEQ ID NO: 1658 - protein, 7 aa, Artificial Sequence
  Synthetic construct
GWGPGCF

SEQ ID NO: 1659 - protein, 7 aa, Artificial Sequence
  Synthetic construct
GWGPGCY

SEQ ID NO: 1660 - protein, 7 aa, Artificial Sequence
  Synthetic construct
GWGPGLF

SEQ ID NO: 1661 - protein, 7 aa, Artificial Sequence
  Synthetic construct
GWGPGLY

SEQ ID NO: 1662 - protein, 7 aa, Artificial Sequence
  Synthetic construct
GWGPGAF

SEQ ID NO: 1663 - protein, 7 aa, Artificial Sequence
  Synthetic construct
GWGPGAY

SEQ ID NO: 1664 - protein, 7 aa, Artificial Sequence
  Synthetic construct
GWGPGQF

SEQ ID NO: 1665 - protein, 7 aa, Artificial Sequence
  Synthetic construct
GWGPGQY

SEQ ID NO: 1666 - protein, 7 aa, Artificial Sequence
  Synthetic construct
GWGPGDF

SEQ ID NO: 1667 - protein, 7 aa, Artificial Sequence
  Synthetic construct
GWGPGDY

SEQ ID NO: 1668 - protein, 7 aa, Artificial Sequence
  Synthetic construct
GWGPGVF

SEQ ID NO: 1669 - protein, 7 aa, Artificial Sequence
  Synthetic construct
GWGPGVY

SEQ ID NO: 1670 - protein, 7 aa, Artificial Sequence
  Synthetic construct
GWGPAFF

SEQ ID NO: 1671 - protein, 7 aa, Artificial Sequence
  Synthetic construct
GWGPAFY

SEQ ID NO: 1672 - protein, 7 aa, Artificial Sequence
  Synthetic construct
GWGPARF

SEQ ID NO: 1673 - protein, 7 aa, Artificial Sequence
  Synthetic construct
GWGPARY

SEQ ID NO: 1674 - protein, 7 aa, Artificial Sequence
  Synthetic construct
GWGPACF

SEQ ID NO: 1675 - protein, 7 aa, Artificial Sequence
  Synthetic construct
GWGPACY

SEQ ID NO: 1676 - protein, 7 aa, Artificial Sequence
  Synthetic construct
GWGPALF

SEQ ID NO: 1677 - protein, 7 aa, Artificial Sequence
  Synthetic construct
GWGPALY

SEQ ID NO: 1678 - protein, 7 aa, Artificial Sequence
  Synthetic construct
GWGPAAF

SEQ ID NO: 1679 - protein, 7 aa, Artificial Sequence
  Synthetic construct
GWGPAAY

SEQ ID NO: 1680 - protein, 7 aa, Artificial Sequence
  Synthetic construct
GWGPAQF

SEQ ID NO: 1681 - protein, 7 aa, Artificial Sequence
  Synthetic construct
GWGPAQY

SEQ ID NO: 1682 - protein, 7 aa, Artificial Sequence
  Synthetic construct
GWGPADF

SEQ ID NO: 1683 - protein, 7 aa, Artificial Sequence
  Synthetic construct
GWGPADY

SEQ ID NO: 1684 - protein, 7 aa, Artificial Sequence
  Synthetic construct
GWGPAVF

SEQ ID NO: 1685 - protein, 7 aa, Artificial Sequence
  Synthetic construct
GWGPAVY

SEQ ID NO: 1686 - protein, 7 aa, Artificial Sequence
  Synthetic construct
GWGPQFF

SEQ ID NO: 1687 - protein, 7 aa, Artificial Sequence
  Synthetic construct
GWGPQFY

SEQ ID NO: 1688 - protein, 7 aa, Artificial Sequence
  Synthetic construct
GWGPQRF

SEQ ID NO: 1689 - protein, 7 aa, Artificial Sequence
  Synthetic construct
GWGPQRY

SEQ ID NO: 1690 - protein, 7 aa, Artificial Sequence
  Synthetic construct
GWGPQCF

SEQ ID NO: 1691 - protein, 7 aa, Artificial Sequence
  Synthetic construct
GWGPQCY

SEQ ID NO: 1692 - protein, 7 aa, Artificial Sequence
  Synthetic construct
GWGPQLF

SEQ ID NO: 1693 - protein, 7 aa, Artificial Sequence
  Synthetic construct
GWGPQLY

SEQ ID NO: 1694 - protein, 7 aa, Artificial Sequence
  Synthetic construct
GWGPQAF

SEQ ID NO: 1695 - protein, 7 aa, Artificial Sequence
  Synthetic construct
GWGPQAY

SEQ ID NO: 1696 - protein, 7 aa, Artificial Sequence
  Synthetic construct
GWGPQQF

SEQ ID NO: 1697 - protein, 7 aa, Artificial Sequence
  Synthetic construct
GWGPQQY

SEQ ID NO: 1698 - protein, 7 aa, Artificial Sequence
  Synthetic construct
GWGPQDF

SEQ ID NO: 1699 - protein, 7 aa, Artificial Sequence
  Synthetic construct
GWGPQDY

SEQ ID NO: 1700 - protein, 7 aa, Artificial Sequence
  Synthetic construct
GWGPQVF

SEQ ID NO: 1701 - protein, 7 aa, Artificial Sequence
  Synthetic construct
GWGPQVY

SEQ ID NO: 1702 - protein, 7 aa, Artificial Sequence
  Synthetic construct
GWGHIFF

SEQ ID NO: 1703 - protein, 7 aa, Artificial Sequence
  Synthetic construct
GWGHIFY

SEQ ID NO: 1704 - protein, 7 aa, Artificial Sequence
  Synthetic construct
GWGHIRF

SEQ ID NO: 1705 - protein, 7 aa, Artificial Sequence
  Synthetic construct
GWGHIRY

SEQ ID NO: 1706 - protein, 7 aa, Artificial Sequence
  Synthetic construct
GWGHICF

SEQ ID NO: 1707 - protein, 7 aa, Artificial Sequence
  Synthetic construct
GWGHICY

SEQ ID NO: 1708 - protein, 7 aa, Artificial Sequence
  Synthetic construct
GWGHILF

SEQ ID NO: 1709 - protein, 7 aa, Artificial Sequence
  Synthetic construct
GWGHILY

SEQ ID NO: 1710 - protein, 7 aa, Artificial Sequence
  Synthetic construct
GWGHIAF

SEQ ID NO: 1711 - protein, 7 aa, Artificial Sequence
  Synthetic construct
GWGHIAY

SEQ ID NO: 1712 - protein, 7 aa, Artificial Sequence
  Synthetic construct
GWGHIQF

SEQ ID NO: 1713 - protein, 7 aa, Artificial Sequence
  Synthetic construct
GWGHIQY

SEQ ID NO: 1714 - protein, 7 aa, Artificial Sequence
  Synthetic construct
GWGHIDF

SEQ ID NO: 1715 - protein, 7 aa, Artificial Sequence
  Synthetic construct
GWGHIDY

SEQ ID NO: 1716 - protein, 7 aa, Artificial Sequence
  Synthetic construct
GWGHIVF

SEQ ID NO: 1717 - protein, 7 aa, Artificial Sequence
  Synthetic construct
GWGHIVY

SEQ ID NO: 1718 - protein, 7 aa, Artificial Sequence
  Synthetic construct
GWGHDFF

SEQ ID NO: 1719 - protein, 7 aa, Artificial Sequence
  Synthetic construct
GWGHDFY

SEQ ID NO: 1720 - protein, 7 aa, Artificial Sequence
  Synthetic construct
GWGHDRF

SEQ ID NO: 1721 - protein, 7 aa, Artificial Sequence
  Synthetic construct
GWGHDRY

SEQ ID NO: 1722 - protein, 7 aa, Artificial Sequence
  Synthetic construct
GWGHDCF

SEQ ID NO: 1723 - protein, 7 aa, Artificial Sequence
  Synthetic construct
GWGHDCY

SEQ ID NO: 1724 - protein, 7 aa, Artificial Sequence
  Synthetic construct
GWGHDLF

SEQ ID NO: 1725 - protein, 7 aa, Artificial Sequence
  Synthetic construct
GWGHDLY

SEQ ID NO: 1726 - protein, 7 aa, Artificial Sequence
  Synthetic construct
GWGHDAF

SEQ ID NO: 1727 - protein, 7 aa, Artificial Sequence
  Synthetic construct
GWGHDAY

SEQ ID NO: 1728 - protein, 7 aa, Artificial Sequence
  Synthetic construct
GWGHDQF

SEQ ID NO: 1729 - protein, 7 aa, Artificial Sequence
  Synthetic construct
GWGHDQY

SEQ ID NO: 1730 - protein, 7 aa, Artificial Sequence
  Synthetic construct
GWGHDDF

SEQ ID NO: 1731 - protein, 7 aa, Artificial Sequence
  Synthetic construct
GWGHDDY

SEQ ID NO: 1732 - protein, 7 aa, Artificial Sequence
  Synthetic construct
GWGHDVF

SEQ ID NO: 1733 - protein, 7 aa, Artificial Sequence
  Synthetic construct
GWGHDVY

SEQ ID NO: 1734 - protein, 7 aa, Artificial Sequence
  Synthetic construct
GWGHYFF

SEQ ID NO: 1735 - protein, 7 aa, Artificial Sequence
  Synthetic construct
GWGHYFY

SEQ ID NO: 1736 - protein, 7 aa, Artificial Sequence
  Synthetic construct
GWGHYRF

SEQ ID NO: 1737 - protein, 7 aa, Artificial Sequence
  Synthetic construct
GWGHYRY

SEQ ID NO: 1738 - protein, 7 aa, Artificial Sequence
  Synthetic construct
GWGHYCF

SEQ ID NO: 1739 - protein, 7 aa, Artificial Sequence
  Synthetic construct
GWGHYCY

SEQ ID NO: 1740 - protein, 7 aa, Artificial Sequence
  Synthetic construct
GWGHYLF

SEQ ID NO: 1741 - protein, 7 aa, Artificial Sequence
  Synthetic construct
GWGHYLY

SEQ ID NO: 1742 - protein, 7 aa, Artificial Sequence
  Synthetic construct
GWGHYAF

SEQ ID NO: 1743 - protein, 7 aa, Artificial Sequence
  Synthetic construct
GWGHYAY

SEQ ID NO: 1744 - protein, 7 aa, Artificial Sequence
  Synthetic construct
GWGHYQF

SEQ ID NO: 1745 - protein, 7 aa, Artificial Sequence
  Synthetic construct
GWGHYQY

SEQ ID NO: 1746 - protein, 7 aa, Artificial Sequence
  Synthetic construct
GWGHYDF

SEQ ID NO: 1747 - protein, 7 aa, Artificial Sequence
  Synthetic construct
GWGHYDY

SEQ ID NO: 1748 - protein, 7 aa, Artificial Sequence
  Synthetic construct
GWGHYVF

SEQ ID NO: 1749 - protein, 7 aa, Artificial Sequence
  Synthetic construct
GWGHYVY

SEQ ID NO: 1750 - protein, 7 aa, Artificial Sequence
  Synthetic construct
GWGHFFF

SEQ ID NO: 1751 - protein, 7 aa, Artificial Sequence
  Synthetic construct
GWGHFFY

SEQ ID NO: 1752 - protein, 7 aa, Artificial Sequence
  Synthetic construct
GWGHFRF

SEQ ID NO: 1753 - protein, 7 aa, Artificial Sequence
  Synthetic construct
GWGHFRY

SEQ ID NO: 1754 - protein, 7 aa, Artificial Sequence
  Synthetic construct
GWGHFCF

SEQ ID NO: 1755 - protein, 7 aa, Artificial Sequence
  Synthetic construct
GWGHFCY

SEQ ID NO: 1756 - protein, 7 aa, Artificial Sequence
  Synthetic construct
GWGHFLF

SEQ ID NO: 1757 - protein, 7 aa, Artificial Sequence
  Synthetic construct
GWGHFLY

SEQ ID NO: 1758 - protein, 7 aa, Artificial Sequence
  Synthetic construct
GWGHFAF

SEQ ID NO: 1759 - protein, 7 aa, Artificial Sequence
  Synthetic construct
GWGHFAY

SEQ ID NO: 1760 - protein, 7 aa, Artificial Sequence
  Synthetic construct
GWGHFQF

SEQ ID NO: 1761 - protein, 7 aa, Artificial Sequence
  Synthetic construct
GWGHFQY

SEQ ID NO: 1762 - protein, 7 aa, Artificial Sequence
  Synthetic construct
GWGHFDF

SEQ ID NO: 1763 - protein, 7 aa, Artificial Sequence
  Synthetic construct
GWGHFDY

SEQ ID NO: 1764 - protein, 7 aa, Artificial Sequence
  Synthetic construct
GWGHFVF

SEQ ID NO: 1765 - protein, 7 aa, Artificial Sequence
  Synthetic construct
GWGHFVY

SEQ ID NO: 1766 - protein, 7 aa, Artificial Sequence
  Synthetic construct
GWGHVFF

SEQ ID NO: 1767 - protein, 7 aa, Artificial Sequence
  Synthetic construct
GWGHVFY

SEQ ID NO: 1768 - protein, 7 aa, Artificial Sequence
  Synthetic construct
GWGHVRF

SEQ ID NO: 1769 - protein, 7 aa, Artificial Sequence
  Synthetic construct
GWGHVRY

SEQ ID NO: 1770 - protein, 7 aa, Artificial Sequence
  Synthetic construct
GWGHVCF

SEQ ID NO: 1771 - protein, 7 aa, Artificial Sequence
  Synthetic construct
GWGHVCY

SEQ ID NO: 1772 - protein, 7 aa, Artificial Sequence
  Synthetic construct
GWGHVLF

SEQ ID NO: 1773 - protein, 7 aa, Artificial Sequence
  Synthetic construct
GWGHVLY

SEQ ID NO: 1774 - protein, 7 aa, Artificial Sequence
  Synthetic construct
GWGHVAF

SEQ ID NO: 1775 - protein, 7 aa, Artificial Sequence
  Synthetic construct
GWGHVAY

SEQ ID NO: 1776 - protein, 7 aa, Artificial Sequence
  Synthetic construct
GWGHVQF

SEQ ID NO: 1777 - protein, 7 aa, Artificial Sequence
  Synthetic construct
GWGHVQY

SEQ ID NO: 1778 - protein, 7 aa, Artificial Sequence
  Synthetic construct
GWGHVDF

SEQ ID NO: 1779 - protein, 7 aa, Artificial Sequence
  Synthetic construct
GWGHVDY

SEQ ID NO: 1780 - protein, 7 aa, Artificial Sequence
  Synthetic construct
GWGHVVF

SEQ ID NO: 1781 - protein, 7 aa, Artificial Sequence
  Synthetic construct
GWGHVVY

SEQ ID NO: 1782 - protein, 7 aa, Artificial Sequence
  Synthetic construct
GWGHTFF

SEQ ID NO: 1783 - protein, 7 aa, Artificial Sequence
  Synthetic construct
GWGHTFY

SEQ ID NO: 1784 - protein, 7 aa, Artificial Sequence
  Synthetic construct
GWGHTRF

SEQ ID NO: 1785 - protein, 7 aa, Artificial Sequence
  Synthetic construct
GWGHTRY

SEQ ID NO: 1786 - protein, 7 aa, Artificial Sequence
  Synthetic construct
GWGHTCF

SEQ ID NO: 1787 - protein, 7 aa, Artificial Sequence
  Synthetic construct
GWGHTCY

SEQ ID NO: 1788 - protein, 7 aa, Artificial Sequence
  Synthetic construct
GWGHTLF

SEQ ID NO: 1789 - protein, 7 aa, Artificial Sequence
  Synthetic construct
GWGHTLY

SEQ ID NO: 1790 - protein, 7 aa, Artificial Sequence
  Synthetic construct
GWGHTAF

SEQ ID NO: 1791 - protein, 7 aa, Artificial Sequence
  Synthetic construct
GWGHTAY

SEQ ID NO: 1792 - protein, 7 aa, Artificial Sequence
  Synthetic construct
GWGHTQF

SEQ ID NO: 1793 - protein, 7 aa, Artificial Sequence
  Synthetic construct
GWGHTQY

SEQ ID NO: 1794 - protein, 7 aa, Artificial Sequence
  Synthetic construct
GWGHTDF

SEQ ID NO: 1795 - protein, 7 aa, Artificial Sequence
  Synthetic construct
GWGHTDY

SEQ ID NO: 1796 - protein, 7 aa, Artificial Sequence
  Synthetic construct
GWGHTVF

SEQ ID NO: 1797 - protein, 7 aa, Artificial Sequence
  Synthetic construct
GWGHTVY

SEQ ID NO: 1798 - protein, 7 aa, Artificial Sequence
  Synthetic construct
GWGHGFF

SEQ ID NO: 1799 - protein, 7 aa, Artificial Sequence
  Synthetic construct
GWGHGFY

SEQ ID NO: 1800 - protein, 7 aa, Artificial Sequence
  Synthetic construct
GWGHGRF

SEQ ID NO: 1801 - protein, 7 aa, Artificial Sequence
  Synthetic construct
GWGHGRY

SEQ ID NO: 1802 - protein, 7 aa, Artificial Sequence
  Synthetic construct
GWGHGCF

SEQ ID NO: 1803 - protein, 7 aa, Artificial Sequence
  Synthetic construct
GWGHGCY

SEQ ID NO: 1804 - protein, 7 aa, Artificial Sequence
  Synthetic construct
GWGHGLF

SEQ ID NO: 1805 - protein, 7 aa, Artificial Sequence
  Synthetic construct
GWGHGLY

SEQ ID NO: 1806 - protein, 7 aa, Artificial Sequence
  Synthetic construct
GWGHGAF

SEQ ID NO: 1807 - protein, 7 aa, Artificial Sequence
  Synthetic construct
GWGHGAY

SEQ ID NO: 1808 - protein, 7 aa, Artificial Sequence
  Synthetic construct
GWGHGQF

SEQ ID NO: 1809 - protein, 7 aa, Artificial Sequence
  Synthetic construct
GWGHGQY

SEQ ID NO: 1810 - protein, 7 aa, Artificial Sequence
  Synthetic construct
GWGHGDF

SEQ ID NO: 1811 - protein, 7 aa, Artificial Sequence
  Synthetic construct
GWGHGDY

SEQ ID NO: 1812 - protein, 7 aa, Artificial Sequence
  Synthetic construct
GWGHGVF

SEQ ID NO: 1813 - protein, 7 aa, Artificial Sequence
  Synthetic construct
GWGHGVY

SEQ ID NO: 1814 - protein, 7 aa, Artificial Sequence
  Synthetic construct
GWGHAFF

SEQ ID NO: 1815 - protein, 7 aa, Artificial Sequence
  Synthetic construct
GWGHAFY

SEQ ID NO: 1816 - protein, 7 aa, Artificial Sequence
  Synthetic construct
GWGHARF

SEQ ID NO: 1817 - protein, 7 aa, Artificial Sequence
  Synthetic construct
GWGHARY

SEQ ID NO: 1818 - protein, 7 aa, Artificial Sequence
  Synthetic construct
GWGHACF

SEQ ID NO: 1819 - protein, 7 aa, Artificial Sequence
  Synthetic construct
GWGHACY

SEQ ID NO: 1820 - protein, 7 aa, Artificial Sequence
  Synthetic construct
GWGHALF

SEQ ID NO: 1821 - protein, 7 aa, Artificial Sequence
  Synthetic construct
GWGHALY

SEQ ID NO: 1822 - protein, 7 aa, Artificial Sequence
  Synthetic construct
GWGHAAF

SEQ ID NO: 1823 - protein, 7 aa, Artificial Sequence
  Synthetic construct
GWGHAAY

SEQ ID NO: 1824 - protein, 7 aa, Artificial Sequence
  Synthetic construct
GWGHAQF

SEQ ID NO: 1825 - protein, 7 aa, Artificial Sequence
  Synthetic construct
GWGHAQY

SEQ ID NO: 1826 - protein, 7 aa, Artificial Sequence
  Synthetic construct
GWGHADF

SEQ ID NO: 1827 - protein, 7 aa, Artificial Sequence
  Synthetic construct
GWGHADY

SEQ ID NO: 1828 - protein, 7 aa, Artificial Sequence
  Synthetic construct
GWGHAVF

SEQ ID NO: 1829 - protein, 7 aa, Artificial Sequence
  Synthetic construct
GWGHAVY

SEQ ID NO: 1830 - protein, 7 aa, Artificial Sequence
  Synthetic construct
GWGHQFF

SEQ ID NO: 1831 - protein, 7 aa, Artificial Sequence
  Synthetic construct
GWGHQFY

SEQ ID NO: 1832 - protein, 7 aa, Artificial Sequence
  Synthetic construct
GWGHQRF

SEQ ID NO: 1833 - protein, 7 aa, Artificial Sequence
  Synthetic construct
GWGHQRY

SEQ ID NO: 1834 - protein, 7 aa, Artificial Sequence
  Synthetic construct
GWGHQCF

SEQ ID NO: 1835 - protein, 7 aa, Artificial Sequence
  Synthetic construct
GWGHQCY

SEQ ID NO: 1836 - protein, 7 aa, Artificial Sequence
  Synthetic construct
GWGHQLF

SEQ ID NO: 1837 - protein, 7 aa, Artificial Sequence
  Synthetic construct
GWGHQLY

SEQ ID NO: 1838 - protein, 7 aa, Artificial Sequence
  Synthetic construct
GWGHQAF

SEQ ID NO: 1839 - protein, 7 aa, Artificial Sequence
  Synthetic construct
GWGHQAY

SEQ ID NO: 1840 - protein, 7 aa, Artificial Sequence
  Synthetic construct
GWGHQQF

SEQ ID NO: 1841 - protein, 7 aa, Artificial Sequence
  Synthetic construct
GWGHQQY

SEQ ID NO: 1842 - protein, 7 aa, Artificial Sequence
  Synthetic construct
GWGHQDF

SEQ ID NO: 1843 - protein, 7 aa, Artificial Sequence
  Synthetic construct
GWGHQDY

SEQ ID NO: 1844 - protein, 7 aa, Artificial Sequence
  Synthetic construct
GWGHQVF

SEQ ID NO: 1845 - protein, 7 aa, Artificial Sequence
  Synthetic construct
GWGHQVY

SEQ ID NO: 1846 - protein, 7 aa, Artificial Sequence
  Synthetic construct
GWGLIFF

SEQ ID NO: 1847 - protein, 7 aa, Artificial Sequence
  Synthetic construct
GWGLIFY

SEQ ID NO: 1848 - protein, 7 aa, Artificial Sequence
  Synthetic construct
GWGLIRF

SEQ ID NO: 1849 - protein, 7 aa, Artificial Sequence
  Synthetic construct
GWGLIRY

SEQ ID NO: 1850 - protein, 7 aa, Artificial Sequence
  Synthetic construct
GWGLICF

SEQ ID NO: 1851 - protein, 7 aa, Artificial Sequence
  Synthetic construct
GWGLICY

SEQ ID NO: 1852 - protein, 7 aa, Artificial Sequence
  Synthetic construct
GWGLILF

SEQ ID NO: 1853 - protein, 7 aa, Artificial Sequence
  Synthetic construct
GWGLILY

SEQ ID NO: 1854 - protein, 7 aa, Artificial Sequence
  Synthetic construct
GWGLIAF

SEQ ID NO: 1855 - protein, 7 aa, Artificial Sequence
  Synthetic construct
GWGLIAY

SEQ ID NO: 1856 - protein, 7 aa, Artificial Sequence
  Synthetic construct
GWGLIQF

SEQ ID NO: 1857 - protein, 7 aa, Artificial Sequence
  Synthetic construct
GWGLIQY

SEQ ID NO: 1858 - protein, 7 aa, Artificial Sequence
  Synthetic construct
GWGLIDF

SEQ ID NO: 1859 - protein, 7 aa, Artificial Sequence
  Synthetic construct
GWGLIDY

SEQ ID NO: 1860 - protein, 7 aa, Artificial Sequence
  Synthetic construct
GWGLIVF

SEQ ID NO: 1861 - protein, 7 aa, Artificial Sequence
  Synthetic construct
GWGLIVY

SEQ ID NO: 1862 - protein, 7 aa, Artificial Sequence
  Synthetic construct
GWGLDFF

SEQ ID NO: 1863 - protein, 7 aa, Artificial Sequence
  Synthetic construct
GWGLDFY

SEQ ID NO: 1864 - protein, 7 aa, Artificial Sequence
  Synthetic construct
GWGLDRF

SEQ ID NO: 1865 - protein, 7 aa, Artificial Sequence
  Synthetic construct
GWGLDRY

SEQ ID NO: 1866 - protein, 7 aa, Artificial Sequence
  Synthetic construct
GWGLDCF

SEQ ID NO: 1867 - protein, 7 aa, Artificial Sequence
  Synthetic construct
GWGLDCY

SEQ ID NO: 1868 - protein, 7 aa, Artificial Sequence
  Synthetic construct
GWGLDLF

SEQ ID NO: 1869 - protein, 7 aa, Artificial Sequence
  Synthetic construct
GWGLDLY

SEQ ID NO: 1870 - protein, 7 aa, Artificial Sequence
  Synthetic construct
GWGLDAF

SEQ ID NO: 1871 - protein, 7 aa, Artificial Sequence
  Synthetic construct
GWGLDAY

SEQ ID NO: 1872 - protein, 7 aa, Artificial Sequence
  Synthetic construct
GWGLDQF

SEQ ID NO: 1873 - protein, 7 aa, Artificial Sequence
  Synthetic construct
GWGLDQY

SEQ ID NO: 1874 - protein, 7 aa, Artificial Sequence
  Synthetic construct
GWGLDDF

SEQ ID NO: 1875 - protein, 7 aa, Artificial Sequence
  Synthetic construct
GWGLDDY

SEQ ID NO: 1876 - protein, 7 aa, Artificial Sequence
  Synthetic construct
GWGLDVF

SEQ ID NO: 1877 - protein, 7 aa, Artificial Sequence
  Synthetic construct
GWGLDVY

SEQ ID NO: 1878 - protein, 7 aa, Artificial Sequence
  Synthetic construct
GWGLYFF

SEQ ID NO: 1879 - protein, 7 aa, Artificial Sequence
  Synthetic construct
GWGLYFY

SEQ ID NO: 1880 - protein, 7 aa, Artificial Sequence
  Synthetic construct
GWGLYRF

SEQ ID NO: 1881 - protein, 7 aa, Artificial Sequence
  Synthetic construct
GWGLYRY

SEQ ID NO: 1882 - protein, 7 aa, Artificial Sequence
  Synthetic construct
GWGLYCF

SEQ ID NO: 1883 - protein, 7 aa, Artificial Sequence
  Synthetic construct
GWGLYCY

SEQ ID NO: 1884 - protein, 7 aa, Artificial Sequence
  Synthetic construct
GWGLYLF

SEQ ID NO: 1885 - protein, 7 aa, Artificial Sequence
  Synthetic construct
GWGLYLY

SEQ ID NO: 1886 - protein, 7 aa, Artificial Sequence
  Synthetic construct
GWGLYAF

SEQ ID NO: 1887 - protein, 7 aa, Artificial Sequence
  Synthetic construct
GWGLYAY

SEQ ID NO: 1888 - protein, 7 aa, Artificial Sequence
  Synthetic construct
GWGLYQF

SEQ ID NO: 1889 - protein, 7 aa, Artificial Sequence
  Synthetic construct
GWGLYQY

SEQ ID NO: 1890 - protein, 7 aa, Artificial Sequence
  Synthetic construct
GWGLYDF

SEQ ID NO: 1891 - protein, 7 aa, Artificial Sequence
  Synthetic construct
GWGLYDY

SEQ ID NO: 1892 - protein, 7 aa, Artificial Sequence
  Synthetic construct
GWGLYVF

SEQ ID NO: 1893 - protein, 7 aa, Artificial Sequence
  Synthetic construct
GWGLYVY

SEQ ID NO: 1894 - protein, 7 aa, Artificial Sequence
  Synthetic construct
GWGLFFF

SEQ ID NO: 1895 - protein, 7 aa, Artificial Sequence
  Synthetic construct
GWGLFFY

SEQ ID NO: 1896 - protein, 7 aa, Artificial Sequence
  Synthetic construct
GWGLFRF

SEQ ID NO: 1897 - protein, 7 aa, Artificial Sequence
  Synthetic construct
GWGLFRY

SEQ ID NO: 1898 - protein, 7 aa, Artificial Sequence
  Synthetic construct
GWGLFCF

SEQ ID NO: 1899 - protein, 7 aa, Artificial Sequence
  Synthetic construct
GWGLFCY

SEQ ID NO: 1900 - protein, 7 aa, Artificial Sequence
  Synthetic construct
GWGLFLF

SEQ ID NO: 1901 - protein, 7 aa, Artificial Sequence
  Synthetic construct
GWGLFLY

SEQ ID NO: 1902 - protein, 7 aa, Artificial Sequence
  Synthetic construct
GWGLFAF

SEQ ID NO: 1903 - protein, 7 aa, Artificial Sequence
  Synthetic construct
GWGLFAY

SEQ ID NO: 1904 - protein, 7 aa, Artificial Sequence
  Synthetic construct
GWGLFQF

SEQ ID NO: 1905 - protein, 7 aa, Artificial Sequence
  Synthetic construct
GWGLFQY

SEQ ID NO: 1906 - protein, 7 aa, Artificial Sequence
  Synthetic construct
GWGLFDF

SEQ ID NO: 1907 - protein, 7 aa, Artificial Sequence
  Synthetic construct
GWGLFDY

SEQ ID NO: 1908 - protein, 7 aa, Artificial Sequence
  Synthetic construct
GWGLFVF

SEQ ID NO: 1909 - protein, 7 aa, Artificial Sequence
  Synthetic construct
GWGLFVY

SEQ ID NO: 1910 - protein, 7 aa, Artificial Sequence
  Synthetic construct
GWGLVFF

SEQ ID NO: 1911 - protein, 7 aa, Artificial Sequence
  Synthetic construct
GWGLVFY

SEQ ID NO: 1912 - protein, 7 aa, Artificial Sequence
  Synthetic construct
GWGLVRF

SEQ ID NO: 1913 - protein, 7 aa, Artificial Sequence
  Synthetic construct
GWGLVRY

SEQ ID NO: 1914 - protein, 7 aa, Artificial Sequence
  Synthetic construct
GWGLVCF

SEQ ID NO: 1915 - protein, 7 aa, Artificial Sequence
  Synthetic construct
GWGLVCY

SEQ ID NO: 1916 - protein, 7 aa, Artificial Sequence
  Synthetic construct
GWGLVLF

SEQ ID NO: 1917 - protein, 7 aa, Artificial Sequence
  Synthetic construct
GWGLVLY

SEQ ID NO: 1918 - protein, 7 aa, Artificial Sequence
  Synthetic construct
GWGLVAF

SEQ ID NO: 1919 - protein, 7 aa, Artificial Sequence
  Synthetic construct
GWGLVAY

SEQ ID NO: 1920 - protein, 7 aa, Artificial Sequence
  Synthetic construct
GWGLVQF

SEQ ID NO: 1921 - protein, 7 aa, Artificial Sequence
  Synthetic construct
GWGLVQY

SEQ ID NO: 1922 - protein, 7 aa, Artificial Sequence
  Synthetic construct
GWGLVDF

SEQ ID NO: 1923 - protein, 7 aa, Artificial Sequence
  Synthetic construct
GWGLVDY

SEQ ID NO: 1924 - protein, 7 aa, Artificial Sequence
  Synthetic construct
GWGLVVF

SEQ ID NO: 1925 - protein, 7 aa, Artificial Sequence
  Synthetic construct
GWGLVVY

SEQ ID NO: 1926 - protein, 7 aa, Artificial Sequence
  Synthetic construct
GWGLTFF

SEQ ID NO: 1927 - protein, 7 aa, Artificial Sequence
  Synthetic construct
GWGLTFY

SEQ ID NO: 1928 - protein, 7 aa, Artificial Sequence
  Synthetic construct
GWGLTRF

SEQ ID NO: 1929 - protein, 7 aa, Artificial Sequence
  Synthetic construct
GWGLTRY

SEQ ID NO: 1930 - protein, 7 aa, Artificial Sequence
  Synthetic construct
GWGLTCF

SEQ ID NO: 1931 - protein, 7 aa, Artificial Sequence
  Synthetic construct
GWGLTCY

SEQ ID NO: 1932 - protein, 7 aa, Artificial Sequence
  Synthetic construct
GWGLTLF

SEQ ID NO: 1933 - protein, 7 aa, Artificial Sequence
  Synthetic construct
GWGLTLY

SEQ ID NO: 1934 - protein, 7 aa, Artificial Sequence
  Synthetic construct
GWGLTAF

SEQ ID NO: 1935 - protein, 7 aa, Artificial Sequence
  Synthetic construct
GWGLTAY

SEQ ID NO: 1936 - protein, 7 aa, Artificial Sequence
  Synthetic construct
GWGLTQF

SEQ ID NO: 1937 - protein, 7 aa, Artificial Sequence
  Synthetic construct
GWGLTQY

SEQ ID NO: 1938 - protein, 7 aa, Artificial Sequence
  Synthetic construct
GWGLTDF

SEQ ID NO: 1939 - protein, 7 aa, Artificial Sequence
  Synthetic construct
GWGLTDY

SEQ ID NO: 1940 - protein, 7 aa, Artificial Sequence
  Synthetic construct
GWGLTVF

SEQ ID NO: 1941 - protein, 7 aa, Artificial Sequence
  Synthetic construct
GWGLTVY

SEQ ID NO: 1942 - protein, 7 aa, Artificial Sequence
  Synthetic construct
GWGLGFF

SEQ ID NO: 1943 - protein, 7 aa, Artificial Sequence
  Synthetic construct
GWGLGFY

SEQ ID NO: 1944 - protein, 7 aa, Artificial Sequence
  Synthetic construct
GWGLGRF

SEQ ID NO: 1945 - protein, 7 aa, Artificial Sequence
  Synthetic construct
GWGLGRY

SEQ ID NO: 1946 - protein, 7 aa, Artificial Sequence
  Synthetic construct
GWGLGCF

SEQ ID NO: 1947 - protein, 7 aa, Artificial Sequence
  Synthetic construct
GWGLGCY

SEQ ID NO: 1948 - protein, 7 aa, Artificial Sequence
  Synthetic construct
GWGLGLF

SEQ ID NO: 1949 - protein, 7 aa, Artificial Sequence
  Synthetic construct
GWGLGLY

SEQ ID NO: 1950 - protein, 7 aa, Artificial Sequence
  Synthetic construct
GWGLGAF

SEQ ID NO: 1951 - protein, 7 aa, Artificial Sequence
  Synthetic construct
GWGLGAY

SEQ ID NO: 1952 - protein, 7 aa, Artificial Sequence
  Synthetic construct
GWGLGQF

SEQ ID NO: 1953 - protein, 7 aa, Artificial Sequence
  Synthetic construct
GWGLGQY

SEQ ID NO: 1954 - protein, 7 aa, Artificial Sequence
  Synthetic construct
GWGLGDF

SEQ ID NO: 1955 - protein, 7 aa, Artificial Sequence
  Synthetic construct
GWGLGDY

SEQ ID NO: 1956 - protein, 7 aa, Artificial Sequence
  Synthetic construct
GWGLGVF

SEQ ID NO: 1957 - protein, 7 aa, Artificial Sequence
  Synthetic construct
GWGLGVY

SEQ ID NO: 1958 - protein, 7 aa, Artificial Sequence
  Synthetic construct
GWGLAFF

SEQ ID NO: 1959 - protein, 7 aa, Artificial Sequence
  Synthetic construct
GWGLAFY

SEQ ID NO: 1960 - protein, 7 aa, Artificial Sequence
  Synthetic construct
GWGLARF

SEQ ID NO: 1961 - protein, 7 aa, Artificial Sequence
  Synthetic construct
GWGLARY

SEQ ID NO: 1962 - protein, 7 aa, Artificial Sequence
  Synthetic construct
GWGLACF

SEQ ID NO: 1963 - protein, 7 aa, Artificial Sequence
  Synthetic construct
GWGLACY

SEQ ID NO: 1964 - protein, 7 aa, Artificial Sequence
  Synthetic construct
GWGLALF

SEQ ID NO: 1965 - protein, 7 aa, Artificial Sequence
  Synthetic construct
GWGLALY

SEQ ID NO: 1966 - protein, 7 aa, Artificial Sequence
  Synthetic construct
GWGLAAF

SEQ ID NO: 1967 - protein, 7 aa, Artificial Sequence
  Synthetic construct
GWGLAAY

SEQ ID NO: 1968 - protein, 7 aa, Artificial Sequence
  Synthetic construct
GWGLAQF

SEQ ID NO: 1969 - protein, 7 aa, Artificial Sequence
  Synthetic construct
GWGLAQY

SEQ ID NO: 1970 - protein, 7 aa, Artificial Sequence
  Synthetic construct
GWGLADF

SEQ ID NO: 1971 - protein, 7 aa, Artificial Sequence
  Synthetic construct
GWGLADY

SEQ ID NO: 1972 - protein, 7 aa, Artificial Sequence
  Synthetic construct
GWGLAVF

SEQ ID NO: 1973 - protein, 7 aa, Artificial Sequence
  Synthetic construct
GWGLAVY

SEQ ID NO: 1974 - protein, 7 aa, Artificial Sequence
  Synthetic construct
GWGLQFF

SEQ ID NO: 1975 - protein, 7 aa, Artificial Sequence
  Synthetic construct
GWGLQFY

SEQ ID NO: 1976 - protein, 7 aa, Artificial Sequence
  Synthetic construct
GWGLQRF

SEQ ID NO: 1977 - protein, 7 aa, Artificial Sequence
  Synthetic construct
GWGLQRY

SEQ ID NO: 1978 - protein, 7 aa, Artificial Sequence
  Synthetic construct
GWGLQCF

SEQ ID NO: 1979 - protein, 7 aa, Artificial Sequence
  Synthetic construct
GWGLQCY

SEQ ID NO: 1980 - protein, 7 aa, Artificial Sequence
  Synthetic construct
GWGLQLF

SEQ ID NO: 1981 - protein, 7 aa, Artificial Sequence
  Synthetic construct
GWGLQLY

SEQ ID NO: 1982 - protein, 7 aa, Artificial Sequence
  Synthetic construct
GWGLQAF

SEQ ID NO: 1983 - protein, 7 aa, Artificial Sequence
  Synthetic construct
GWGLQAY

SEQ ID NO: 1984 - protein, 7 aa, Artificial Sequence
  Synthetic construct
GWGLQQF

SEQ ID NO: 1985 - protein, 7 aa, Artificial Sequence
  Synthetic construct
GWGLQQY

SEQ ID NO: 1986 - protein, 7 aa, Artificial Sequence
  Synthetic construct
GWGLQDF

SEQ ID NO: 1987 - protein, 7 aa, Artificial Sequence
  Synthetic construct
GWGLQDY

SEQ ID NO: 1988 - protein, 7 aa, Artificial Sequence
  Synthetic construct
GWGLQVF

SEQ ID NO: 1989 - protein, 7 aa, Artificial Sequence
  Synthetic construct
GWGLQVY

SEQ ID NO: 1990 - protein, 7 aa, Artificial Sequence
  Synthetic construct
GWGFIFF

SEQ ID NO: 1991 - protein, 7 aa, Artificial Sequence
  Synthetic construct
GWGFIFY

SEQ ID NO: 1992 - protein, 7 aa, Artificial Sequence
  Synthetic construct
GWGFIRF

SEQ ID NO: 1993 - protein, 7 aa, Artificial Sequence
  Synthetic construct
GWGFIRY

SEQ ID NO: 1994 - protein, 7 aa, Artificial Sequence
  Synthetic construct
GWGFICF

SEQ ID NO: 1995 - protein, 7 aa, Artificial Sequence
  Synthetic construct
GWGFICY

SEQ ID NO: 1996 - protein, 7 aa, Artificial Sequence
  Synthetic construct
GWGFILF

SEQ ID NO: 1997 - protein, 7 aa, Artificial Sequence
  Synthetic construct
GWGFILY

SEQ ID NO: 1998 - protein, 7 aa, Artificial Sequence
  Synthetic construct
GWGFIAF

SEQ ID NO: 1999 - protein, 7 aa, Artificial Sequence
  Synthetic construct
GWGFIAY

SEQ ID NO: 2000 - protein, 7 aa, Artificial Sequence
  Synthetic construct
GWGFIQF

SEQ ID NO: 2001 - protein, 7 aa, Artificial Sequence
  Synthetic construct
GWGFIQY

SEQ ID NO: 2002 - protein, 7 aa, Artificial Sequence
  Synthetic construct
GWGFIDF

SEQ ID NO: 2003 - protein, 7 aa, Artificial Sequence
  Synthetic construct
GWGFIDY

SEQ ID NO: 2004 - protein, 7 aa, Artificial Sequence
  Synthetic construct
GWGFIVF

SEQ ID NO: 2005 - protein, 7 aa, Artificial Sequence
  Synthetic construct
GWGFIVY

SEQ ID NO: 2006 - protein, 7 aa, Artificial Sequence
  Synthetic construct
GWGFDFF

SEQ ID NO: 2007 - protein, 7 aa, Artificial Sequence
  Synthetic construct
GWGFDFY

SEQ ID NO: 2008 - protein, 7 aa, Artificial Sequence
  Synthetic construct
GWGFDRF

SEQ ID NO: 2009 - protein, 7 aa, Artificial Sequence
  Synthetic construct
GWGFDRY

SEQ ID NO: 2010 - protein, 7 aa, Artificial Sequence
  Synthetic construct
GWGFDCF

SEQ ID NO: 2011 - protein, 7 aa, Artificial Sequence
  Synthetic construct
GWGFDCY

SEQ ID NO: 2012 - protein, 7 aa, Artificial Sequence
  Synthetic construct
GWGFDLF

SEQ ID NO: 2013 - protein, 7 aa, Artificial Sequence
  Synthetic construct
GWGFDLY

SEQ ID NO: 2014 - protein, 7 aa, Artificial Sequence
  Synthetic construct
GWGFDAF

SEQ ID NO: 2015 - protein, 7 aa, Artificial Sequence
  Synthetic construct
GWGFDAY

SEQ ID NO: 2016 - protein, 7 aa, Artificial Sequence
  Synthetic construct
GWGFDQF

SEQ ID NO: 2017 - protein, 7 aa, Artificial Sequence
  Synthetic construct
GWGFDQY

SEQ ID NO: 2018 - protein, 7 aa, Artificial Sequence
  Synthetic construct
GWGFDDF

SEQ ID NO: 2019 - protein, 7 aa, Artificial Sequence
  Synthetic construct
GWGFDDY

SEQ ID NO: 2020 - protein, 7 aa, Artificial Sequence
  Synthetic construct
GWGFDVF

SEQ ID NO: 2021 - protein, 7 aa, Artificial Sequence
  Synthetic construct
GWGFDVY

SEQ ID NO: 2022 - protein, 7 aa, Artificial Sequence
  Synthetic construct
GWGFYFF

SEQ ID NO: 2023 - protein, 7 aa, Artificial Sequence
  Synthetic construct
GWGFYFY

SEQ ID NO: 2024 - protein, 7 aa, Artificial Sequence
  Synthetic construct
GWGFYRF

SEQ ID NO: 2025 - protein, 7 aa, Artificial Sequence
  Synthetic construct
GWGFYRY

SEQ ID NO: 2026 - protein, 7 aa, Artificial Sequence
  Synthetic construct
GWGFYCF

SEQ ID NO: 2027 - protein, 7 aa, Artificial Sequence
  Synthetic construct
GWGFYCY

SEQ ID NO: 2028 - protein, 7 aa, Artificial Sequence
  Synthetic construct
GWGFYLF

SEQ ID NO: 2029 - protein, 7 aa, Artificial Sequence
  Synthetic construct
GWGFYLY

SEQ ID NO: 2030 - protein, 7 aa, Artificial Sequence
  Synthetic construct
GWGFYAF

SEQ ID NO: 2031 - protein, 7 aa, Artificial Sequence
  Synthetic construct
GWGFYAY

SEQ ID NO: 2032 - protein, 7 aa, Artificial Sequence
  Synthetic construct
GWGFYQF

SEQ ID NO: 2033 - protein, 7 aa, Artificial Sequence
  Synthetic construct
GWGFYQY

SEQ ID NO: 2034 - protein, 7 aa, Artificial Sequence
  Synthetic construct
GWGFYDF

SEQ ID NO: 2035 - protein, 7 aa, Artificial Sequence
  Synthetic construct
GWGFYDY

SEQ ID NO: 2036 - protein, 7 aa, Artificial Sequence
  Synthetic construct
GWGFYVF

SEQ ID NO: 2037 - protein, 7 aa, Artificial Sequence
  Synthetic construct
GWGFYVY

SEQ ID NO: 2038 - protein, 7 aa, Artificial Sequence
  Synthetic construct
GWGFFFF

SEQ ID NO: 2039 - protein, 7 aa, Artificial Sequence
  Synthetic construct
GWGFFFY

SEQ ID NO: 2040 - protein, 7 aa, Artificial Sequence
  Synthetic construct
GWGFFRF

SEQ ID NO: 2041 - protein, 7 aa, Artificial Sequence
  Synthetic construct
GWGFFRY

SEQ ID NO: 2042 - protein, 7 aa, Artificial Sequence
  Synthetic construct
GWGFFCF

SEQ ID NO: 2043 - protein, 7 aa, Artificial Sequence
  Synthetic construct
GWGFFCY

SEQ ID NO: 2044 - protein, 7 aa, Artificial Sequence
  Synthetic construct
GWGFFLF

SEQ ID NO: 2045 - protein, 7 aa, Artificial Sequence
  Synthetic construct
GWGFFLY

SEQ ID NO: 2046 - protein, 7 aa, Artificial Sequence
  Synthetic construct
GWGFFAF

SEQ ID NO: 2047 - protein, 7 aa, Artificial Sequence
  Synthetic construct
GWGFFAY

SEQ ID NO: 2048 - protein, 7 aa, Artificial Sequence
  Synthetic construct
GWGFFQF

SEQ ID NO: 2049 - protein, 7 aa, Artificial Sequence
  Synthetic construct
GWGFFQY

SEQ ID NO: 2050 - protein, 7 aa, Artificial Sequence
  Synthetic construct
GWGFFDF

SEQ ID NO: 2051 - protein, 7 aa, Artificial Sequence
  Synthetic construct
GWGFFDY

SEQ ID NO: 2052 - protein, 7 aa, Artificial Sequence
  Synthetic construct
GWGFFVF

SEQ ID NO: 2053 - protein, 7 aa, Artificial Sequence
  Synthetic construct
GWGFFVY

SEQ ID NO: 2054 - protein, 7 aa, Artificial Sequence
  Synthetic construct
GWGFVFF

SEQ ID NO: 2055 - protein, 7 aa, Artificial Sequence
  Synthetic construct
GWGFVFY

SEQ ID NO: 2056 - protein, 7 aa, Artificial Sequence
  Synthetic construct
GWGFVRF

SEQ ID NO: 2057 - protein, 7 aa, Artificial Sequence
  Synthetic construct
GWGFVRY

SEQ ID NO: 2058 - protein, 7 aa, Artificial Sequence
  Synthetic construct
GWGFVCF

SEQ ID NO: 2059 - protein, 7 aa, Artificial Sequence
  Synthetic construct
GWGFVCY

SEQ ID NO: 2060 - protein, 7 aa, Artificial Sequence
  Synthetic construct
GWGFVLF

SEQ ID NO: 2061 - protein, 7 aa, Artificial Sequence
  Synthetic construct
GWGFVLY

SEQ ID NO: 2062 - protein, 7 aa, Artificial Sequence
  Synthetic construct
GWGFVAF

SEQ ID NO: 2063 - protein, 7 aa, Artificial Sequence
  Synthetic construct
GWGFVAY

SEQ ID NO: 2064 - protein, 7 aa, Artificial Sequence
  Synthetic construct
GWGFVQF

SEQ ID NO: 2065 - protein, 7 aa, Artificial Sequence
  Synthetic construct
GWGFVQY

SEQ ID NO: 2066 - protein, 7 aa, Artificial Sequence
  Synthetic construct
GWGFVDF

SEQ ID NO: 2067 - protein, 7 aa, Artificial Sequence
  Synthetic construct
GWGFVDY

SEQ ID NO: 2068 - protein, 7 aa, Artificial Sequence
  Synthetic construct
GWGFVVF

SEQ ID NO: 2069 - protein, 7 aa, Artificial Sequence
  Synthetic construct
GWGFVVY

SEQ ID NO: 2070 - protein, 7 aa, Artificial Sequence
  Synthetic construct
GWGFTFF

SEQ ID NO: 2071 - protein, 7 aa, Artificial Sequence
  Synthetic construct
GWGFTFY

SEQ ID NO: 2072 - protein, 7 aa, Artificial Sequence
  Synthetic construct
GWGFTRF

SEQ ID NO: 2073 - protein, 7 aa, Artificial Sequence
  Synthetic construct
GWGFTRY

SEQ ID NO: 2074 - protein, 7 aa, Artificial Sequence
  Synthetic construct
GWGFTCF

SEQ ID NO: 2075 - protein, 7 aa, Artificial Sequence
  Synthetic construct
GWGFTCY

SEQ ID NO: 2076 - protein, 7 aa, Artificial Sequence
  Synthetic construct
GWGFTLF

SEQ ID NO: 2077 - protein, 7 aa, Artificial Sequence
  Synthetic construct
GWGFTLY

SEQ ID NO: 2078 - protein, 7 aa, Artificial Sequence
  Synthetic construct
GWGFTAF

SEQ ID NO: 2079 - protein, 7 aa, Artificial Sequence
  Synthetic construct
GWGFTAY

SEQ ID NO: 2080 - protein, 7 aa, Artificial Sequence
  Synthetic construct
GWGFTQF

SEQ ID NO: 2081 - protein, 7 aa, Artificial Sequence
  Synthetic construct
GWGFTQY

SEQ ID NO: 2082 - protein, 7 aa, Artificial Sequence
  Synthetic construct
GWGFTDF

SEQ ID NO: 2083 - protein, 7 aa, Artificial Sequence
  Synthetic construct
GWGFTDY

SEQ ID NO: 2084 - protein, 7 aa, Artificial Sequence
  Synthetic construct
GWGFTVF

SEQ ID NO: 2085 - protein, 7 aa, Artificial Sequence
  Synthetic construct
GWGFTVY

SEQ ID NO: 2086 - protein, 7 aa, Artificial Sequence
  Synthetic construct
GWGFGFF

SEQ ID NO: 2087 - protein, 7 aa, Artificial Sequence
  Synthetic construct
GWGFGFY

SEQ ID NO: 2088 - protein, 7 aa, Artificial Sequence
  Synthetic construct
GWGFGRF

SEQ ID NO: 2089 - protein, 7 aa, Artificial Sequence
  Synthetic construct
GWGFGRY

SEQ ID NO: 2090 - protein, 7 aa, Artificial Sequence
  Synthetic construct
GWGFGCF

SEQ ID NO: 2091 - protein, 7 aa, Artificial Sequence
  Synthetic construct
GWGFGCY

SEQ ID NO: 2092 - protein, 7 aa, Artificial Sequence
  Synthetic construct
GWGFGLF

SEQ ID NO: 2093 - protein, 7 aa, Artificial Sequence
  Synthetic construct
GWGFGLY

SEQ ID NO: 2094 - protein, 7 aa, Artificial Sequence
  Synthetic construct
GWGFGAF

SEQ ID NO: 2095 - protein, 7 aa, Artificial Sequence
  Synthetic construct
GWGFGAY

SEQ ID NO: 2096 - protein, 7 aa, Artificial Sequence
  Synthetic construct
GWGFGQF

SEQ ID NO: 2097 - protein, 7 aa, Artificial Sequence
  Synthetic construct
GWGFGQY

SEQ ID NO: 2098 - protein, 7 aa, Artificial Sequence
  Synthetic construct
GWGFGDF

SEQ ID NO: 2099 - protein, 7 aa, Artificial Sequence
  Synthetic construct
GWGFGDY

SEQ ID NO: 2100 - protein, 7 aa, Artificial Sequence
  Synthetic construct
GWGFGVF

SEQ ID NO: 2101 - protein, 7 aa, Artificial Sequence
  Synthetic construct
GWGFGVY

SEQ ID NO: 2102 - protein, 7 aa, Artificial Sequence
  Synthetic construct
GWGFAFF

SEQ ID NO: 2103 - protein, 7 aa, Artificial Sequence
  Synthetic construct
GWGFAFY

SEQ ID NO: 2104 - protein, 7 aa, Artificial Sequence
  Synthetic construct
GWGFARF

SEQ ID NO: 2105 - protein, 7 aa, Artificial Sequence
  Synthetic construct
GWGFARY

SEQ ID NO: 2106 - protein, 7 aa, Artificial Sequence
  Synthetic construct
GWGFACF

SEQ ID NO: 2107 - protein, 7 aa, Artificial Sequence
  Synthetic construct
GWGFACY

SEQ ID NO: 2108 - protein, 7 aa, Artificial Sequence
  Synthetic construct
GWGFALF

SEQ ID NO: 2109 - protein, 7 aa, Artificial Sequence
  Synthetic construct
GWGFALY

SEQ ID NO: 2110 - protein, 7 aa, Artificial Sequence
  Synthetic construct
GWGFAAF

SEQ ID NO: 2111 - protein, 7 aa, Artificial Sequence
  Synthetic construct
GWGFAAY

SEQ ID NO: 2112 - protein, 7 aa, Artificial Sequence
  Synthetic construct
GWGFAQF

SEQ ID NO: 2113 - protein, 7 aa, Artificial Sequence
  Synthetic construct
GWGFAQY

SEQ ID NO: 2114 - protein, 7 aa, Artificial Sequence
  Synthetic construct
GWGFADF

SEQ ID NO: 2115 - protein, 7 aa, Artificial Sequence
  Synthetic construct
GWGFADY

SEQ ID NO: 2116 - protein, 7 aa, Artificial Sequence
  Synthetic construct
GWGFAVF

SEQ ID NO: 2117 - protein, 7 aa, Artificial Sequence
  Synthetic construct
GWGFAVY

SEQ ID NO: 2118 - protein, 7 aa, Artificial Sequence
  Synthetic construct
GWGFQFF

SEQ ID NO: 2119 - protein, 7 aa, Artificial Sequence
  Synthetic construct
GWGFQFY

SEQ ID NO: 2120 - protein, 7 aa, Artificial Sequence
  Synthetic construct
GWGFQRF

SEQ ID NO: 2121 - protein, 7 aa, Artificial Sequence
  Synthetic construct
GWGFQRY

SEQ ID NO: 2122 - protein, 7 aa, Artificial Sequence
  Synthetic construct
GWGFQCF

SEQ ID NO: 2123 - protein, 7 aa, Artificial Sequence
  Synthetic construct
GWGFQCY

SEQ ID NO: 2124 - protein, 7 aa, Artificial Sequence
  Synthetic construct
GWGFQLF

SEQ ID NO: 2125 - protein, 7 aa, Artificial Sequence
  Synthetic construct
GWGFQLY

SEQ ID NO: 2126 - protein, 7 aa, Artificial Sequence
  Synthetic construct
GWGFQAF

SEQ ID NO: 2127 - protein, 7 aa, Artificial Sequence
  Synthetic construct
GWGFQAY

SEQ ID NO: 2128 - protein, 7 aa, Artificial Sequence
  Synthetic construct
GWGFQQF

SEQ ID NO: 2129 - protein, 7 aa, Artificial Sequence
  Synthetic construct
GWGFQQY

SEQ ID NO: 2130 - protein, 7 aa, Artificial Sequence
  Synthetic construct
GWGFQDF

SEQ ID NO: 2131 - protein, 7 aa, Artificial Sequence
  Synthetic construct
GWGFQDY

SEQ ID NO: 2132 - protein, 7 aa, Artificial Sequence
  Synthetic construct
GWGFQVF

SEQ ID NO: 2133 - protein, 7 aa, Artificial Sequence
  Synthetic construct
GWGFQVY

SEQ ID NO: 2134 - protein, 7 aa, Artificial Sequence
  Synthetic construct
GVIYIFF

SEQ ID NO: 2135 - protein, 7 aa, Artificial Sequence
  Synthetic construct
GVIYIFY

SEQ ID NO: 2136 - protein, 7 aa, Artificial Sequence
  Synthetic construct
GVIYIRF

SEQ ID NO: 2137 - protein, 7 aa, Artificial Sequence
  Synthetic construct
GVIYIRY

SEQ ID NO: 2138 - protein, 7 aa, Artificial Sequence
  Synthetic construct
GVIYICF

SEQ ID NO: 2139 - protein, 7 aa, Artificial Sequence
  Synthetic construct
GVIYICY

SEQ ID NO: 2140 - protein, 7 aa, Artificial Sequence
  Synthetic construct
GVIYILF

SEQ ID NO: 2141 - protein, 7 aa, Artificial Sequence
  Synthetic construct
GVIYILY

SEQ ID NO: 2142 - protein, 7 aa, Artificial Sequence
  Synthetic construct
GVIYIAF

SEQ ID NO: 2143 - protein, 7 aa, Artificial Sequence
  Synthetic construct
GVIYIAY

SEQ ID NO: 2144 - protein, 7 aa, Artificial Sequence
  Synthetic construct
GVIYIQF

SEQ ID NO: 2145 - protein, 7 aa, Artificial Sequence
  Synthetic construct
GVIYIQY

SEQ ID NO: 2146 - protein, 7 aa, Artificial Sequence
  Synthetic construct
GVIYIDF

SEQ ID NO: 2147 - protein, 7 aa, Artificial Sequence
  Synthetic construct
GVIYIDY

SEQ ID NO: 2148 - protein, 7 aa, Artificial Sequence
  Synthetic construct
GVIYIVF

SEQ ID NO: 2149 - protein, 7 aa, Artificial Sequence
  Synthetic construct
GVIYIVY

SEQ ID NO: 2150 - protein, 7 aa, Artificial Sequence
  Synthetic construct
GVIYDFF

SEQ ID NO: 2151 - protein, 7 aa, Artificial Sequence
  Synthetic construct
GVIYDFY

SEQ ID NO: 2152 - protein, 7 aa, Artificial Sequence
  Synthetic construct
GVIYDRF

SEQ ID NO: 2153 - protein, 7 aa, Artificial Sequence
  Synthetic construct
GVIYDRY

SEQ ID NO: 2154 - protein, 7 aa, Artificial Sequence
  Synthetic construct
GVIYDCF

SEQ ID NO: 2155 - protein, 7 aa, Artificial Sequence
  Synthetic construct
GVIYDCY

SEQ ID NO: 2156 - protein, 7 aa, Artificial Sequence
  Synthetic construct
GVIYDLF

SEQ ID NO: 2157 - protein, 7 aa, Artificial Sequence
  Synthetic construct
GVIYDLY

SEQ ID NO: 2158 - protein, 7 aa, Artificial Sequence
  Synthetic construct
GVIYDAF

SEQ ID NO: 2159 - protein, 7 aa, Artificial Sequence
  Synthetic construct
GVIYDAY

SEQ ID NO: 2160 - protein, 7 aa, Artificial Sequence
  Synthetic construct
GVIYDQF

SEQ ID NO: 2161 - protein, 7 aa, Artificial Sequence
  Synthetic construct
GVIYDQY

SEQ ID NO: 2162 - protein, 7 aa, Artificial Sequence
  Synthetic construct
GVIYDDF

SEQ ID NO: 2163 - protein, 7 aa, Artificial Sequence
  Synthetic construct
GVIYDDY

SEQ ID NO: 2164 - protein, 7 aa, Artificial Sequence
  Synthetic construct
GVIYDVF

SEQ ID NO: 2165 - protein, 7 aa, Artificial Sequence
  Synthetic construct
GVIYDVY

SEQ ID NO: 2166 - protein, 7 aa, Artificial Sequence
  Synthetic construct
GVIYYFF

SEQ ID NO: 2167 - protein, 7 aa, Artificial Sequence
  Synthetic construct
GVIYYFY

SEQ ID NO: 2168 - protein, 7 aa, Artificial Sequence
  Synthetic construct
GVIYYRF

SEQ ID NO: 2169 - protein, 7 aa, Artificial Sequence
  Synthetic construct
GVIYYRY

SEQ ID NO: 2170 - protein, 7 aa, Artificial Sequence
  Synthetic construct
GVIYYCF

SEQ ID NO: 2171 - protein, 7 aa, Artificial Sequence
  Synthetic construct
GVIYYCY

SEQ ID NO: 2172 - protein, 7 aa, Artificial Sequence
  Synthetic construct
GVIYYLF

SEQ ID NO: 2173 - protein, 7 aa, Artificial Sequence
  Synthetic construct
GVIYYLY

SEQ ID NO: 2174 - protein, 7 aa, Artificial Sequence
  Synthetic construct
GVIYYAF

SEQ ID NO: 2175 - protein, 7 aa, Artificial Sequence
  Synthetic construct
GVIYYAY

SEQ ID NO: 2176 - protein, 7 aa, Artificial Sequence
  Synthetic construct
GVIYYQF

SEQ ID NO: 2177 - protein, 7 aa, Artificial Sequence
  Synthetic construct
GVIYYQY

SEQ ID NO: 2178 - protein, 7 aa, Artificial Sequence
  Synthetic construct
GVIYYDF

SEQ ID NO: 2179 - protein, 7 aa, Artificial Sequence
  Synthetic construct
GVIYYDY

SEQ ID NO: 2180 - protein, 7 aa, Artificial Sequence
  Synthetic construct
GVIYYVF

SEQ ID NO: 2181 - protein, 7 aa, Artificial Sequence
  Synthetic construct
GVIYYVY

SEQ ID NO: 2182 - protein, 7 aa, Artificial Sequence
  Synthetic construct
GVIYFFF

SEQ ID NO: 2183 - protein, 7 aa, Artificial Sequence
  Synthetic construct
GVIYFFY

SEQ ID NO: 2184 - protein, 7 aa, Artificial Sequence
  Synthetic construct
GVIYFRF

SEQ ID NO: 2185 - protein, 7 aa, Artificial Sequence
  Synthetic construct
GVIYFRY

SEQ ID NO: 2186 - protein, 7 aa, Artificial Sequence
  Synthetic construct
GVIYFCF

SEQ ID NO: 2187 - protein, 7 aa, Artificial Sequence
  Synthetic construct
GVIYFCY

SEQ ID NO: 2188 - protein, 7 aa, Artificial Sequence
  Synthetic construct
GVIYFLF

SEQ ID NO: 2189 - protein, 7 aa, Artificial Sequence
  Synthetic construct
GVIYFLY

SEQ ID NO: 2190 - protein, 7 aa, Artificial Sequence
  Synthetic construct
GVIYFAF

SEQ ID NO: 2191 - protein, 7 aa, Artificial Sequence
  Synthetic construct
GVIYFAY

SEQ ID NO: 2192 - protein, 7 aa, Artificial Sequence
  Synthetic construct
GVIYFQF

SEQ ID NO: 2193 - protein, 7 aa, Artificial Sequence
  Synthetic construct
GVIYFQY

SEQ ID NO: 2194 - protein, 7 aa, Artificial Sequence
  Synthetic construct
GVIYFDF

SEQ ID NO: 2195 - protein, 7 aa, Artificial Sequence
  Synthetic construct
GVIYFDY

SEQ ID NO: 2196 - protein, 7 aa, Artificial Sequence
  Synthetic construct
GVIYFVF

SEQ ID NO: 2197 - protein, 7 aa, Artificial Sequence
  Synthetic construct
GVIYFVY

SEQ ID NO: 2198 - protein, 7 aa, Artificial Sequence
  Synthetic construct
GVIYVFF

SEQ ID NO: 2199 - protein, 7 aa, Artificial Sequence
  Synthetic construct
GVIYVFY

SEQ ID NO: 2200 - protein, 7 aa, Artificial Sequence
  Synthetic construct
GVIYVRF

SEQ ID NO: 2201 - protein, 7 aa, Artificial Sequence
  Synthetic construct
GVIYVRY

SEQ ID NO: 2202 - protein, 7 aa, Artificial Sequence
  Synthetic construct
GVIYVCF

SEQ ID NO: 2203 - protein, 7 aa, Artificial Sequence
  Synthetic construct
GVIYVCY

SEQ ID NO: 2204 - protein, 7 aa, Artificial Sequence
  Synthetic construct
GVIYVLF

SEQ ID NO: 2205 - protein, 7 aa, Artificial Sequence
  Synthetic construct
GVIYVLY

SEQ ID NO: 2206 - protein, 7 aa, Artificial Sequence
  Synthetic construct
GVIYVAF

SEQ ID NO: 2207 - protein, 7 aa, Artificial Sequence
  Synthetic construct
GVIYVAY

SEQ ID NO: 2208 - protein, 7 aa, Artificial Sequence
  Synthetic construct
GVIYVQF

SEQ ID NO: 2209 - protein, 7 aa, Artificial Sequence
  Synthetic construct
GVIYVQY

SEQ ID NO: 2210 - protein, 7 aa, Artificial Sequence
  Synthetic construct
GVIYVDF

SEQ ID NO: 2211 - protein, 7 aa, Artificial Sequence
  Synthetic construct
GVIYVDY

SEQ ID NO: 2212 - protein, 7 aa, Artificial Sequence
  Synthetic construct
GVIYVVF

SEQ ID NO: 2213 - protein, 7 aa, Artificial Sequence
  Synthetic construct
GVIYVVY

SEQ ID NO: 2214 - protein, 7 aa, Artificial Sequence
  Synthetic construct
GVIYTFF

SEQ ID NO: 2215 - protein, 7 aa, Artificial Sequence
  Synthetic construct
GVIYTFY

SEQ ID NO: 2216 - protein, 7 aa, Artificial Sequence
  Synthetic construct
GVIYTRF

SEQ ID NO: 2217 - protein, 7 aa, Artificial Sequence
  Synthetic construct
GVIYTRY

SEQ ID NO: 2218 - protein, 7 aa, Artificial Sequence
  Synthetic construct
GVIYTCF

SEQ ID NO: 2219 - protein, 7 aa, Artificial Sequence
  Synthetic construct
GVIYTCY

SEQ ID NO: 2220 - protein, 7 aa, Artificial Sequence
  Synthetic construct
GVIYTLF

SEQ ID NO: 2221 - protein, 7 aa, Artificial Sequence
  Synthetic construct
GVIYTLY

SEQ ID NO: 2222 - protein, 7 aa, Artificial Sequence
  Synthetic construct
GVIYTAF

SEQ ID NO: 2223 - protein, 7 aa, Artificial Sequence
  Synthetic construct
GVIYTAY

SEQ ID NO: 2224 - protein, 7 aa, Artificial Sequence
  Synthetic construct
GVIYTQF

SEQ ID NO: 2225 - protein, 7 aa, Artificial Sequence
  Synthetic construct
GVIYTQY

SEQ ID NO: 2226 - protein, 7 aa, Artificial Sequence
  Synthetic construct
GVIYTDF

SEQ ID NO: 2227 - protein, 7 aa, Artificial Sequence
  Synthetic construct
GVIYTDY

SEQ ID NO: 2228 - protein, 7 aa, Artificial Sequence
  Synthetic construct
GVIYTVF

SEQ ID NO: 2229 - protein, 7 aa, Artificial Sequence
  Synthetic construct
GVIYTVY

SEQ ID NO: 2230 - protein, 7 aa, Artificial Sequence
  Synthetic construct
GVIYGFF

SEQ ID NO: 2231 - protein, 7 aa, Artificial Sequence
  Synthetic construct
GVIYGFY

SEQ ID NO: 2232 - protein, 7 aa, Artificial Sequence
  Synthetic construct
GVIYGRF

SEQ ID NO: 2233 - protein, 7 aa, Artificial Sequence
  Synthetic construct
GVIYGRY

SEQ ID NO: 2234 - protein, 7 aa, Artificial Sequence
  Synthetic construct
GVIYGCF

SEQ ID NO: 2235 - protein, 7 aa, Artificial Sequence
  Synthetic construct
GVIYGCY

SEQ ID NO: 2236 - protein, 7 aa, Artificial Sequence
  Synthetic construct
GVIYGLF

SEQ ID NO: 2237 - protein, 7 aa, Artificial Sequence
  Synthetic construct
GVIYGLY

SEQ ID NO: 2238 - protein, 7 aa, Artificial Sequence
  Synthetic construct
GVIYGAF

SEQ ID NO: 2239 - protein, 7 aa, Artificial Sequence
  Synthetic construct
GVIYGAY

SEQ ID NO: 2240 - protein, 7 aa, Artificial Sequence
  Synthetic construct
GVIYGQF

SEQ ID NO: 2241 - protein, 7 aa, Artificial Sequence
  Synthetic construct
GVIYGQY

SEQ ID NO: 2242 - protein, 7 aa, Artificial Sequence
  Synthetic construct
GVIYGDF

SEQ ID NO: 2243 - protein, 7 aa, Artificial Sequence
  Synthetic construct
GVIYGDY

SEQ ID NO: 2244 - protein, 7 aa, Artificial Sequence
  Synthetic construct
GVIYGVF

SEQ ID NO: 2245 - protein, 7 aa, Artificial Sequence
  Synthetic construct
GVIYGVY

SEQ ID NO: 2246 - protein, 7 aa, Artificial Sequence
  Synthetic construct
GVIYAFF

SEQ ID NO: 2247 - protein, 7 aa, Artificial Sequence
  Synthetic construct
GVIYAFY

SEQ ID NO: 2248 - protein, 7 aa, Artificial Sequence
  Synthetic construct
GVIYARF

SEQ ID NO: 2249 - protein, 7 aa, Artificial Sequence
  Synthetic construct
GVIYARY

SEQ ID NO: 2250 - protein, 7 aa, Artificial Sequence
  Synthetic construct
GVIYACF

SEQ ID NO: 2251 - protein, 7 aa, Artificial Sequence
  Synthetic construct
GVIYACY

SEQ ID NO: 2252 - protein, 7 aa, Artificial Sequence
  Synthetic construct
GVIYALF

SEQ ID NO: 2253 - protein, 7 aa, Artificial Sequence
  Synthetic construct
GVIYALY

SEQ ID NO: 2254 - protein, 7 aa, Artificial Sequence
  Synthetic construct
GVIYAAF

SEQ ID NO: 2255 - protein, 7 aa, Artificial Sequence
  Synthetic construct
GVIYAAY

SEQ ID NO: 2256 - protein, 7 aa, Artificial Sequence
  Synthetic construct
GVIYAQF

SEQ ID NO: 2257 - protein, 7 aa, Artificial Sequence
  Synthetic construct
GVIYAQY

SEQ ID NO: 2258 - protein, 7 aa, Artificial Sequence
  Synthetic construct
GVIYADF

SEQ ID NO: 2259 - protein, 7 aa, Artificial Sequence
  Synthetic construct
GVIYADY

SEQ ID NO: 2260 - protein, 7 aa, Artificial Sequence
  Synthetic construct
GVIYAVF

SEQ ID NO: 2261 - protein, 7 aa, Artificial Sequence
  Synthetic construct
GVIYAVY

SEQ ID NO: 2262 - protein, 7 aa, Artificial Sequence
  Synthetic construct
GVIYQFF

SEQ ID NO: 2263 - protein, 7 aa, Artificial Sequence
  Synthetic construct
GVIYQFY

SEQ ID NO: 2264 - protein, 7 aa, Artificial Sequence
  Synthetic construct
GVIYQRF

SEQ ID NO: 2265 - protein, 7 aa, Artificial Sequence
  Synthetic construct
GVIYQRY

SEQ ID NO: 2266 - protein, 7 aa, Artificial Sequence
  Synthetic construct
GVIYQCF

SEQ ID NO: 2267 - protein, 7 aa, Artificial Sequence
  Synthetic construct
GVIYQCY

SEQ ID NO: 2268 - protein, 7 aa, Artificial Sequence
  Synthetic construct
GVIYQLF

SEQ ID NO: 2269 - protein, 7 aa, Artificial Sequence
  Synthetic construct
GVIYQLY

SEQ ID NO: 2270 - protein, 7 aa, Artificial Sequence
  Synthetic construct
GVIYQAF

SEQ ID NO: 2271 - protein, 7 aa, Artificial Sequence
  Synthetic construct
GVIYQAY

SEQ ID NO: 2272 - protein, 7 aa, Artificial Sequence
  Synthetic construct
GVIYQQF

SEQ ID NO: 2273 - protein, 7 aa, Artificial Sequence
  Synthetic construct
GVIYQQY

SEQ ID NO: 2274 - protein, 7 aa, Artificial Sequence
  Synthetic construct
GVIYQDF

SEQ ID NO: 2275 - protein, 7 aa, Artificial Sequence
  Synthetic construct
GVIYQDY

SEQ ID NO: 2276 - protein, 7 aa, Artificial Sequence
  Synthetic construct
GVIYQVF

SEQ ID NO: 2277 - protein, 7 aa, Artificial Sequence
  Synthetic construct
GVIYQVY

SEQ ID NO: 2278 - protein, 7 aa, Artificial Sequence
  Synthetic construct
GVIPIFF

SEQ ID NO: 2279 - protein, 7 aa, Artificial Sequence
  Synthetic construct
GVIPIFY

SEQ ID NO: 2280 - protein, 7 aa, Artificial Sequence
  Synthetic construct
GVIPIRF

SEQ ID NO: 2281 - protein, 7 aa, Artificial Sequence
  Synthetic construct
GVIPIRY

SEQ ID NO: 2282 - protein, 7 aa, Artificial Sequence
  Synthetic construct
GVIPICF

SEQ ID NO: 2283 - protein, 7 aa, Artificial Sequence
  Synthetic construct
GVIPICY

SEQ ID NO: 2284 - protein, 7 aa, Artificial Sequence
  Synthetic construct
GVIPILF

SEQ ID NO: 2285 - protein, 7 aa, Artificial Sequence
  Synthetic construct
GVIPILY

SEQ ID NO: 2286 - protein, 7 aa, Artificial Sequence
  Synthetic construct
GVIPIAF

SEQ ID NO: 2287 - protein, 7 aa, Artificial Sequence
  Synthetic construct
GVIPIAY

SEQ ID NO: 2288 - protein, 7 aa, Artificial Sequence
  Synthetic construct
GVIPIQF

SEQ ID NO: 2289 - protein, 7 aa, Artificial Sequence
  Synthetic construct
GVIPIQY

SEQ ID NO: 2290 - protein, 7 aa, Artificial Sequence
  Synthetic construct
GVIPIDF

SEQ ID NO: 2291 - protein, 7 aa, Artificial Sequence
  Synthetic construct
GVIPIDY

SEQ ID NO: 2292 - protein, 7 aa, Artificial Sequence
  Synthetic construct
GVIPIVF

SEQ ID NO: 2293 - protein, 7 aa, Artificial Sequence
  Synthetic construct
GVIPIVY

SEQ ID NO: 2294 - protein, 7 aa, Artificial Sequence
  Synthetic construct
GVIPDFF

SEQ ID NO: 2295 - protein, 7 aa, Artificial Sequence
  Synthetic construct
GVIPDFY

SEQ ID NO: 2296 - protein, 7 aa, Artificial Sequence
  Synthetic construct
GVIPDRF

SEQ ID NO: 2297 - protein, 7 aa, Artificial Sequence
  Synthetic construct
GVIPDRY

SEQ ID NO: 2298 - protein, 7 aa, Artificial Sequence
  Synthetic construct
GVIPDCF

SEQ ID NO: 2299 - protein, 7 aa, Artificial Sequence
  Synthetic construct
GVIPDCY

SEQ ID NO: 2300 - protein, 7 aa, Artificial Sequence
  Synthetic construct
GVIPDLF

SEQ ID NO: 2301 - protein, 7 aa, Artificial Sequence
  Synthetic construct
GVIPDLY

SEQ ID NO: 2302 - protein, 7 aa, Artificial Sequence
  Synthetic construct
GVIPDAF

SEQ ID NO: 2303 - protein, 7 aa, Artificial Sequence
  Synthetic construct
GVIPDAY

SEQ ID NO: 2304 - protein, 7 aa, Artificial Sequence
  Synthetic construct
GVIPDQF

SEQ ID NO: 2305 - protein, 7 aa, Artificial Sequence
  Synthetic construct
GVIPDQY

SEQ ID NO: 2306 - protein, 7 aa, Artificial Sequence
  Synthetic construct
GVIPDDF

SEQ ID NO: 2307 - protein, 7 aa, Artificial Sequence
  Synthetic construct
GVIPDDY

SEQ ID NO: 2308 - protein, 7 aa, Artificial Sequence
  Synthetic construct
GVIPDVF

SEQ ID NO: 2309 - protein, 7 aa, Artificial Sequence
  Synthetic construct
GVIPDVY

SEQ ID NO: 2310 - protein, 7 aa, Artificial Sequence
  Synthetic construct
GVIPYFF

SEQ ID NO: 2311 - protein, 7 aa, Artificial Sequence
  Synthetic construct
GVIPYFY

SEQ ID NO: 2312 - protein, 7 aa, Artificial Sequence
  Synthetic construct
GVIPYRF

SEQ ID NO: 2313 - protein, 7 aa, Artificial Sequence
  Synthetic construct
GVIPYRY

SEQ ID NO: 2314 - protein, 7 aa, Artificial Sequence
  Synthetic construct
GVIPYCF

SEQ ID NO: 2315 - protein, 7 aa, Artificial Sequence
  Synthetic construct
GVIPYCY

SEQ ID NO: 2316 - protein, 7 aa, Artificial Sequence
  Synthetic construct
GVIPYLF

SEQ ID NO: 2317 - protein, 7 aa, Artificial Sequence
  Synthetic construct
GVIPYLY

SEQ ID NO: 2318 - protein, 7 aa, Artificial Sequence
  Synthetic construct
GVIPYAF

SEQ ID NO: 2319 - protein, 7 aa, Artificial Sequence
  Synthetic construct
GVIPYAY

SEQ ID NO: 2320 - protein, 7 aa, Artificial Sequence
  Synthetic construct
GVIPYQF

SEQ ID NO: 2321 - protein, 7 aa, Artificial Sequence
  Synthetic construct
GVIPYQY

SEQ ID NO: 2322 - protein, 7 aa, Artificial Sequence
  Synthetic construct
GVIPYDF

SEQ ID NO: 2323 - protein, 7 aa, Artificial Sequence
  Synthetic construct
GVIPYDY

SEQ ID NO: 2324 - protein, 7 aa, Artificial Sequence
  Synthetic construct
GVIPYVF

SEQ ID NO: 2325 - protein, 7 aa, Artificial Sequence
  Synthetic construct
GVIPYVY

SEQ ID NO: 2326 - protein, 7 aa, Artificial Sequence
  Synthetic construct
GVIPFFF

SEQ ID NO: 2327 - protein, 7 aa, Artificial Sequence
  Synthetic construct
GVIPFFY

SEQ ID NO: 2328 - protein, 7 aa, Artificial Sequence
  Synthetic construct
GVIPFRF

SEQ ID NO: 2329 - protein, 7 aa, Artificial Sequence
  Synthetic construct
GVIPFRY

SEQ ID NO: 2330 - protein, 7 aa, Artificial Sequence
  Synthetic construct
GVIPFCF

SEQ ID NO: 2331 - protein, 7 aa, Artificial Sequence
  Synthetic construct
GVIPFCY

SEQ ID NO: 2332 - protein, 7 aa, Artificial Sequence
  Synthetic construct
GVIPFLF

SEQ ID NO: 2333 - protein, 7 aa, Artificial Sequence
  Synthetic construct
GVIPFLY

SEQ ID NO: 2334 - protein, 7 aa, Artificial Sequence
  Synthetic construct
GVIPFAF

SEQ ID NO: 2335 - protein, 7 aa, Artificial Sequence
  Synthetic construct
GVIPFAY

SEQ ID NO: 2336 - protein, 7 aa, Artificial Sequence
  Synthetic construct
GVIPFQF

SEQ ID NO: 2337 - protein, 7 aa, Artificial Sequence
  Synthetic construct
GVIPFQY

SEQ ID NO: 2338 - protein, 7 aa, Artificial Sequence
  Synthetic construct
GVIPFDF

SEQ ID NO: 2339 - protein, 7 aa, Artificial Sequence
  Synthetic construct
GVIPFDY

SEQ ID NO: 2340 - protein, 7 aa, Artificial Sequence
  Synthetic construct
GVIPFVF

SEQ ID NO: 2341 - protein, 7 aa, Artificial Sequence
  Synthetic construct
GVIPFVY

SEQ ID NO: 2342 - protein, 7 aa, Artificial Sequence
  Synthetic construct
GVIPVFF

SEQ ID NO: 2343 - protein, 7 aa, Artificial Sequence
  Synthetic construct
GVIPVFY

SEQ ID NO: 2344 - protein, 7 aa, Artificial Sequence
  Synthetic construct
GVIPVRF

SEQ ID NO: 2345 - protein, 7 aa, Artificial Sequence
  Synthetic construct
GVIPVRY

SEQ ID NO: 2346 - protein, 7 aa, Artificial Sequence
  Synthetic construct
GVIPVCF

SEQ ID NO: 2347 - protein, 7 aa, Artificial Sequence
  Synthetic construct
GVIPVCY

SEQ ID NO: 2348 - protein, 7 aa, Artificial Sequence
  Synthetic construct
GVIPVLF

SEQ ID NO: 2349 - protein, 7 aa, Artificial Sequence
  Synthetic construct
GVIPVLY

SEQ ID NO: 2350 - protein, 7 aa, Artificial Sequence
  Synthetic construct
GVIPVAF

SEQ ID NO: 2351 - protein, 7 aa, Artificial Sequence
  Synthetic construct
GVIPVAY

SEQ ID NO: 2352 - protein, 7 aa, Artificial Sequence
  Synthetic construct
GVIPVQF

SEQ ID NO: 2353 - protein, 7 aa, Artificial Sequence
  Synthetic construct
GVIPVQY

SEQ ID NO: 2354 - protein, 7 aa, Artificial Sequence
  Synthetic construct
GVIPVDF

SEQ ID NO: 2355 - protein, 7 aa, Artificial Sequence
  Synthetic construct
GVIPVDY

SEQ ID NO: 2356 - protein, 7 aa, Artificial Sequence
  Synthetic construct
GVIPVVF

SEQ ID NO: 2357 - protein, 7 aa, Artificial Sequence
  Synthetic construct
GVIPVVY

SEQ ID NO: 2358 - protein, 7 aa, Artificial Sequence
  Synthetic construct
GVIPTFF

SEQ ID NO: 2359 - protein, 7 aa, Artificial Sequence
  Synthetic construct
GVIPTFY

SEQ ID NO: 2360 - protein, 7 aa, Artificial Sequence
  Synthetic construct
GVIPTRF

SEQ ID NO: 2361 - protein, 7 aa, Artificial Sequence
  Synthetic construct
GVIPTRY

SEQ ID NO: 2362 - protein, 7 aa, Artificial Sequence
  Synthetic construct
GVIPTCF

SEQ ID NO: 2363 - protein, 7 aa, Artificial Sequence
  Synthetic construct
GVIPTCY

SEQ ID NO: 2364 - protein, 7 aa, Artificial Sequence
  Synthetic construct
GVIPTLF

SEQ ID NO: 2365 - protein, 7 aa, Artificial Sequence
  Synthetic construct
GVIPTLY

SEQ ID NO: 2366 - protein, 7 aa, Artificial Sequence
  Synthetic construct
GVIPTAF

SEQ ID NO: 2367 - protein, 7 aa, Artificial Sequence
  Synthetic construct
GVIPTAY

SEQ ID NO: 2368 - protein, 7 aa, Artificial Sequence
  Synthetic construct
GVIPTQF

SEQ ID NO: 2369 - protein, 7 aa, Artificial Sequence
  Synthetic construct
GVIPTQY

SEQ ID NO: 2370 - protein, 7 aa, Artificial Sequence
  Synthetic construct
GVIPTDF

SEQ ID NO: 2371 - protein, 7 aa, Artificial Sequence
  Synthetic construct
GVIPTDY

SEQ ID NO: 2372 - protein, 7 aa, Artificial Sequence
  Synthetic construct
GVIPTVF

SEQ ID NO: 2373 - protein, 7 aa, Artificial Sequence
  Synthetic construct
GVIPTVY

SEQ ID NO: 2374 - protein, 7 aa, Artificial Sequence
  Synthetic construct
GVIPGFF

SEQ ID NO: 2375 - protein, 7 aa, Artificial Sequence
  Synthetic construct
GVIPGFY

SEQ ID NO: 2376 - protein, 7 aa, Artificial Sequence
  Synthetic construct
GVIPGRF

SEQ ID NO: 2377 - protein, 7 aa, Artificial Sequence
  Synthetic construct
GVIPGRY

SEQ ID NO: 2378 - protein, 7 aa, Artificial Sequence
  Synthetic construct
GVIPGCF

SEQ ID NO: 2379 - protein, 7 aa, Artificial Sequence
  Synthetic construct
GVIPGCY

SEQ ID NO: 2380 - protein, 7 aa, Artificial Sequence
  Synthetic construct
GVIPGLF

SEQ ID NO: 2381 - protein, 7 aa, Artificial Sequence
  Synthetic construct
GVIPGLY

SEQ ID NO: 2382 - protein, 7 aa, Artificial Sequence
  Synthetic construct
GVIPGAF

SEQ ID NO: 2383 - protein, 7 aa, Artificial Sequence
  Synthetic construct
GVIPGAY

SEQ ID NO: 2384 - protein, 7 aa, Artificial Sequence
  Synthetic construct
GVIPGQF

SEQ ID NO: 2385 - protein, 7 aa, Artificial Sequence
  Synthetic construct
GVIPGQY

SEQ ID NO: 2386 - protein, 7 aa, Artificial Sequence
  Synthetic construct
GVIPGDF

SEQ ID NO: 2387 - protein, 7 aa, Artificial Sequence
  Synthetic construct
GVIPGDY

SEQ ID NO: 2388 - protein, 7 aa, Artificial Sequence
  Synthetic construct
GVIPGVF

SEQ ID NO: 2389 - protein, 7 aa, Artificial Sequence
  Synthetic construct
GVIPGVY

SEQ ID NO: 2390 - protein, 7 aa, Artificial Sequence
  Synthetic construct
GVIPAFF

SEQ ID NO: 2391 - protein, 7 aa, Artificial Sequence
  Synthetic construct
GVIPAFY

SEQ ID NO: 2392 - protein, 7 aa, Artificial Sequence
  Synthetic construct
GVIPARF

SEQ ID NO: 2393 - protein, 7 aa, Artificial Sequence
  Synthetic construct
GVIPARY

SEQ ID NO: 2394 - protein, 7 aa, Artificial Sequence
  Synthetic construct
GVIPACF

SEQ ID NO: 2395 - protein, 7 aa, Artificial Sequence
  Synthetic construct
GVIPACY

SEQ ID NO: 2396 - protein, 7 aa, Artificial Sequence
  Synthetic construct
GVIPALF

SEQ ID NO: 2397 - protein, 7 aa, Artificial Sequence
  Synthetic construct
GVIPALY

SEQ ID NO: 2398 - protein, 7 aa, Artificial Sequence
  Synthetic construct
GVIPAAF

SEQ ID NO: 2399 - protein, 7 aa, Artificial Sequence
  Synthetic construct
GVIPAAY

SEQ ID NO: 2400 - protein, 7 aa, Artificial Sequence
  Synthetic construct
GVIPAQF

SEQ ID NO: 2401 - protein, 7 aa, Artificial Sequence
  Synthetic construct
GVIPAQY

SEQ ID NO: 2402 - protein, 7 aa, Artificial Sequence
  Synthetic construct
GVIPADF

SEQ ID NO: 2403 - protein, 7 aa, Artificial Sequence
  Synthetic construct
GVIPADY

SEQ ID NO: 2404 - protein, 7 aa, Artificial Sequence
  Synthetic construct
GVIPAVF

SEQ ID NO: 2405 - protein, 7 aa, Artificial Sequence
  Synthetic construct
GVIPAVY

SEQ ID NO: 2406 - protein, 7 aa, Artificial Sequence
  Synthetic construct
GVIPQFF

SEQ ID NO: 2407 - protein, 7 aa, Artificial Sequence
  Synthetic construct
GVIPQFY

SEQ ID NO: 2408 - protein, 7 aa, Artificial Sequence
  Synthetic construct
GVIPQRF

SEQ ID NO: 2409 - protein, 7 aa, Artificial Sequence
  Synthetic construct
GVIPQRY

SEQ ID NO: 2410 - protein, 7 aa, Artificial Sequence
  Synthetic construct
GVIPQCF

SEQ ID NO: 2411 - protein, 7 aa, Artificial Sequence
  Synthetic construct
GVIPQCY

SEQ ID NO: 2412 - protein, 7 aa, Artificial Sequence
  Synthetic construct
GVIPQLF

SEQ ID NO: 2413 - protein, 7 aa, Artificial Sequence
  Synthetic construct
GVIPQLY

SEQ ID NO: 2414 - protein, 7 aa, Artificial Sequence
  Synthetic construct
GVIPQAF

SEQ ID NO: 2415 - protein, 7 aa, Artificial Sequence
  Synthetic construct
GVIPQAY

SEQ ID NO: 2416 - protein, 7 aa, Artificial Sequence
  Synthetic construct
GVIPQQF

SEQ ID NO: 2417 - protein, 7 aa, Artificial Sequence
  Synthetic construct
GVIPQQY

SEQ ID NO: 2418 - protein, 7 aa, Artificial Sequence
  Synthetic construct
GVIPQDF

SEQ ID NO: 2419 - protein, 7 aa, Artificial Sequence
  Synthetic construct
GVIPQDY

SEQ ID NO: 2420 - protein, 7 aa, Artificial Sequence
  Synthetic construct
GVIPQVF

SEQ ID NO: 2421 - protein, 7 aa, Artificial Sequence
  Synthetic construct
GVIPQVY

SEQ ID NO: 2422 - protein, 7 aa, Artificial Sequence
  Synthetic construct
GVIHIFF

SEQ ID NO: 2423 - protein, 7 aa, Artificial Sequence
  Synthetic construct
GVIHIFY

SEQ ID NO: 2424 - protein, 7 aa, Artificial Sequence
  Synthetic construct
GVIHIRF

SEQ ID NO: 2425 - protein, 7 aa, Artificial Sequence
  Synthetic construct
GVIHIRY

SEQ ID NO: 2426 - protein, 7 aa, Artificial Sequence
  Synthetic construct
GVIHICF

SEQ ID NO: 2427 - protein, 7 aa, Artificial Sequence
  Synthetic construct
GVIHICY

SEQ ID NO: 2428 - protein, 7 aa, Artificial Sequence
  Synthetic construct
GVIHILF

SEQ ID NO: 2429 - protein, 7 aa, Artificial Sequence
  Synthetic construct
GVIHILY

SEQ ID NO: 2430 - protein, 7 aa, Artificial Sequence
  Synthetic construct
GVIHIAF

SEQ ID NO: 2431 - protein, 7 aa, Artificial Sequence
  Synthetic construct
GVIHIAY

SEQ ID NO: 2432 - protein, 7 aa, Artificial Sequence
  Synthetic construct
GVIHIQF

SEQ ID NO: 2433 - protein, 7 aa, Artificial Sequence
  Synthetic construct
GVIHIQY

SEQ ID NO: 2434 - protein, 7 aa, Artificial Sequence
  Synthetic construct
GVIHIDF

SEQ ID NO: 2435 - protein, 7 aa, Artificial Sequence
  Synthetic construct
GVIHIDY

SEQ ID NO: 2436 - protein, 7 aa, Artificial Sequence
  Synthetic construct
GVIHIVF

SEQ ID NO: 2437 - protein, 7 aa, Artificial Sequence
  Synthetic construct
GVIHIVY

SEQ ID NO: 2438 - protein, 7 aa, Artificial Sequence
  Synthetic construct
GVIHDFF

SEQ ID NO: 2439 - protein, 7 aa, Artificial Sequence
  Synthetic construct
GVIHDFY

SEQ ID NO: 2440 - protein, 7 aa, Artificial Sequence
  Synthetic construct
GVIHDRF

SEQ ID NO: 2441 - protein, 7 aa, Artificial Sequence
  Synthetic construct
GVIHDRY

SEQ ID NO: 2442 - protein, 7 aa, Artificial Sequence
  Synthetic construct
GVIHDCF

SEQ ID NO: 2443 - protein, 7 aa, Artificial Sequence
  Synthetic construct
GVIHDCY

SEQ ID NO: 2444 - protein, 7 aa, Artificial Sequence
  Synthetic construct
GVIHDLF

SEQ ID NO: 2445 - protein, 7 aa, Artificial Sequence
  Synthetic construct
GVIHDLY

SEQ ID NO: 2446 - protein, 7 aa, Artificial Sequence
  Synthetic construct
GVIHDAF

SEQ ID NO: 2447 - protein, 7 aa, Artificial Sequence
  Synthetic construct
GVIHDAY

SEQ ID NO: 2448 - protein, 7 aa, Artificial Sequence
  Synthetic construct
GVIHDQF

SEQ ID NO: 2449 - protein, 7 aa, Artificial Sequence
  Synthetic construct
GVIHDQY

SEQ ID NO: 2450 - protein, 7 aa, Artificial Sequence
  Synthetic construct
GVIHDDF

SEQ ID NO: 2451 - protein, 7 aa, Artificial Sequence
  Synthetic construct
GVIHDDY

SEQ ID NO: 2452 - protein, 7 aa, Artificial Sequence
  Synthetic construct
GVIHDVF

SEQ ID NO: 2453 - protein, 7 aa, Artificial Sequence
  Synthetic construct
GVIHDVY

SEQ ID NO: 2454 - protein, 7 aa, Artificial Sequence
  Synthetic construct
GVIHYFF

SEQ ID NO: 2455 - protein, 7 aa, Artificial Sequence
  Synthetic construct
GVIHYFY

SEQ ID NO: 2456 - protein, 7 aa, Artificial Sequence
  Synthetic construct
GVIHYRF

SEQ ID NO: 2457 - protein, 7 aa, Artificial Sequence
  Synthetic construct
GVIHYRY

SEQ ID NO: 2458 - protein, 7 aa, Artificial Sequence
  Synthetic construct
GVIHYCF

SEQ ID NO: 2459 - protein, 7 aa, Artificial Sequence
  Synthetic construct
GVIHYCY

SEQ ID NO: 2460 - protein, 7 aa, Artificial Sequence
  Synthetic construct
GVIHYLF

SEQ ID NO: 2461 - protein, 7 aa, Artificial Sequence
  Synthetic construct
GVIHYLY

SEQ ID NO: 2462 - protein, 7 aa, Artificial Sequence
  Synthetic construct
GVIHYAF

SEQ ID NO: 2463 - protein, 7 aa, Artificial Sequence
  Synthetic construct
GVIHYAY

SEQ ID NO: 2464 - protein, 7 aa, Artificial Sequence
  Synthetic construct
GVIHYQF

SEQ ID NO: 2465 - protein, 7 aa, Artificial Sequence
  Synthetic construct
GVIHYQY

SEQ ID NO: 2466 - protein, 7 aa, Artificial Sequence
  Synthetic construct
GVIHYDF

SEQ ID NO: 2467 - protein, 7 aa, Artificial Sequence
  Synthetic construct
GVIHYDY

SEQ ID NO: 2468 - protein, 7 aa, Artificial Sequence
  Synthetic construct
GVIHYVF

SEQ ID NO: 2469 - protein, 7 aa, Artificial Sequence
  Synthetic construct
GVIHYVY

SEQ ID NO: 2470 - protein, 7 aa, Artificial Sequence
  Synthetic construct
GVIHFFF

SEQ ID NO: 2471 - protein, 7 aa, Artificial Sequence
  Synthetic construct
GVIHFFY

SEQ ID NO: 2472 - protein, 7 aa, Artificial Sequence
  Synthetic construct
GVIHFRF

SEQ ID NO: 2473 - protein, 7 aa, Artificial Sequence
  Synthetic construct
GVIHFRY

SEQ ID NO: 2474 - protein, 7 aa, Artificial Sequence
  Synthetic construct
GVIHFCF

SEQ ID NO: 2475 - protein, 7 aa, Artificial Sequence
  Synthetic construct
GVIHFCY

SEQ ID NO: 2476 - protein, 7 aa, Artificial Sequence
  Synthetic construct
GVIHFLF

SEQ ID NO: 2477 - protein, 7 aa, Artificial Sequence
  Synthetic construct
GVIHFLY

SEQ ID NO: 2478 - protein, 7 aa, Artificial Sequence
  Synthetic construct
GVIHFAF

SEQ ID NO: 2479 - protein, 7 aa, Artificial Sequence
  Synthetic construct
GVIHFAY

SEQ ID NO: 2480 - protein, 7 aa, Artificial Sequence
  Synthetic construct
GVIHFQF

SEQ ID NO: 2481 - protein, 7 aa, Artificial Sequence
  Synthetic construct
GVIHFQY

SEQ ID NO: 2482 - protein, 7 aa, Artificial Sequence
  Synthetic construct
GVIHFDF

SEQ ID NO: 2483 - protein, 7 aa, Artificial Sequence
  Synthetic construct
GVIHFDY

SEQ ID NO: 2484 - protein, 7 aa, Artificial Sequence
  Synthetic construct
GVIHFVF

SEQ ID NO: 2485 - protein, 7 aa, Artificial Sequence
  Synthetic construct
GVIHFVY

SEQ ID NO: 2486 - protein, 7 aa, Artificial Sequence
  Synthetic construct
GVIHVFF

SEQ ID NO: 2487 - protein, 7 aa, Artificial Sequence
  Synthetic construct
GVIHVFY

SEQ ID NO: 2488 - protein, 7 aa, Artificial Sequence
  Synthetic construct
GVIHVRF

SEQ ID NO: 2489 - protein, 7 aa, Artificial Sequence
  Synthetic construct
GVIHVRY

SEQ ID NO: 2490 - protein, 7 aa, Artificial Sequence
  Synthetic construct
GVIHVCF

SEQ ID NO: 2491 - protein, 7 aa, Artificial Sequence
  Synthetic construct
GVIHVCY

SEQ ID NO: 2492 - protein, 7 aa, Artificial Sequence
  Synthetic construct
GVIHVLF

SEQ ID NO: 2493 - protein, 7 aa, Artificial Sequence
  Synthetic construct
GVIHVLY

SEQ ID NO: 2494 - protein, 7 aa, Artificial Sequence
  Synthetic construct
GVIHVAF

SEQ ID NO: 2495 - protein, 7 aa, Artificial Sequence
  Synthetic construct
GVIHVAY

SEQ ID NO: 2496 - protein, 7 aa, Artificial Sequence
  Synthetic construct
GVIHVQF

SEQ ID NO: 2497 - protein, 7 aa, Artificial Sequence
  Synthetic construct
GVIHVQY

SEQ ID NO: 2498 - protein, 7 aa, Artificial Sequence
  Synthetic construct
GVIHVDF

SEQ ID NO: 2499 - protein, 7 aa, Artificial Sequence
  Synthetic construct
GVIHVDY

SEQ ID NO: 2500 - protein, 7 aa, Artificial Sequence
  Synthetic construct
GVIHVVF

SEQ ID NO: 2501 - protein, 7 aa, Artificial Sequence
  Synthetic construct
GVIHVVY

SEQ ID NO: 2502 - protein, 7 aa, Artificial Sequence
  Synthetic construct
GVIHTFF

SEQ ID NO: 2503 - protein, 7 aa, Artificial Sequence
  Synthetic construct
GVIHTFY

SEQ ID NO: 2504 - protein, 7 aa, Artificial Sequence
  Synthetic construct
GVIHTRF

SEQ ID NO: 2505 - protein, 7 aa, Artificial Sequence
  Synthetic construct
GVIHTRY

SEQ ID NO: 2506 - protein, 7 aa, Artificial Sequence
  Synthetic construct
GVIHTCF

SEQ ID NO: 2507 - protein, 7 aa, Artificial Sequence
  Synthetic construct
GVIHTCY

SEQ ID NO: 2508 - protein, 7 aa, Artificial Sequence
  Synthetic construct
GVIHTLF

SEQ ID NO: 2509 - protein, 7 aa, Artificial Sequence
  Synthetic construct
GVIHTLY

SEQ ID NO: 2510 - protein, 7 aa, Artificial Sequence
  Synthetic construct
GVIHTAF

SEQ ID NO: 2511 - protein, 7 aa, Artificial Sequence
  Synthetic construct
GVIHTAY

SEQ ID NO: 2512 - protein, 7 aa, Artificial Sequence
  Synthetic construct
GVIHTQF

SEQ ID NO: 2513 - protein, 7 aa, Artificial Sequence
  Synthetic construct
GVIHTQY

SEQ ID NO: 2514 - protein, 7 aa, Artificial Sequence
  Synthetic construct
GVIHTDF

SEQ ID NO: 2515 - protein, 7 aa, Artificial Sequence
  Synthetic construct
GVIHTDY

SEQ ID NO: 2516 - protein, 7 aa, Artificial Sequence
  Synthetic construct
GVIHTVF

SEQ ID NO: 2517 - protein, 7 aa, Artificial Sequence
  Synthetic construct
GVIHTVY

SEQ ID NO: 2518 - protein, 7 aa, Artificial Sequence
  Synthetic construct
GVIHGFF

SEQ ID NO: 2519 - protein, 7 aa, Artificial Sequence
  Synthetic construct
GVIHGFY

SEQ ID NO: 2520 - protein, 7 aa, Artificial Sequence
  Synthetic construct
GVIHGRF

SEQ ID NO: 2521 - protein, 7 aa, Artificial Sequence
  Synthetic construct
GVIHGRY

SEQ ID NO: 2522 - protein, 7 aa, Artificial Sequence
  Synthetic construct
GVIHGCF

SEQ ID NO: 2523 - protein, 7 aa, Artificial Sequence
  Synthetic construct
GVIHGCY

SEQ ID NO: 2524 - protein, 7 aa, Artificial Sequence
  Synthetic construct
GVIHGLF

SEQ ID NO: 2525 - protein, 7 aa, Artificial Sequence
  Synthetic construct
GVIHGLY

SEQ ID NO: 2526 - protein, 7 aa, Artificial Sequence
  Synthetic construct
GVIHGAF

SEQ ID NO: 2527 - protein, 7 aa, Artificial Sequence
  Synthetic construct
GVIHGAY

SEQ ID NO: 2528 - protein, 7 aa, Artificial Sequence
  Synthetic construct
GVIHGQF

SEQ ID NO: 2529 - protein, 7 aa, Artificial Sequence
  Synthetic construct
GVIHGQY

SEQ ID NO: 2530 - protein, 7 aa, Artificial Sequence
  Synthetic construct
GVIHGDF

SEQ ID NO: 2531 - protein, 7 aa, Artificial Sequence
  Synthetic construct
GVIHGDY

SEQ ID NO: 2532 - protein, 7 aa, Artificial Sequence
  Synthetic construct
GVIHGVF

SEQ ID NO: 2533 - protein, 7 aa, Artificial Sequence
  Synthetic construct
GVIHGVY

SEQ ID NO: 2534 - protein, 7 aa, Artificial Sequence
  Synthetic construct
GVIHAFF

SEQ ID NO: 2535 - protein, 7 aa, Artificial Sequence
  Synthetic construct
GVIHAFY

SEQ ID NO: 2536 - protein, 7 aa, Artificial Sequence
  Synthetic construct
GVIHARF

SEQ ID NO: 2537 - protein, 7 aa, Artificial Sequence
  Synthetic construct
GVIHARY

SEQ ID NO: 2538 - protein, 7 aa, Artificial Sequence
  Synthetic construct
GVIHACF

SEQ ID NO: 2539 - protein, 7 aa, Artificial Sequence
  Synthetic construct
GVIHACY

SEQ ID NO: 2540 - protein, 7 aa, Artificial Sequence
  Synthetic construct
GVIHALF

SEQ ID NO: 2541 - protein, 7 aa, Artificial Sequence
  Synthetic construct
GVIHALY

SEQ ID NO: 2542 - protein, 7 aa, Artificial Sequence
  Synthetic construct
GVIHAAF

SEQ ID NO: 2543 - protein, 7 aa, Artificial Sequence
  Synthetic construct
GVIHAAY

SEQ ID NO: 2544 - protein, 7 aa, Artificial Sequence
  Synthetic construct
GVIHAQF

SEQ ID NO: 2545 - protein, 7 aa, Artificial Sequence
  Synthetic construct
GVIHAQY

SEQ ID NO: 2546 - protein, 7 aa, Artificial Sequence
  Synthetic construct
GVIHADF

SEQ ID NO: 2547 - protein, 7 aa, Artificial Sequence
  Synthetic construct
GVIHADY

SEQ ID NO: 2548 - protein, 7 aa, Artificial Sequence
  Synthetic construct
GVIHAVF

SEQ ID NO: 2549 - protein, 7 aa, Artificial Sequence
  Synthetic construct
GVIHAVY

SEQ ID NO: 2550 - protein, 7 aa, Artificial Sequence
  Synthetic construct
GVIHQFF

SEQ ID NO: 2551 - protein, 7 aa, Artificial Sequence
  Synthetic construct
GVIHQFY

SEQ ID NO: 2552 - protein, 7 aa, Artificial Sequence
  Synthetic construct
GVIHQRF

SEQ ID NO: 2553 - protein, 7 aa, Artificial Sequence
  Synthetic construct
GVIHQRY

SEQ ID NO: 2554 - protein, 7 aa, Artificial Sequence
  Synthetic construct
GVIHQCF

SEQ ID NO: 2555 - protein, 7 aa, Artificial Sequence
  Synthetic construct
GVIHQCY

SEQ ID NO: 2556 - protein, 7 aa, Artificial Sequence
  Synthetic construct
GVIHQLF

SEQ ID NO: 2557 - protein, 7 aa, Artificial Sequence
  Synthetic construct
GVIHQLY

SEQ ID NO: 2558 - protein, 7 aa, Artificial Sequence
  Synthetic construct
GVIHQAF

SEQ ID NO: 2559 - protein, 7 aa, Artificial Sequence
  Synthetic construct
GVIHQAY

SEQ ID NO: 2560 - protein, 7 aa, Artificial Sequence
  Synthetic construct
GVIHQQF

SEQ ID NO: 2561 - protein, 7 aa, Artificial Sequence
  Synthetic construct
GVIHQQY

SEQ ID NO: 2562 - protein, 7 aa, Artificial Sequence
  Synthetic construct
GVIHQDF

SEQ ID NO: 2563 - protein, 7 aa, Artificial Sequence
  Synthetic construct
GVIHQDY

SEQ ID NO: 2564 - protein, 7 aa, Artificial Sequence
  Synthetic construct
GVIHQVF

SEQ ID NO: 2565 - protein, 7 aa, Artificial Sequence
  Synthetic construct
GVIHQVY

SEQ ID NO: 2566 - protein, 7 aa, Artificial Sequence
  Synthetic construct
GVILIFF

SEQ ID NO: 2567 - protein, 7 aa, Artificial Sequence
  Synthetic construct
GVILIFY

SEQ ID NO: 2568 - protein, 7 aa, Artificial Sequence
  Synthetic construct
GVILIRF

SEQ ID NO: 2569 - protein, 7 aa, Artificial Sequence
  Synthetic construct
GVILIRY

SEQ ID NO: 2570 - protein, 7 aa, Artificial Sequence
  Synthetic construct
GVILICF

SEQ ID NO: 2571 - protein, 7 aa, Artificial Sequence
  Synthetic construct
GVILICY

SEQ ID NO: 2572 - protein, 7 aa, Artificial Sequence
  Synthetic construct
GVILILF

SEQ ID NO: 2573 - protein, 7 aa, Artificial Sequence
  Synthetic construct
GVILILY

SEQ ID NO: 2574 - protein, 7 aa, Artificial Sequence
  Synthetic construct
GVILIAF

SEQ ID NO: 2575 - protein, 7 aa, Artificial Sequence
  Synthetic construct
GVILIAY

SEQ ID NO: 2576 - protein, 7 aa, Artificial Sequence
  Synthetic construct
GVILIQF

SEQ ID NO: 2577 - protein, 7 aa, Artificial Sequence
  Synthetic construct
GVILIQY

SEQ ID NO: 2578 - protein, 7 aa, Artificial Sequence
  Synthetic construct
GVILIDF

SEQ ID NO: 2579 - protein, 7 aa, Artificial Sequence
  Synthetic construct
GVILIDY

SEQ ID NO: 2580 - protein, 7 aa, Artificial Sequence
  Synthetic construct
GVILIVF

SEQ ID NO: 2581 - protein, 7 aa, Artificial Sequence
  Synthetic construct
GVILIVY

SEQ ID NO: 2582 - protein, 7 aa, Artificial Sequence
  Synthetic construct
GVILDFF

SEQ ID NO: 2583 - protein, 7 aa, Artificial Sequence
  Synthetic construct
GVILDFY

SEQ ID NO: 2584 - protein, 7 aa, Artificial Sequence
  Synthetic construct
GVILDRF

SEQ ID NO: 2585 - protein, 7 aa, Artificial Sequence
  Synthetic construct
GVILDRY

SEQ ID NO: 2586 - protein, 7 aa, Artificial Sequence
  Synthetic construct
GVILDCF

SEQ ID NO: 2587 - protein, 7 aa, Artificial Sequence
  Synthetic construct
GVILDCY

SEQ ID NO: 2588 - protein, 7 aa, Artificial Sequence
  Synthetic construct
GVILDLF

SEQ ID NO: 2589 - protein, 7 aa, Artificial Sequence
  Synthetic construct
GVILDLY

SEQ ID NO: 2590 - protein, 7 aa, Artificial Sequence
  Synthetic construct
GVILDAF

SEQ ID NO: 2591 - protein, 7 aa, Artificial Sequence
  Synthetic construct
GVILDAY

SEQ ID NO: 2592 - protein, 7 aa, Artificial Sequence
  Synthetic construct
GVILDQF

SEQ ID NO: 2593 - protein, 7 aa, Artificial Sequence
  Synthetic construct
GVILDQY

SEQ ID NO: 2594 - protein, 7 aa, Artificial Sequence
  Synthetic construct
GVILDDF

SEQ ID NO: 2595 - protein, 7 aa, Artificial Sequence
  Synthetic construct
GVILDDY

SEQ ID NO: 2596 - protein, 7 aa, Artificial Sequence
  Synthetic construct
GVILDVF

SEQ ID NO: 2597 - protein, 7 aa, Artificial Sequence
  Synthetic construct
GVILDVY

SEQ ID NO: 2598 - protein, 7 aa, Artificial Sequence
  Synthetic construct
GVILYFF

SEQ ID NO: 2599 - protein, 7 aa, Artificial Sequence
  Synthetic construct
GVILYFY

SEQ ID NO: 2600 - protein, 7 aa, Artificial Sequence
  Synthetic construct
GVILYRF

SEQ ID NO: 2601 - protein, 7 aa, Artificial Sequence
  Synthetic construct
GVILYRY

SEQ ID NO: 2602 - protein, 7 aa, Artificial Sequence
  Synthetic construct
GVILYCF

SEQ ID NO: 2603 - protein, 7 aa, Artificial Sequence
  Synthetic construct
GVILYCY

SEQ ID NO: 2604 - protein, 7 aa, Artificial Sequence
  Synthetic construct
GVILYLF

SEQ ID NO: 2605 - protein, 7 aa, Artificial Sequence
  Synthetic construct
GVILYLY

SEQ ID NO: 2606 - protein, 7 aa, Artificial Sequence
  Synthetic construct
GVILYAF

SEQ ID NO: 2607 - protein, 7 aa, Artificial Sequence
  Synthetic construct
GVILYAY

SEQ ID NO: 2608 - protein, 7 aa, Artificial Sequence
  Synthetic construct
GVILYQF

SEQ ID NO: 2609 - protein, 7 aa, Artificial Sequence
  Synthetic construct
GVILYQY

SEQ ID NO: 2610 - protein, 7 aa, Artificial Sequence
  Synthetic construct
GVILYDF

SEQ ID NO: 2611 - protein, 7 aa, Artificial Sequence
  Synthetic construct
GVILYDY

SEQ ID NO: 2612 - protein, 7 aa, Artificial Sequence
  Synthetic construct
GVILYVF

SEQ ID NO: 2613 - protein, 7 aa, Artificial Sequence
  Synthetic construct
GVILYVY

SEQ ID NO: 2614 - protein, 7 aa, Artificial Sequence
  Synthetic construct
GVILFFF

SEQ ID NO: 2615 - protein, 7 aa, Artificial Sequence
  Synthetic construct
GVILFFY

SEQ ID NO: 2616 - protein, 7 aa, Artificial Sequence
  Synthetic construct
GVILFRF

SEQ ID NO: 2617 - protein, 7 aa, Artificial Sequence
  Synthetic construct
GVILFRY

SEQ ID NO: 2618 - protein, 7 aa, Artificial Sequence
  Synthetic construct
GVILFCF

SEQ ID NO: 2619 - protein, 7 aa, Artificial Sequence
  Synthetic construct
GVILFCY

SEQ ID NO: 2620 - protein, 7 aa, Artificial Sequence
  Synthetic construct
GVILFLF

SEQ ID NO: 2621 - protein, 7 aa, Artificial Sequence
  Synthetic construct
GVILFLY

SEQ ID NO: 2622 - protein, 7 aa, Artificial Sequence
  Synthetic construct
GVILFAF

SEQ ID NO: 2623 - protein, 7 aa, Artificial Sequence
  Synthetic construct
GVILFAY

SEQ ID NO: 2624 - protein, 7 aa, Artificial Sequence
  Synthetic construct
GVILFQF

SEQ ID NO: 2625 - protein, 7 aa, Artificial Sequence
  Synthetic construct
GVILFQY

SEQ ID NO: 2626 - protein, 7 aa, Artificial Sequence
  Synthetic construct
GVILFDF

SEQ ID NO: 2627 - protein, 7 aa, Artificial Sequence
  Synthetic construct
GVILFDY

SEQ ID NO: 2628 - protein, 7 aa, Artificial Sequence
  Synthetic construct
GVILFVF

SEQ ID NO: 2629 - protein, 7 aa, Artificial Sequence
  Synthetic construct
GVILFVY

SEQ ID NO: 2630 - protein, 7 aa, Artificial Sequence
  Synthetic construct
GVILVFF

SEQ ID NO: 2631 - protein, 7 aa, Artificial Sequence
  Synthetic construct
GVILVFY

SEQ ID NO: 2632 - protein, 7 aa, Artificial Sequence
  Synthetic construct
GVILVRF

SEQ ID NO: 2633 - protein, 7 aa, Artificial Sequence
  Synthetic construct
GVILVRY

SEQ ID NO: 2634 - protein, 7 aa, Artificial Sequence
  Synthetic construct
GVILVCF

SEQ ID NO: 2635 - protein, 7 aa, Artificial Sequence
  Synthetic construct
GVILVCY

SEQ ID NO: 2636 - protein, 7 aa, Artificial Sequence
  Synthetic construct
GVILVLF

SEQ ID NO: 2637 - protein, 7 aa, Artificial Sequence
  Synthetic construct
GVILVLY

SEQ ID NO: 2638 - protein, 7 aa, Artificial Sequence
  Synthetic construct
GVILVAF

SEQ ID NO: 2639 - protein, 7 aa, Artificial Sequence
  Synthetic construct
GVILVAY

SEQ ID NO: 2640 - protein, 7 aa, Artificial Sequence
  Synthetic construct
GVILVQF

SEQ ID NO: 2641 - protein, 7 aa, Artificial Sequence
  Synthetic construct
GVILVQY

SEQ ID NO: 2642 - protein, 7 aa, Artificial Sequence
  Synthetic construct
GVILVDF

SEQ ID NO: 2643 - protein, 7 aa, Artificial Sequence
  Synthetic construct
GVILVDY

SEQ ID NO: 2644 - protein, 7 aa, Artificial Sequence
  Synthetic construct
GVILVVF

SEQ ID NO: 2645 - protein, 7 aa, Artificial Sequence
  Synthetic construct
GVILVVY

SEQ ID NO: 2646 - protein, 7 aa, Artificial Sequence
  Synthetic construct
GVILTFF

SEQ ID NO: 2647 - protein, 7 aa, Artificial Sequence
  Synthetic construct
GVILTFY

SEQ ID NO: 2648 - protein, 7 aa, Artificial Sequence
  Synthetic construct
GVILTRF

SEQ ID NO: 2649 - protein, 7 aa, Artificial Sequence
  Synthetic construct
GVILTRY

SEQ ID NO: 2650 - protein, 7 aa, Artificial Sequence
  Synthetic construct
GVILTCF

SEQ ID NO: 2651 - protein, 7 aa, Artificial Sequence
  Synthetic construct
GVILTCY

SEQ ID NO: 2652 - protein, 7 aa, Artificial Sequence
  Synthetic construct
GVILTLF

SEQ ID NO: 2653 - protein, 7 aa, Artificial Sequence
  Synthetic construct
GVILTLY

SEQ ID NO: 2654 - protein, 7 aa, Artificial Sequence
  Synthetic construct
GVILTAF

SEQ ID NO: 2655 - protein, 7 aa, Artificial Sequence
  Synthetic construct
GVILTAY

SEQ ID NO: 2656 - protein, 7 aa, Artificial Sequence
  Synthetic construct
GVILTQF

SEQ ID NO: 2657 - protein, 7 aa, Artificial Sequence
  Synthetic construct
GVILTQY

SEQ ID NO: 2658 - protein, 7 aa, Artificial Sequence
  Synthetic construct
GVILTDF

SEQ ID NO: 2659 - protein, 7 aa, Artificial Sequence
  Synthetic construct
GVILTDY

SEQ ID NO: 2660 - protein, 7 aa, Artificial Sequence
  Synthetic construct
GVILTVF

SEQ ID NO: 2661 - protein, 7 aa, Artificial Sequence
  Synthetic construct
GVILTVY

SEQ ID NO: 2662 - protein, 7 aa, Artificial Sequence
  Synthetic construct
GVILGFF

SEQ ID NO: 2663 - protein, 7 aa, Artificial Sequence
  Synthetic construct
GVILGFY

SEQ ID NO: 2664 - protein, 7 aa, Artificial Sequence
  Synthetic construct
GVILGRF

SEQ ID NO: 2665 - protein, 7 aa, Artificial Sequence
  Synthetic construct
GVILGRY

SEQ ID NO: 2666 - protein, 7 aa, Artificial Sequence
  Synthetic construct
GVILGCF

SEQ ID NO: 2667 - protein, 7 aa, Artificial Sequence
  Synthetic construct
GVILGCY

SEQ ID NO: 2668 - protein, 7 aa, Artificial Sequence
  Synthetic construct
GVILGLF

SEQ ID NO: 2669 - protein, 7 aa, Artificial Sequence
  Synthetic construct
GVILGLY

SEQ ID NO: 2670 - protein, 7 aa, Artificial Sequence
  Synthetic construct
GVILGAF

SEQ ID NO: 2671 - protein, 7 aa, Artificial Sequence
  Synthetic construct
GVILGAY

SEQ ID NO: 2672 - protein, 7 aa, Artificial Sequence
  Synthetic construct
GVILGQF

SEQ ID NO: 2673 - protein, 7 aa, Artificial Sequence
  Synthetic construct
GVILGQY

SEQ ID NO: 2674 - protein, 7 aa, Artificial Sequence
  Synthetic construct
GVILGDF

SEQ ID NO: 2675 - protein, 7 aa, Artificial Sequence
  Synthetic construct
GVILGDY

SEQ ID NO: 2676 - protein, 7 aa, Artificial Sequence
  Synthetic construct
GVILGVF

SEQ ID NO: 2677 - protein, 7 aa, Artificial Sequence
  Synthetic construct
GVILGVY

SEQ ID NO: 2678 - protein, 7 aa, Artificial Sequence
  Synthetic construct
GVILAFF

SEQ ID NO: 2679 - protein, 7 aa, Artificial Sequence
  Synthetic construct
GVILAFY

SEQ ID NO: 2680 - protein, 7 aa, Artificial Sequence
  Synthetic construct
GVILARF

SEQ ID NO: 2681 - protein, 7 aa, Artificial Sequence
  Synthetic construct
GVILARY

SEQ ID NO: 2682 - protein, 7 aa, Artificial Sequence
  Synthetic construct
GVILACF

SEQ ID NO: 2683 - protein, 7 aa, Artificial Sequence
  Synthetic construct
GVILACY

SEQ ID NO: 2684 - protein, 7 aa, Artificial Sequence
  Synthetic construct
GVILALF

SEQ ID NO: 2685 - protein, 7 aa, Artificial Sequence
  Synthetic construct
GVILALY

SEQ ID NO: 2686 - protein, 7 aa, Artificial Sequence
  Synthetic construct
GVILAAF

SEQ ID NO: 2687 - protein, 7 aa, Artificial Sequence
  Synthetic construct
GVILAAY

SEQ ID NO: 2688 - protein, 7 aa, Artificial Sequence
  Synthetic construct
GVILAQF

SEQ ID NO: 2689 - protein, 7 aa, Artificial Sequence
  Synthetic construct
GVILAQY

SEQ ID NO: 2690 - protein, 7 aa, Artificial Sequence
  Synthetic construct
GVILADF

SEQ ID NO: 2691 - protein, 7 aa, Artificial Sequence
  Synthetic construct
GVILADY

SEQ ID NO: 2692 - protein, 7 aa, Artificial Sequence
  Synthetic construct
GVILAVF

SEQ ID NO: 2693 - protein, 7 aa, Artificial Sequence
  Synthetic construct
GVILAVY

SEQ ID NO: 2694 - protein, 7 aa, Artificial Sequence
  Synthetic construct
GVILQFF

SEQ ID NO: 2695 - protein, 7 aa, Artificial Sequence
  Synthetic construct
GVILQFY

SEQ ID NO: 2696 - protein, 7 aa, Artificial Sequence
  Synthetic construct
GVILQRF

SEQ ID NO: 2697 - protein, 7 aa, Artificial Sequence
  Synthetic construct
GVILQRY

SEQ ID NO: 2698 - protein, 7 aa, Artificial Sequence
  Synthetic construct
GVILQCF

SEQ ID NO: 2699 - protein, 7 aa, Artificial Sequence
  Synthetic construct
GVILQCY

SEQ ID NO: 2700 - protein, 7 aa, Artificial Sequence
  Synthetic construct
GVILQLF

SEQ ID NO: 2701 - protein, 7 aa, Artificial Sequence
  Synthetic construct
GVILQLY

SEQ ID NO: 2702 - protein, 7 aa, Artificial Sequence
  Synthetic construct
GVILQAF

SEQ ID NO: 2703 - protein, 7 aa, Artificial Sequence
  Synthetic construct
GVILQAY

SEQ ID NO: 2704 - protein, 7 aa, Artificial Sequence
  Synthetic construct
GVILQQF

SEQ ID NO: 2705 - protein, 7 aa, Artificial Sequence
  Synthetic construct
GVILQQY

SEQ ID NO: 2706 - protein, 7 aa, Artificial Sequence
  Synthetic construct
GVILQDF

SEQ ID NO: 2707 - protein, 7 aa, Artificial Sequence
  Synthetic construct
GVILQDY

SEQ ID NO: 2708 - protein, 7 aa, Artificial Sequence
  Synthetic construct
GVILQVF

SEQ ID NO: 2709 - protein, 7 aa, Artificial Sequence
  Synthetic construct
GVILQVY

SEQ ID NO: 2710 - protein, 7 aa, Artificial Sequence
  Synthetic construct
GVIFIFF

SEQ ID NO: 2711 - protein, 7 aa, Artificial Sequence
  Synthetic construct
GVIFIFY

SEQ ID NO: 2712 - protein, 7 aa, Artificial Sequence
  Synthetic construct
GVIFIRF

SEQ ID NO: 2713 - protein, 7 aa, Artificial Sequence
  Synthetic construct
GVIFIRY

SEQ ID NO: 2714 - protein, 7 aa, Artificial Sequence
  Synthetic construct
GVIFICF

SEQ ID NO: 2715 - protein, 7 aa, Artificial Sequence
  Synthetic construct
GVIFICY

SEQ ID NO: 2716 - protein, 7 aa, Artificial Sequence
  Synthetic construct
GVIFILF

SEQ ID NO: 2717 - protein, 7 aa, Artificial Sequence
  Synthetic construct
GVIFILY

SEQ ID NO: 2718 - protein, 7 aa, Artificial Sequence
  Synthetic construct
GVIFIAF

SEQ ID NO: 2719 - protein, 7 aa, Artificial Sequence
  Synthetic construct
GVIFIAY

SEQ ID NO: 2720 - protein, 7 aa, Artificial Sequence
  Synthetic construct
GVIFIQF

SEQ ID NO: 2721 - protein, 7 aa, Artificial Sequence
  Synthetic construct
GVIFIQY

SEQ ID NO: 2722 - protein, 7 aa, Artificial Sequence
  Synthetic construct
GVIFIDF

SEQ ID NO: 2723 - protein, 7 aa, Artificial Sequence
  Synthetic construct
GVIFIDY

SEQ ID NO: 2724 - protein, 7 aa, Artificial Sequence
  Synthetic construct
GVIFIVF

SEQ ID NO: 2725 - protein, 7 aa, Artificial Sequence
  Synthetic construct
GVIFIVY

SEQ ID NO: 2726 - protein, 7 aa, Artificial Sequence
  Synthetic construct
GVIFDFF

SEQ ID NO: 2727 - protein, 7 aa, Artificial Sequence
  Synthetic construct
GVIFDFY

SEQ ID NO: 2728 - protein, 7 aa, Artificial Sequence
  Synthetic construct
GVIFDRF

SEQ ID NO: 2729 - protein, 7 aa, Artificial Sequence
  Synthetic construct
GVIFDRY

SEQ ID NO: 2730 - protein, 7 aa, Artificial Sequence
  Synthetic construct
GVIFDCF

SEQ ID NO: 2731 - protein, 7 aa, Artificial Sequence
  Synthetic construct
GVIFDCY

SEQ ID NO: 2732 - protein, 7 aa, Artificial Sequence
  Synthetic construct
GVIFDLF

SEQ ID NO: 2733 - protein, 7 aa, Artificial Sequence
  Synthetic construct
GVIFDLY

SEQ ID NO: 2734 - protein, 7 aa, Artificial Sequence
  Synthetic construct
GVIFDAF

SEQ ID NO: 2735 - protein, 7 aa, Artificial Sequence
  Synthetic construct
GVIFDAY

SEQ ID NO: 2736 - protein, 7 aa, Artificial Sequence
  Synthetic construct
GVIFDQF

SEQ ID NO: 2737 - protein, 7 aa, Artificial Sequence
  Synthetic construct
GVIFDQY

SEQ ID NO: 2738 - protein, 7 aa, Artificial Sequence
  Synthetic construct
GVIFDDF

SEQ ID NO: 2739 - protein, 7 aa, Artificial Sequence
  Synthetic construct
GVIFDDY

SEQ ID NO: 2740 - protein, 7 aa, Artificial Sequence
  Synthetic construct
GVIFDVF

SEQ ID NO: 2741 - protein, 7 aa, Artificial Sequence
  Synthetic construct
GVIFDVY

SEQ ID NO: 2742 - protein, 7 aa, Artificial Sequence
  Synthetic construct
GVIFYFF

SEQ ID NO: 2743 - protein, 7 aa, Artificial Sequence
  Synthetic construct
GVIFYFY

SEQ ID NO: 2744 - protein, 7 aa, Artificial Sequence
  Synthetic construct
GVIFYRF

SEQ ID NO: 2745 - protein, 7 aa, Artificial Sequence
  Synthetic construct
GVIFYRY

SEQ ID NO: 2746 - protein, 7 aa, Artificial Sequence
  Synthetic construct
GVIFYCF

SEQ ID NO: 2747 - protein, 7 aa, Artificial Sequence
  Synthetic construct
GVIFYCY

SEQ ID NO: 2748 - protein, 7 aa, Artificial Sequence
  Synthetic construct
GVIFYLF

SEQ ID NO: 2749 - protein, 7 aa, Artificial Sequence
  Synthetic construct
GVIFYLY

SEQ ID NO: 2750 - protein, 7 aa, Artificial Sequence
  Synthetic construct
GVIFYAF

SEQ ID NO: 2751 - protein, 7 aa, Artificial Sequence
  Synthetic construct
GVIFYAY

SEQ ID NO: 2752 - protein, 7 aa, Artificial Sequence
  Synthetic construct
GVIFYQF

SEQ ID NO: 2753 - protein, 7 aa, Artificial Sequence
  Synthetic construct
GVIFYQY

SEQ ID NO: 2754 - protein, 7 aa, Artificial Sequence
  Synthetic construct
GVIFYDF

SEQ ID NO: 2755 - protein, 7 aa, Artificial Sequence
  Synthetic construct
GVIFYDY

SEQ ID NO: 2756 - protein, 7 aa, Artificial Sequence
  Synthetic construct
GVIFYVF

SEQ ID NO: 2757 - protein, 7 aa, Artificial Sequence
  Synthetic construct
GVIFYVY

SEQ ID NO: 2758 - protein, 7 aa, Artificial Sequence
  Synthetic construct
GVIFFFF

SEQ ID NO: 2759 - protein, 7 aa, Artificial Sequence
  Synthetic construct
GVIFFFY

SEQ ID NO: 2760 - protein, 7 aa, Artificial Sequence
  Synthetic construct
GVIFFRF

SEQ ID NO: 2761 - protein, 7 aa, Artificial Sequence
  Synthetic construct
GVIFFRY

SEQ ID NO: 2762 - protein, 7 aa, Artificial Sequence
  Synthetic construct
GVIFFCF

SEQ ID NO: 2763 - protein, 7 aa, Artificial Sequence
  Synthetic construct
GVIFFCY

SEQ ID NO: 2764 - protein, 7 aa, Artificial Sequence
  Synthetic construct
GVIFFLF

SEQ ID NO: 2765 - protein, 7 aa, Artificial Sequence
  Synthetic construct
GVIFFLY

SEQ ID NO: 2766 - protein, 7 aa, Artificial Sequence
  Synthetic construct
GVIFFAF

SEQ ID NO: 2767 - protein, 7 aa, Artificial Sequence
  Synthetic construct
GVIFFAY

SEQ ID NO: 2768 - protein, 7 aa, Artificial Sequence
  Synthetic construct
GVIFFQF

SEQ ID NO: 2769 - protein, 7 aa, Artificial Sequence
  Synthetic construct
GVIFFQY

SEQ ID NO: 2770 - protein, 7 aa, Artificial Sequence
  Synthetic construct
GVIFFDF

SEQ ID NO: 2771 - protein, 7 aa, Artificial Sequence
  Synthetic construct
GVIFFDY

SEQ ID NO: 2772 - protein, 7 aa, Artificial Sequence
  Synthetic construct
GVIFFVF

SEQ ID NO: 2773 - protein, 7 aa, Artificial Sequence
  Synthetic construct
GVIFFVY

SEQ ID NO: 2774 - protein, 7 aa, Artificial Sequence
  Synthetic construct
GVIFVFF

SEQ ID NO: 2775 - protein, 7 aa, Artificial Sequence
  Synthetic construct
GVIFVFY

SEQ ID NO: 2776 - protein, 7 aa, Artificial Sequence
  Synthetic construct
GVIFVRF

SEQ ID NO: 2777 - protein, 7 aa, Artificial Sequence
  Synthetic construct
GVIFVRY

SEQ ID NO: 2778 - protein, 7 aa, Artificial Sequence
  Synthetic construct
GVIFVCF

SEQ ID NO: 2779 - protein, 7 aa, Artificial Sequence
  Synthetic construct
GVIFVCY

SEQ ID NO: 2780 - protein, 7 aa, Artificial Sequence
  Synthetic construct
GVIFVLF

SEQ ID NO: 2781 - protein, 7 aa, Artificial Sequence
  Synthetic construct
GVIFVLY

SEQ ID NO: 2782 - protein, 7 aa, Artificial Sequence
  Synthetic construct
GVIFVAF

SEQ ID NO: 2783 - protein, 7 aa, Artificial Sequence
  Synthetic construct
GVIFVAY

SEQ ID NO: 2784 - protein, 7 aa, Artificial Sequence
  Synthetic construct
GVIFVQF

SEQ ID NO: 2785 - protein, 7 aa, Artificial Sequence
  Synthetic construct
GVIFVQY

SEQ ID NO: 2786 - protein, 7 aa, Artificial Sequence
  Synthetic construct
GVIFVDF

SEQ ID NO: 2787 - protein, 7 aa, Artificial Sequence
  Synthetic construct
GVIFVDY

SEQ ID NO: 2788 - protein, 7 aa, Artificial Sequence
  Synthetic construct
GVIFVVF

SEQ ID NO: 2789 - protein, 7 aa, Artificial Sequence
  Synthetic construct
GVIFVVY

SEQ ID NO: 2790 - protein, 7 aa, Artificial Sequence
  Synthetic construct
GVIFTFF

SEQ ID NO: 2791 - protein, 7 aa, Artificial Sequence
  Synthetic construct
GVIFTFY

SEQ ID NO: 2792 - protein, 7 aa, Artificial Sequence
  Synthetic construct
GVIFTRF

SEQ ID NO: 2793 - protein, 7 aa, Artificial Sequence
  Synthetic construct
GVIFTRY

SEQ ID NO: 2794 - protein, 7 aa, Artificial Sequence
  Synthetic construct
GVIFTCF

SEQ ID NO: 2795 - protein, 7 aa, Artificial Sequence
  Synthetic construct
GVIFTCY

SEQ ID NO: 2796 - protein, 7 aa, Artificial Sequence
  Synthetic construct
GVIFTLF

SEQ ID NO: 2797 - protein, 7 aa, Artificial Sequence
  Synthetic construct
GVIFTLY

SEQ ID NO: 2798 - protein, 7 aa, Artificial Sequence
  Synthetic construct
GVIFTAF

SEQ ID NO: 2799 - protein, 7 aa, Artificial Sequence
  Synthetic construct
GVIFTAY

SEQ ID NO: 2800 - protein, 7 aa, Artificial Sequence
  Synthetic construct
GVIFTQF

SEQ ID NO: 2801 - protein, 7 aa, Artificial Sequence
  Synthetic construct
GVIFTQY

SEQ ID NO: 2802 - protein, 7 aa, Artificial Sequence
  Synthetic construct
GVIFTDF

SEQ ID NO: 2803 - protein, 7 aa, Artificial Sequence
  Synthetic construct
GVIFTDY

SEQ ID NO: 2804 - protein, 7 aa, Artificial Sequence
  Synthetic construct
GVIFTVF

SEQ ID NO: 2805 - protein, 7 aa, Artificial Sequence
  Synthetic construct
GVIFTVY

SEQ ID NO: 2806 - protein, 7 aa, Artificial Sequence
  Synthetic construct
GVIFGFF

SEQ ID NO: 2807 - protein, 7 aa, Artificial Sequence
  Synthetic construct
GVIFGFY

SEQ ID NO: 2808 - protein, 7 aa, Artificial Sequence
  Synthetic construct
GVIFGRF

SEQ ID NO: 2809 - protein, 7 aa, Artificial Sequence
  Synthetic construct
GVIFGRY

SEQ ID NO: 2810 - protein, 7 aa, Artificial Sequence
  Synthetic construct
GVIFGCF

SEQ ID NO: 2811 - protein, 7 aa, Artificial Sequence
  Synthetic construct
GVIFGCY

SEQ ID NO: 2812 - protein, 7 aa, Artificial Sequence
  Synthetic construct
GVIFGLF

SEQ ID NO: 2813 - protein, 7 aa, Artificial Sequence
  Synthetic construct
GVIFGLY

SEQ ID NO: 2814 - protein, 7 aa, Artificial Sequence
  Synthetic construct
GVIFGAF

SEQ ID NO: 2815 - protein, 7 aa, Artificial Sequence
  Synthetic construct
GVIFGAY

SEQ ID NO: 2816 - protein, 7 aa, Artificial Sequence
  Synthetic construct
GVIFGQF

SEQ ID NO: 2817 - protein, 7 aa, Artificial Sequence
  Synthetic construct
GVIFGQY

SEQ ID NO: 2818 - protein, 7 aa, Artificial Sequence
  Synthetic construct
GVIFGDF

SEQ ID NO: 2819 - protein, 7 aa, Artificial Sequence
  Synthetic construct
GVIFGDY

SEQ ID NO: 2820 - protein, 7 aa, Artificial Sequence
  Synthetic construct
GVIFGVF

SEQ ID NO: 2821 - protein, 7 aa, Artificial Sequence
  Synthetic construct
GVIFGVY

SEQ ID NO: 2822 - protein, 7 aa, Artificial Sequence
  Synthetic construct
GVIFAFF

SEQ ID NO: 2823 - protein, 7 aa, Artificial Sequence
  Synthetic construct
GVIFAFY

SEQ ID NO: 2824 - protein, 7 aa, Artificial Sequence
  Synthetic construct
GVIFARF

SEQ ID NO: 2825 - protein, 7 aa, Artificial Sequence
  Synthetic construct
GVIFARY

SEQ ID NO: 2826 - protein, 7 aa, Artificial Sequence
  Synthetic construct
GVIFACF

SEQ ID NO: 2827 - protein, 7 aa, Artificial Sequence
  Synthetic construct
GVIFACY

SEQ ID NO: 2828 - protein, 7 aa, Artificial Sequence
  Synthetic construct
GVIFALF

SEQ ID NO: 2829 - protein, 7 aa, Artificial Sequence
  Synthetic construct
GVIFALY

SEQ ID NO: 2830 - protein, 7 aa, Artificial Sequence
  Synthetic construct
GVIFAAF

SEQ ID NO: 2831 - protein, 7 aa, Artificial Sequence
  Synthetic construct
GVIFAAY

SEQ ID NO: 2832 - protein, 7 aa, Artificial Sequence
  Synthetic construct
GVIFAQF

SEQ ID NO: 2833 - protein, 7 aa, Artificial Sequence
  Synthetic construct
GVIFAQY

SEQ ID NO: 2834 - protein, 7 aa, Artificial Sequence
  Synthetic construct
GVIFADF

SEQ ID NO: 2835 - protein, 7 aa, Artificial Sequence
  Synthetic construct
GVIFADY

SEQ ID NO: 2836 - protein, 7 aa, Artificial Sequence
  Synthetic construct
GVIFAVF

SEQ ID NO: 2837 - protein, 7 aa, Artificial Sequence
  Synthetic construct
GVIFAVY

SEQ ID NO: 2838 - protein, 7 aa, Artificial Sequence
  Synthetic construct
GVIFQFF

SEQ ID NO: 2839 - protein, 7 aa, Artificial Sequence
  Synthetic construct
GVIFQFY

SEQ ID NO: 2840 - protein, 7 aa, Artificial Sequence
  Synthetic construct
GVIFQRF

SEQ ID NO: 2841 - protein, 7 aa, Artificial Sequence
  Synthetic construct
GVIFQRY

SEQ ID NO: 2842 - protein, 7 aa, Artificial Sequence
  Synthetic construct
GVIFQCF

SEQ ID NO: 2843 - protein, 7 aa, Artificial Sequence
  Synthetic construct
GVIFQCY

SEQ ID NO: 2844 - protein, 7 aa, Artificial Sequence
  Synthetic construct
GVIFQLF

SEQ ID NO: 2845 - protein, 7 aa, Artificial Sequence
  Synthetic construct
GVIFQLY

SEQ ID NO: 2846 - protein, 7 aa, Artificial Sequence
  Synthetic construct
GVIFQAF

SEQ ID NO: 2847 - protein, 7 aa, Artificial Sequence
  Synthetic construct
GVIFQAY

SEQ ID NO: 2848 - protein, 7 aa, Artificial Sequence
  Synthetic construct
GVIFQQF

SEQ ID NO: 2849 - protein, 7 aa, Artificial Sequence
  Synthetic construct
GVIFQQY

SEQ ID NO: 2850 - protein, 7 aa, Artificial Sequence
  Synthetic construct
GVIFQDF

SEQ ID NO: 2851 - protein, 7 aa, Artificial Sequence
  Synthetic construct
GVIFQDY

SEQ ID NO: 2852 - protein, 7 aa, Artificial Sequence
  Synthetic construct
GVIFQVF

SEQ ID NO: 2853 - protein, 7 aa, Artificial Sequence
  Synthetic construct
GVIFQVY

SEQ ID NO: 2854 - protein, 7 aa, Artificial Sequence
  Synthetic construct
GVGYIFF

SEQ ID NO: 2855 - protein, 7 aa, Artificial Sequence
  Synthetic construct
GVGYIFY

SEQ ID NO: 2856 - protein, 7 aa, Artificial Sequence
  Synthetic construct
GVGYIRF

SEQ ID NO: 2857 - protein, 7 aa, Artificial Sequence
  Synthetic construct
GVGYIRY

SEQ ID NO: 2858 - protein, 7 aa, Artificial Sequence
  Synthetic construct
GVGYICF

SEQ ID NO: 2859 - protein, 7 aa, Artificial Sequence
  Synthetic construct
GVGYICY

SEQ ID NO: 2860 - protein, 7 aa, Artificial Sequence
  Synthetic construct
GVGYILF

SEQ ID NO: 2861 - protein, 7 aa, Artificial Sequence
  Synthetic construct
GVGYILY

SEQ ID NO: 2862 - protein, 7 aa, Artificial Sequence
  Synthetic construct
GVGYIAF

SEQ ID NO: 2863 - protein, 7 aa, Artificial Sequence
  Synthetic construct
GVGYIAY

SEQ ID NO: 2864 - protein, 7 aa, Artificial Sequence
  Synthetic construct
GVGYIQF

SEQ ID NO: 2865 - protein, 7 aa, Artificial Sequence
  Synthetic construct
GVGYIQY

SEQ ID NO: 2866 - protein, 7 aa, Artificial Sequence
  Synthetic construct
GVGYIDF

SEQ ID NO: 2867 - protein, 7 aa, Artificial Sequence
  Synthetic construct
GVGYIDY

SEQ ID NO: 2868 - protein, 7 aa, Artificial Sequence
  Synthetic construct
GVGYIVF

SEQ ID NO: 2869 - protein, 7 aa, Artificial Sequence
  Synthetic construct
GVGYIVY

SEQ ID NO: 2870 - protein, 7 aa, Artificial Sequence
  Synthetic construct
GVGYDFF

SEQ ID NO: 2871 - protein, 7 aa, Artificial Sequence
  Synthetic construct
GVGYDFY

SEQ ID NO: 2872 - protein, 7 aa, Artificial Sequence
  Synthetic construct
GVGYDRF

SEQ ID NO: 2873 - protein, 7 aa, Artificial Sequence
  Synthetic construct
GVGYDRY

SEQ ID NO: 2874 - protein, 7 aa, Artificial Sequence
  Synthetic construct
GVGYDCF

SEQ ID NO: 2875 - protein, 7 aa, Artificial Sequence
  Synthetic construct
GVGYDCY

SEQ ID NO: 2876 - protein, 7 aa, Artificial Sequence
  Synthetic construct
GVGYDLF

SEQ ID NO: 2877 - protein, 7 aa, Artificial Sequence
  Synthetic construct
GVGYDLY

SEQ ID NO: 2878 - protein, 7 aa, Artificial Sequence
  Synthetic construct
GVGYDAF

SEQ ID NO: 2879 - protein, 7 aa, Artificial Sequence
  Synthetic construct
GVGYDAY

SEQ ID NO: 2880 - protein, 7 aa, Artificial Sequence
  Synthetic construct
GVGYDQF

SEQ ID NO: 2881 - protein, 7 aa, Artificial Sequence
  Synthetic construct
GVGYDQY

SEQ ID NO: 2882 - protein, 7 aa, Artificial Sequence
  Synthetic construct
GVGYDDF

SEQ ID NO: 2883 - protein, 7 aa, Artificial Sequence
  Synthetic construct
GVGYDDY

SEQ ID NO: 2884 - protein, 7 aa, Artificial Sequence
  Synthetic construct
GVGYDVF

SEQ ID NO: 2885 - protein, 7 aa, Artificial Sequence
  Synthetic construct
GVGYDVY

SEQ ID NO: 2886 - protein, 7 aa, Artificial Sequence
  Synthetic construct
GVGYYFF

SEQ ID NO: 2887 - protein, 7 aa, Artificial Sequence
  Synthetic construct
GVGYYFY

SEQ ID NO: 2888 - protein, 7 aa, Artificial Sequence
  Synthetic construct
GVGYYRF

SEQ ID NO: 2889 - protein, 7 aa, Artificial Sequence
  Synthetic construct
GVGYYRY

SEQ ID NO: 2890 - protein, 7 aa, Artificial Sequence
  Synthetic construct
GVGYYCF

SEQ ID NO: 2891 - protein, 7 aa, Artificial Sequence
  Synthetic construct
GVGYYCY

SEQ ID NO: 2892 - protein, 7 aa, Artificial Sequence
  Synthetic construct
GVGYYLF

SEQ ID NO: 2893 - protein, 7 aa, Artificial Sequence
  Synthetic construct
GVGYYLY

SEQ ID NO: 2894 - protein, 7 aa, Artificial Sequence
  Synthetic construct
GVGYYAF

SEQ ID NO: 2895 - protein, 7 aa, Artificial Sequence
  Synthetic construct
GVGYYAY

SEQ ID NO: 2896 - protein, 7 aa, Artificial Sequence
  Synthetic construct
GVGYYQF

SEQ ID NO: 2897 - protein, 7 aa, Artificial Sequence
  Synthetic construct
GVGYYQY

SEQ ID NO: 2898 - protein, 7 aa, Artificial Sequence
  Synthetic construct
GVGYYDF

SEQ ID NO: 2899 - protein, 7 aa, Artificial Sequence
  Synthetic construct
GVGYYDY

SEQ ID NO: 2900 - protein, 7 aa, Artificial Sequence
  Synthetic construct
GVGYYVF

SEQ ID NO: 2901 - protein, 7 aa, Artificial Sequence
  Synthetic construct
GVGYYVY

SEQ ID NO: 2902 - protein, 7 aa, Artificial Sequence
  Synthetic construct
GVGYFFF

SEQ ID NO: 2903 - protein, 7 aa, Artificial Sequence
  Synthetic construct
GVGYFFY

SEQ ID NO: 2904 - protein, 7 aa, Artificial Sequence
  Synthetic construct
GVGYFRF

SEQ ID NO: 2905 - protein, 7 aa, Artificial Sequence
  Synthetic construct
GVGYFRY

SEQ ID NO: 2906 - protein, 7 aa, Artificial Sequence
  Synthetic construct
GVGYFCF

SEQ ID NO: 2907 - protein, 7 aa, Artificial Sequence
  Synthetic construct
GVGYFCY

SEQ ID NO: 2908 - protein, 7 aa, Artificial Sequence
  Synthetic construct
GVGYFLF

SEQ ID NO: 2909 - protein, 7 aa, Artificial Sequence
  Synthetic construct
GVGYFLY

SEQ ID NO: 2910 - protein, 7 aa, Artificial Sequence
  Synthetic construct
GVGYFAF

SEQ ID NO: 2911 - protein, 7 aa, Artificial Sequence
  Synthetic construct
GVGYFAY

SEQ ID NO: 2912 - protein, 7 aa, Artificial Sequence
  Synthetic construct
GVGYFQF

SEQ ID NO: 2913 - protein, 7 aa, Artificial Sequence
  Synthetic construct
GVGYFQY

SEQ ID NO: 2914 - protein, 7 aa, Artificial Sequence
  Synthetic construct
GVGYFDF

SEQ ID NO: 2915 - protein, 7 aa, Artificial Sequence
  Synthetic construct
GVGYFDY

SEQ ID NO: 2916 - protein, 7 aa, Artificial Sequence
  Synthetic construct
GVGYFVF

SEQ ID NO: 2917 - protein, 7 aa, Artificial Sequence
  Synthetic construct
GVGYFVY

SEQ ID NO: 2918 - protein, 7 aa, Artificial Sequence
  Synthetic construct
GVGYVFF

SEQ ID NO: 2919 - protein, 7 aa, Artificial Sequence
  Synthetic construct
GVGYVFY

SEQ ID NO: 2920 - protein, 7 aa, Artificial Sequence
  Synthetic construct
GVGYVRF

SEQ ID NO: 2921 - protein, 7 aa, Artificial Sequence
  Synthetic construct
GVGYVRY

SEQ ID NO: 2922 - protein, 7 aa, Artificial Sequence
  Synthetic construct
GVGYVCF

SEQ ID NO: 2923 - protein, 7 aa, Artificial Sequence
  Synthetic construct
GVGYVCY

SEQ ID NO: 2924 - protein, 7 aa, Artificial Sequence
  Synthetic construct
GVGYVLF

SEQ ID NO: 2925 - protein, 7 aa, Artificial Sequence
  Synthetic construct
GVGYVLY

SEQ ID NO: 2926 - protein, 7 aa, Artificial Sequence
  Synthetic construct
GVGYVAF

SEQ ID NO: 2927 - protein, 7 aa, Artificial Sequence
  Synthetic construct
GVGYVAY

SEQ ID NO: 2928 - protein, 7 aa, Artificial Sequence
  Synthetic construct
GVGYVQF

SEQ ID NO: 2929 - protein, 7 aa, Artificial Sequence
  Synthetic construct
GVGYVQY

SEQ ID NO: 2930 - protein, 7 aa, Artificial Sequence
  Synthetic construct
GVGYVDF

SEQ ID NO: 2931 - protein, 7 aa, Artificial Sequence
  Synthetic construct
GVGYVDY

SEQ ID NO: 2932 - protein, 7 aa, Artificial Sequence
  Synthetic construct
GVGYVVF

SEQ ID NO: 2933 - protein, 7 aa, Artificial Sequence
  Synthetic construct
GVGYVVY

SEQ ID NO: 2934 - protein, 7 aa, Artificial Sequence
  Synthetic construct
GVGYTFF

SEQ ID NO: 2935 - protein, 7 aa, Artificial Sequence
  Synthetic construct
GVGYTFY

SEQ ID NO: 2936 - protein, 7 aa, Artificial Sequence
  Synthetic construct
GVGYTRF

SEQ ID NO: 2937 - protein, 7 aa, Artificial Sequence
  Synthetic construct
GVGYTRY

SEQ ID NO: 2938 - protein, 7 aa, Artificial Sequence
  Synthetic construct
GVGYTCF

SEQ ID NO: 2939 - protein, 7 aa, Artificial Sequence
  Synthetic construct
GVGYTCY

SEQ ID NO: 2940 - protein, 7 aa, Artificial Sequence
  Synthetic construct
GVGYTLF

SEQ ID NO: 2941 - protein, 7 aa, Artificial Sequence
  Synthetic construct
GVGYTLY

SEQ ID NO: 2942 - protein, 7 aa, Artificial Sequence
  Synthetic construct
GVGYTAF

SEQ ID NO: 2943 - protein, 7 aa, Artificial Sequence
  Synthetic construct
GVGYTAY

SEQ ID NO: 2944 - protein, 7 aa, Artificial Sequence
  Synthetic construct
GVGYTQF

SEQ ID NO: 2945 - protein, 7 aa, Artificial Sequence
  Synthetic construct
GVGYTQY

SEQ ID NO: 2946 - protein, 7 aa, Artificial Sequence
  Synthetic construct
GVGYTDF

SEQ ID NO: 2947 - protein, 7 aa, Artificial Sequence
  Synthetic construct
GVGYTDY

SEQ ID NO: 2948 - protein, 7 aa, Artificial Sequence
  Synthetic construct
GVGYTVF

SEQ ID NO: 2949 - protein, 7 aa, Artificial Sequence
  Synthetic construct
GVGYTVY

SEQ ID NO: 2950 - protein, 7 aa, Artificial Sequence
  Synthetic construct
GVGYGFF

SEQ ID NO: 2951 - protein, 7 aa, Artificial Sequence
  Synthetic construct
GVGYGFY

SEQ ID NO: 2952 - protein, 7 aa, Artificial Sequence
  Synthetic construct
GVGYGRF

SEQ ID NO: 2953 - protein, 7 aa, Artificial Sequence
  Synthetic construct
GVGYGRY

SEQ ID NO: 2954 - protein, 7 aa, Artificial Sequence
  Synthetic construct
GVGYGCF

SEQ ID NO: 2955 - protein, 7 aa, Artificial Sequence
  Synthetic construct
GVGYGCY

SEQ ID NO: 2956 - protein, 7 aa, Artificial Sequence
  Synthetic construct
GVGYGLF

SEQ ID NO: 2957 - protein, 7 aa, Artificial Sequence
  Synthetic construct
GVGYGLY

SEQ ID NO: 2958 - protein, 7 aa, Artificial Sequence
  Synthetic construct
GVGYGAF

SEQ ID NO: 2959 - protein, 7 aa, Artificial Sequence
  Synthetic construct
GVGYGAY

SEQ ID NO: 2960 - protein, 7 aa, Artificial Sequence
  Synthetic construct
GVGYGQF

SEQ ID NO: 2961 - protein, 7 aa, Artificial Sequence
  Synthetic construct
GVGYGQY

SEQ ID NO: 2962 - protein, 7 aa, Artificial Sequence
  Synthetic construct
GVGYGDF

SEQ ID NO: 2963 - protein, 7 aa, Artificial Sequence
  Synthetic construct
GVGYGDY

SEQ ID NO: 2964 - protein, 7 aa, Artificial Sequence
  Synthetic construct
GVGYGVF

SEQ ID NO: 2965 - protein, 7 aa, Artificial Sequence
  Synthetic construct
GVGYGVY

SEQ ID NO: 2966 - protein, 7 aa, Artificial Sequence
  Synthetic construct
GVGYAFF

SEQ ID NO: 2967 - protein, 7 aa, Artificial Sequence
  Synthetic construct
GVGYAFY

SEQ ID NO: 2968 - protein, 7 aa, Artificial Sequence
  Synthetic construct
GVGYARF

SEQ ID NO: 2969 - protein, 7 aa, Artificial Sequence
  Synthetic construct
GVGYARY

SEQ ID NO: 2970 - protein, 7 aa, Artificial Sequence
  Synthetic construct
GVGYACF

SEQ ID NO: 2971 - protein, 7 aa, Artificial Sequence
  Synthetic construct
GVGYACY

SEQ ID NO: 2972 - protein, 7 aa, Artificial Sequence
  Synthetic construct
GVGYALF

SEQ ID NO: 2973 - protein, 7 aa, Artificial Sequence
  Synthetic construct
GVGYALY

SEQ ID NO: 2974 - protein, 7 aa, Artificial Sequence
  Synthetic construct
GVGYAAF

SEQ ID NO: 2975 - protein, 7 aa, Artificial Sequence
  Synthetic construct
GVGYAAY

SEQ ID NO: 2976 - protein, 7 aa, Artificial Sequence
  Synthetic construct
GVGYAQF

SEQ ID NO: 2977 - protein, 7 aa, Artificial Sequence
  Synthetic construct
GVGYAQY

SEQ ID NO: 2978 - protein, 7 aa, Artificial Sequence
  Synthetic construct
GVGYADF

SEQ ID NO: 2979 - protein, 7 aa, Artificial Sequence
  Synthetic construct
GVGYADY

SEQ ID NO: 2980 - protein, 7 aa, Artificial Sequence
  Synthetic construct
GVGYAVF

SEQ ID NO: 2981 - protein, 7 aa, Artificial Sequence
  Synthetic construct
GVGYAVY

SEQ ID NO: 2982 - protein, 7 aa, Artificial Sequence
  Synthetic construct
GVGYQFF

SEQ ID NO: 2983 - protein, 7 aa, Artificial Sequence
  Synthetic construct
GVGYQFY

SEQ ID NO: 2984 - protein, 7 aa, Artificial Sequence
  Synthetic construct
GVGYQRF

SEQ ID NO: 2985 - protein, 7 aa, Artificial Sequence
  Synthetic construct
GVGYQRY

SEQ ID NO: 2986 - protein, 7 aa, Artificial Sequence
  Synthetic construct
GVGYQCF

SEQ ID NO: 2987 - protein, 7 aa, Artificial Sequence
  Synthetic construct
GVGYQCY

SEQ ID NO: 2988 - protein, 7 aa, Artificial Sequence
  Synthetic construct
GVGYQLF

SEQ ID NO: 2989 - protein, 7 aa, Artificial Sequence
  Synthetic construct
GVGYQLY

SEQ ID NO: 2990 - protein, 7 aa, Artificial Sequence
  Synthetic construct
GVGYQAF

SEQ ID NO: 2991 - protein, 7 aa, Artificial Sequence
  Synthetic construct
GVGYQAY

SEQ ID NO: 2992 - protein, 7 aa, Artificial Sequence
  Synthetic construct
GVGYQQF

SEQ ID NO: 2993 - protein, 7 aa, Artificial Sequence
  Synthetic construct
GVGYQQY

SEQ ID NO: 2994 - protein, 7 aa, Artificial Sequence
  Synthetic construct
GVGYQDF

SEQ ID NO: 2995 - protein, 7 aa, Artificial Sequence
  Synthetic construct
GVGYQDY

SEQ ID NO: 2996 - protein, 7 aa, Artificial Sequence
  Synthetic construct
GVGYQVF

SEQ ID NO: 2997 - protein, 7 aa, Artificial Sequence
  Synthetic construct
GVGYQVY

SEQ ID NO: 2998 - protein, 7 aa, Artificial Sequence
  Synthetic construct
GVGPIFF

SEQ ID NO: 2999 - protein, 7 aa, Artificial Sequence
  Synthetic construct
GVGPIFY

SEQ ID NO: 3000 - protein, 7 aa, Artificial Sequence
  Synthetic construct
GVGPIRF

SEQ ID NO: 3001 - protein, 7 aa, Artificial Sequence
  Synthetic construct
GVGPIRY

SEQ ID NO: 3002 - protein, 7 aa, Artificial Sequence
  Synthetic construct
GVGPICF

SEQ ID NO: 3003 - protein, 7 aa, Artificial Sequence
  Synthetic construct
GVGPICY

SEQ ID NO: 3004 - protein, 7 aa, Artificial Sequence
  Synthetic construct
GVGPILF

SEQ ID NO: 3005 - protein, 7 aa, Artificial Sequence
  Synthetic construct
GVGPILY

SEQ ID NO: 3006 - protein, 7 aa, Artificial Sequence
  Synthetic construct
GVGPIAF

SEQ ID NO: 3007 - protein, 7 aa, Artificial Sequence
  Synthetic construct
GVGPIAY

SEQ ID NO: 3008 - protein, 7 aa, Artificial Sequence
  Synthetic construct
GVGPIQF

SEQ ID NO: 3009 - protein, 7 aa, Artificial Sequence
  Synthetic construct
GVGPIQY

SEQ ID NO: 3010 - protein, 7 aa, Artificial Sequence
  Synthetic construct
GVGPIDF

SEQ ID NO: 3011 - protein, 7 aa, Artificial Sequence
  Synthetic construct
GVGPIDY

SEQ ID NO: 3012 - protein, 7 aa, Artificial Sequence
  Synthetic construct
GVGPIVF

SEQ ID NO: 3013 - protein, 7 aa, Artificial Sequence
  Synthetic construct
GVGPIVY

SEQ ID NO: 3014 - protein, 7 aa, Artificial Sequence
  Synthetic construct
GVGPDFF

SEQ ID NO: 3015 - protein, 7 aa, Artificial Sequence
  Synthetic construct
GVGPDFY

SEQ ID NO: 3016 - protein, 7 aa, Artificial Sequence
  Synthetic construct
GVGPDRF

SEQ ID NO: 3017 - protein, 7 aa, Artificial Sequence
  Synthetic construct
GVGPDRY

SEQ ID NO: 3018 - protein, 7 aa, Artificial Sequence
  Synthetic construct
GVGPDCF

SEQ ID NO: 3019 - protein, 7 aa, Artificial Sequence
  Synthetic construct
GVGPDCY

SEQ ID NO: 3020 - protein, 7 aa, Artificial Sequence
  Synthetic construct
GVGPDLF

SEQ ID NO: 3021 - protein, 7 aa, Artificial Sequence
  Synthetic construct
GVGPDLY

SEQ ID NO: 3022 - protein, 7 aa, Artificial Sequence
  Synthetic construct
GVGPDAF

SEQ ID NO: 3023 - protein, 7 aa, Artificial Sequence
  Synthetic construct
GVGPDAY

SEQ ID NO: 3024 - protein, 7 aa, Artificial Sequence
  Synthetic construct
GVGPDQF

SEQ ID NO: 3025 - protein, 7 aa, Artificial Sequence
  Synthetic construct
GVGPDQY

SEQ ID NO: 3026 - protein, 7 aa, Artificial Sequence
  Synthetic construct
GVGPDDF

SEQ ID NO: 3027 - protein, 7 aa, Artificial Sequence
  Synthetic construct
GVGPDDY

SEQ ID NO: 3028 - protein, 7 aa, Artificial Sequence
  Synthetic construct
GVGPDVF

SEQ ID NO: 3029 - protein, 7 aa, Artificial Sequence
  Synthetic construct
GVGPDVY

SEQ ID NO: 3030 - protein, 7 aa, Artificial Sequence
  Synthetic construct
GVGPYFF

SEQ ID NO: 3031 - protein, 7 aa, Artificial Sequence
  Synthetic construct
GVGPYFY

SEQ ID NO: 3032 - protein, 7 aa, Artificial Sequence
  Synthetic construct
GVGPYRF

SEQ ID NO: 3033 - protein, 7 aa, Artificial Sequence
  Synthetic construct
GVGPYRY

SEQ ID NO: 3034 - protein, 7 aa, Artificial Sequence
  Synthetic construct
GVGPYCF

SEQ ID NO: 3035 - protein, 7 aa, Artificial Sequence
  Synthetic construct
GVGPYCY

SEQ ID NO: 3036 - protein, 7 aa, Artificial Sequence
  Synthetic construct
GVGPYLF

SEQ ID NO: 3037 - protein, 7 aa, Artificial Sequence
  Synthetic construct
GVGPYLY

SEQ ID NO: 3038 - protein, 7 aa, Artificial Sequence
  Synthetic construct
GVGPYAF

SEQ ID NO: 3039 - protein, 7 aa, Artificial Sequence
  Synthetic construct
GVGPYAY

SEQ ID NO: 3040 - protein, 7 aa, Artificial Sequence
  Synthetic construct
GVGPYQF

SEQ ID NO: 3041 - protein, 7 aa, Artificial Sequence
  Synthetic construct
GVGPYQY

SEQ ID NO: 3042 - protein, 7 aa, Artificial Sequence
  Synthetic construct
GVGPYDF

SEQ ID NO: 3043 - protein, 7 aa, Artificial Sequence
  Synthetic construct
GVGPYDY

SEQ ID NO: 3044 - protein, 7 aa, Artificial Sequence
  Synthetic construct
GVGPYVF

SEQ ID NO: 3045 - protein, 7 aa, Artificial Sequence
  Synthetic construct
GVGPYVY

SEQ ID NO: 3046 - protein, 7 aa, Artificial Sequence
  Synthetic construct
GVGPFFF

SEQ ID NO: 3047 - protein, 7 aa, Artificial Sequence
  Synthetic construct
GVGPFFY

SEQ ID NO: 3048 - protein, 7 aa, Artificial Sequence
  Synthetic construct
GVGPFRF

SEQ ID NO: 3049 - protein, 7 aa, Artificial Sequence
  Synthetic construct
GVGPFRY

SEQ ID NO: 3050 - protein, 7 aa, Artificial Sequence
  Synthetic construct
GVGPFCF

SEQ ID NO: 3051 - protein, 7 aa, Artificial Sequence
  Synthetic construct
GVGPFCY

SEQ ID NO: 3052 - protein, 7 aa, Artificial Sequence
  Synthetic construct
GVGPFLF

SEQ ID NO: 3053 - protein, 7 aa, Artificial Sequence
  Synthetic construct
GVGPFLY

SEQ ID NO: 3054 - protein, 7 aa, Artificial Sequence
  Synthetic construct
GVGPFAF

SEQ ID NO: 3055 - protein, 7 aa, Artificial Sequence
  Synthetic construct
GVGPFAY

SEQ ID NO: 3056 - protein, 7 aa, Artificial Sequence
  Synthetic construct
GVGPFQF

SEQ ID NO: 3057 - protein, 7 aa, Artificial Sequence
  Synthetic construct
GVGPFQY

SEQ ID NO: 3058 - protein, 7 aa, Artificial Sequence
  Synthetic construct
GVGPFDF

SEQ ID NO: 3059 - protein, 7 aa, Artificial Sequence
  Synthetic construct
GVGPFDY

SEQ ID NO: 3060 - protein, 7 aa, Artificial Sequence
  Synthetic construct
GVGPFVF

SEQ ID NO: 3061 - protein, 7 aa, Artificial Sequence
  Synthetic construct
GVGPFVY

SEQ ID NO: 3062 - protein, 7 aa, Artificial Sequence
  Synthetic construct
GVGPVFF

SEQ ID NO: 3063 - protein, 7 aa, Artificial Sequence
  Synthetic construct
GVGPVFY

SEQ ID NO: 3064 - protein, 7 aa, Artificial Sequence
  Synthetic construct
GVGPVRF

SEQ ID NO: 3065 - protein, 7 aa, Artificial Sequence
  Synthetic construct
GVGPVRY

SEQ ID NO: 3066 - protein, 7 aa, Artificial Sequence
  Synthetic construct
GVGPVCF

SEQ ID NO: 3067 - protein, 7 aa, Artificial Sequence
  Synthetic construct
GVGPVCY

SEQ ID NO: 3068 - protein, 7 aa, Artificial Sequence
  Synthetic construct
GVGPVLF

SEQ ID NO: 3069 - protein, 7 aa, Artificial Sequence
  Synthetic construct
GVGPVLY

SEQ ID NO: 3070 - protein, 7 aa, Artificial Sequence
  Synthetic construct
GVGPVAF

SEQ ID NO: 3071 - protein, 7 aa, Artificial Sequence
  Synthetic construct
GVGPVAY

SEQ ID NO: 3072 - protein, 7 aa, Artificial Sequence
  Synthetic construct
GVGPVQF

SEQ ID NO: 3073 - protein, 7 aa, Artificial Sequence
  Synthetic construct
GVGPVQY

SEQ ID NO: 3074 - protein, 7 aa, Artificial Sequence
  Synthetic construct
GVGPVDF

SEQ ID NO: 3075 - protein, 7 aa, Artificial Sequence
  Synthetic construct
GVGPVDY

SEQ ID NO: 3076 - protein, 7 aa, Artificial Sequence
  Synthetic construct
GVGPVVF

SEQ ID NO: 3077 - protein, 7 aa, Artificial Sequence
  Synthetic construct
GVGPVVY

SEQ ID NO: 3078 - protein, 7 aa, Artificial Sequence
  Synthetic construct
GVGPTFF

SEQ ID NO: 3079 - protein, 7 aa, Artificial Sequence
  Synthetic construct
GVGPTFY

SEQ ID NO: 3080 - protein, 7 aa, Artificial Sequence
  Synthetic construct
GVGPTRF

SEQ ID NO: 3081 - protein, 7 aa, Artificial Sequence
  Synthetic construct
GVGPTRY

SEQ ID NO: 3082 - protein, 7 aa, Artificial Sequence
  Synthetic construct
GVGPTCF

SEQ ID NO: 3083 - protein, 7 aa, Artificial Sequence
  Synthetic construct
GVGPTCY

SEQ ID NO: 3084 - protein, 7 aa, Artificial Sequence
  Synthetic construct
GVGPTLF

SEQ ID NO: 3085 - protein, 7 aa, Artificial Sequence
  Synthetic construct
GVGPTLY

SEQ ID NO: 3086 - protein, 7 aa, Artificial Sequence
  Synthetic construct
GVGPTAF

SEQ ID NO: 3087 - protein, 7 aa, Artificial Sequence
  Synthetic construct
GVGPTAY

SEQ ID NO: 3088 - protein, 7 aa, Artificial Sequence
  Synthetic construct
GVGPTQF

SEQ ID NO: 3089 - protein, 7 aa, Artificial Sequence
  Synthetic construct
GVGPTQY

SEQ ID NO: 3090 - protein, 7 aa, Artificial Sequence
  Synthetic construct
GVGPTDF

SEQ ID NO: 3091 - protein, 7 aa, Artificial Sequence
  Synthetic construct
GVGPTDY

SEQ ID NO: 3092 - protein, 7 aa, Artificial Sequence
  Synthetic construct
GVGPTVF

SEQ ID NO: 3093 - protein, 7 aa, Artificial Sequence
  Synthetic construct
GVGPTVY

SEQ ID NO: 3094 - protein, 7 aa, Artificial Sequence
  Synthetic construct
GVGPGFF

SEQ ID NO: 3095 - protein, 7 aa, Artificial Sequence
  Synthetic construct
GVGPGFY

SEQ ID NO: 3096 - protein, 7 aa, Artificial Sequence
  Synthetic construct
GVGPGRF

SEQ ID NO: 3097 - protein, 7 aa, Artificial Sequence
  Synthetic construct
GVGPGRY

SEQ ID NO: 3098 - protein, 7 aa, Artificial Sequence
  Synthetic construct
GVGPGCF

SEQ ID NO: 3099 - protein, 7 aa, Artificial Sequence
  Synthetic construct
GVGPGCY

SEQ ID NO: 3100 - protein, 7 aa, Artificial Sequence
  Synthetic construct
GVGPGLF

SEQ ID NO: 3101 - protein, 7 aa, Artificial Sequence
  Synthetic construct
GVGPGLY

SEQ ID NO: 3102 - protein, 7 aa, Artificial Sequence
  Synthetic construct
GVGPGAF

SEQ ID NO: 3103 - protein, 7 aa, Artificial Sequence
  Synthetic construct
GVGPGAY

SEQ ID NO: 3104 - protein, 7 aa, Artificial Sequence
  Synthetic construct
GVGPGQF

SEQ ID NO: 3105 - protein, 7 aa, Artificial Sequence
  Synthetic construct
GVGPGQY

SEQ ID NO: 3106 - protein, 7 aa, Artificial Sequence
  Synthetic construct
GVGPGDF

SEQ ID NO: 3107 - protein, 7 aa, Artificial Sequence
  Synthetic construct
GVGPGDY

SEQ ID NO: 3108 - protein, 7 aa, Artificial Sequence
  Synthetic construct
GVGPGVF

SEQ ID NO: 3109 - protein, 7 aa, Artificial Sequence
  Synthetic construct
GVGPGVY

SEQ ID NO: 3110 - protein, 7 aa, Artificial Sequence
  Synthetic construct
GVGPAFF

SEQ ID NO: 3111 - protein, 7 aa, Artificial Sequence
  Synthetic construct
GVGPAFY

SEQ ID NO: 3112 - protein, 7 aa, Artificial Sequence
  Synthetic construct
GVGPARF

SEQ ID NO: 3113 - protein, 7 aa, Artificial Sequence
  Synthetic construct
GVGPARY

SEQ ID NO: 3114 - protein, 7 aa, Artificial Sequence
  Synthetic construct
GVGPACF

SEQ ID NO: 3115 - protein, 7 aa, Artificial Sequence
  Synthetic construct
GVGPACY

SEQ ID NO: 3116 - protein, 7 aa, Artificial Sequence
  Synthetic construct
GVGPALF

SEQ ID NO: 3117 - protein, 7 aa, Artificial Sequence
  Synthetic construct
GVGPALY

SEQ ID NO: 3118 - protein, 7 aa, Artificial Sequence
  Synthetic construct
GVGPAAF

SEQ ID NO: 3119 - protein, 7 aa, Artificial Sequence
  Synthetic construct
GVGPAAY

SEQ ID NO: 3120 - protein, 7 aa, Artificial Sequence
  Synthetic construct
GVGPAQF

SEQ ID NO: 3121 - protein, 7 aa, Artificial Sequence
  Synthetic construct
GVGPAQY

SEQ ID NO: 3122 - protein, 7 aa, Artificial Sequence
  Synthetic construct
GVGPADF

SEQ ID NO: 3123 - protein, 7 aa, Artificial Sequence
  Synthetic construct
GVGPADY

SEQ ID NO: 3124 - protein, 7 aa, Artificial Sequence
  Synthetic construct
GVGPAVF

SEQ ID NO: 3125 - protein, 7 aa, Artificial Sequence
  Synthetic construct
GVGPAVY

SEQ ID NO: 3126 - protein, 7 aa, Artificial Sequence
  Synthetic construct
GVGPQFF

SEQ ID NO: 3127 - protein, 7 aa, Artificial Sequence
  Synthetic construct
GVGPQFY

SEQ ID NO: 3128 - protein, 7 aa, Artificial Sequence
  Synthetic construct
GVGPQRF

SEQ ID NO: 3129 - protein, 7 aa, Artificial Sequence
  Synthetic construct
GVGPQRY

SEQ ID NO: 3130 - protein, 7 aa, Artificial Sequence
  Synthetic construct
GVGPQCF

SEQ ID NO: 3131 - protein, 7 aa, Artificial Sequence
  Synthetic construct
GVGPQCY

SEQ ID NO: 3132 - protein, 7 aa, Artificial Sequence
  Synthetic construct
GVGPQLF

SEQ ID NO: 3133 - protein, 7 aa, Artificial Sequence
  Synthetic construct
GVGPQLY

SEQ ID NO: 3134 - protein, 7 aa, Artificial Sequence
  Synthetic construct
GVGPQAF

SEQ ID NO: 3135 - protein, 7 aa, Artificial Sequence
  Synthetic construct
GVGPQAY

SEQ ID NO: 3136 - protein, 7 aa, Artificial Sequence
  Synthetic construct
GVGPQQF

SEQ ID NO: 3137 - protein, 7 aa, Artificial Sequence
  Synthetic construct
GVGPQQY

SEQ ID NO: 3138 - protein, 7 aa, Artificial Sequence
  Synthetic construct
GVGPQDF

SEQ ID NO: 3139 - protein, 7 aa, Artificial Sequence
  Synthetic construct
GVGPQDY

SEQ ID NO: 3140 - protein, 7 aa, Artificial Sequence
  Synthetic construct
GVGPQVF

SEQ ID NO: 3141 - protein, 7 aa, Artificial Sequence
  Synthetic construct
GVGPQVY

SEQ ID NO: 3142 - protein, 7 aa, Artificial Sequence
  Synthetic construct
GVGHIFF

SEQ ID NO: 3143 - protein, 7 aa, Artificial Sequence
  Synthetic construct
GVGHIFY

SEQ ID NO: 3144 - protein, 7 aa, Artificial Sequence
  Synthetic construct
GVGHIRF

SEQ ID NO: 3145 - protein, 7 aa, Artificial Sequence
  Synthetic construct
GVGHIRY

SEQ ID NO: 3146 - protein, 7 aa, Artificial Sequence
  Synthetic construct
GVGHICF

SEQ ID NO: 3147 - protein, 7 aa, Artificial Sequence
  Synthetic construct
GVGHICY

SEQ ID NO: 3148 - protein, 7 aa, Artificial Sequence
  Synthetic construct
GVGHILF

SEQ ID NO: 3149 - protein, 7 aa, Artificial Sequence
  Synthetic construct
GVGHILY

SEQ ID NO: 3150 - protein, 7 aa, Artificial Sequence
  Synthetic construct
GVGHIAF

SEQ ID NO: 3151 - protein, 7 aa, Artificial Sequence
  Synthetic construct
GVGHIAY

SEQ ID NO: 3152 - protein, 7 aa, Artificial Sequence
  Synthetic construct
GVGHIQF

SEQ ID NO: 3153 - protein, 7 aa, Artificial Sequence
  Synthetic construct
GVGHIQY

SEQ ID NO: 3154 - protein, 7 aa, Artificial Sequence
  Synthetic construct
GVGHIDF

SEQ ID NO: 3155 - protein, 7 aa, Artificial Sequence
  Synthetic construct
GVGHIDY

SEQ ID NO: 3156 - protein, 7 aa, Artificial Sequence
  Synthetic construct
GVGHIVF

SEQ ID NO: 3157 - protein, 7 aa, Artificial Sequence
  Synthetic construct
GVGHIVY

SEQ ID NO: 3158 - protein, 7 aa, Artificial Sequence
  Synthetic construct
GVGHDFF

SEQ ID NO: 3159 - protein, 7 aa, Artificial Sequence
  Synthetic construct
GVGHDFY

SEQ ID NO: 3160 - protein, 7 aa, Artificial Sequence
  Synthetic construct
GVGHDRF

SEQ ID NO: 3161 - protein, 7 aa, Artificial Sequence
  Synthetic construct
GVGHDRY

SEQ ID NO: 3162 - protein, 7 aa, Artificial Sequence
  Synthetic construct
GVGHDCF

SEQ ID NO: 3163 - protein, 7 aa, Artificial Sequence
  Synthetic construct
GVGHDCY

SEQ ID NO: 3164 - protein, 7 aa, Artificial Sequence
  Synthetic construct
GVGHDLF

SEQ ID NO: 3165 - protein, 7 aa, Artificial Sequence
  Synthetic construct
GVGHDLY

SEQ ID NO: 3166 - protein, 7 aa, Artificial Sequence
  Synthetic construct
GVGHDAF

SEQ ID NO: 3167 - protein, 7 aa, Artificial Sequence
  Synthetic construct
GVGHDAY

SEQ ID NO: 3168 - protein, 7 aa, Artificial Sequence
  Synthetic construct
GVGHDQF

SEQ ID NO: 3169 - protein, 7 aa, Artificial Sequence
  Synthetic construct
GVGHDQY

SEQ ID NO: 3170 - protein, 7 aa, Artificial Sequence
  Synthetic construct
GVGHDDF

SEQ ID NO: 3171 - protein, 7 aa, Artificial Sequence
  Synthetic construct
GVGHDDY

SEQ ID NO: 3172 - protein, 7 aa, Artificial Sequence
  Synthetic construct
GVGHDVF

SEQ ID NO: 3173 - protein, 7 aa, Artificial Sequence
  Synthetic construct
GVGHDVY

SEQ ID NO: 3174 - protein, 7 aa, Artificial Sequence
  Synthetic construct
GVGHYFF

SEQ ID NO: 3175 - protein, 7 aa, Artificial Sequence
  Synthetic construct
GVGHYFY

SEQ ID NO: 3176 - protein, 7 aa, Artificial Sequence
  Synthetic construct
GVGHYRF

SEQ ID NO: 3177 - protein, 7 aa, Artificial Sequence
  Synthetic construct
GVGHYRY

SEQ ID NO: 3178 - protein, 7 aa, Artificial Sequence
  Synthetic construct
GVGHYCF

SEQ ID NO: 3179 - protein, 7 aa, Artificial Sequence
  Synthetic construct
GVGHYCY

SEQ ID NO: 3180 - protein, 7 aa, Artificial Sequence
  Synthetic construct
GVGHYLF

SEQ ID NO: 3181 - protein, 7 aa, Artificial Sequence
  Synthetic construct
GVGHYLY

SEQ ID NO: 3182 - protein, 7 aa, Artificial Sequence
  Synthetic construct
GVGHYAF

SEQ ID NO: 3183 - protein, 7 aa, Artificial Sequence
  Synthetic construct
GVGHYAY

SEQ ID NO: 3184 - protein, 7 aa, Artificial Sequence
  Synthetic construct
GVGHYQF

SEQ ID NO: 3185 - protein, 7 aa, Artificial Sequence
  Synthetic construct
GVGHYQY

SEQ ID NO: 3186 - protein, 7 aa, Artificial Sequence
  Synthetic construct
GVGHYDF

SEQ ID NO: 3187 - protein, 7 aa, Artificial Sequence
  Synthetic construct
GVGHYDY

SEQ ID NO: 3188 - protein, 7 aa, Artificial Sequence
  Synthetic construct
GVGHYVF

SEQ ID NO: 3189 - protein, 7 aa, Artificial Sequence
  Synthetic construct
GVGHYVY

SEQ ID NO: 3190 - protein, 7 aa, Artificial Sequence
  Synthetic construct
GVGHFFF

SEQ ID NO: 3191 - protein, 7 aa, Artificial Sequence
  Synthetic construct
GVGHFFY

SEQ ID NO: 3192 - protein, 7 aa, Artificial Sequence
  Synthetic construct
GVGHFRF

SEQ ID NO: 3193 - protein, 7 aa, Artificial Sequence
  Synthetic construct
GVGHFRY

SEQ ID NO: 3194 - protein, 7 aa, Artificial Sequence
  Synthetic construct
GVGHFCF

SEQ ID NO: 3195 - protein, 7 aa, Artificial Sequence
  Synthetic construct
GVGHFCY

SEQ ID NO: 3196 - protein, 7 aa, Artificial Sequence
  Synthetic construct
GVGHFLF

SEQ ID NO: 3197 - protein, 7 aa, Artificial Sequence
  Synthetic construct
GVGHFLY

SEQ ID NO: 3198 - protein, 7 aa, Artificial Sequence
  Synthetic construct
GVGHFAF

SEQ ID NO: 3199 - protein, 7 aa, Artificial Sequence
  Synthetic construct
GVGHFAY

SEQ ID NO: 3200 - protein, 7 aa, Artificial Sequence
  Synthetic construct
GVGHFQF

SEQ ID NO: 3201 - protein, 7 aa, Artificial Sequence
  Synthetic construct
GVGHFQY

SEQ ID NO: 3202 - protein, 7 aa, Artificial Sequence
  Synthetic construct
GVGHFDF

SEQ ID NO: 3203 - protein, 7 aa, Artificial Sequence
  Synthetic construct
GVGHFDY

SEQ ID NO: 3204 - protein, 7 aa, Artificial Sequence
  Synthetic construct
GVGHFVF

SEQ ID NO: 3205 - protein, 7 aa, Artificial Sequence
  Synthetic construct
GVGHFVY

SEQ ID NO: 3206 - protein, 7 aa, Artificial Sequence
  Synthetic construct
GVGHVFF

SEQ ID NO: 3207 - protein, 7 aa, Artificial Sequence
  Synthetic construct
GVGHVFY

SEQ ID NO: 3208 - protein, 7 aa, Artificial Sequence
  Synthetic construct
GVGHVRF

SEQ ID NO: 3209 - protein, 7 aa, Artificial Sequence
  Synthetic construct
GVGHVRY

SEQ ID NO: 3210 - protein, 7 aa, Artificial Sequence
  Synthetic construct
GVGHVCF

SEQ ID NO: 3211 - protein, 7 aa, Artificial Sequence
  Synthetic construct
GVGHVCY

SEQ ID NO: 3212 - protein, 7 aa, Artificial Sequence
  Synthetic construct
GVGHVLF

SEQ ID NO: 3213 - protein, 7 aa, Artificial Sequence
  Synthetic construct
GVGHVLY

SEQ ID NO: 3214 - protein, 7 aa, Artificial Sequence
  Synthetic construct
GVGHVAF

SEQ ID NO: 3215 - protein, 7 aa, Artificial Sequence
  Synthetic construct
GVGHVAY

SEQ ID NO: 3216 - protein, 7 aa, Artificial Sequence
  Synthetic construct
GVGHVQF

SEQ ID NO: 3217 - protein, 7 aa, Artificial Sequence
  Synthetic construct
GVGHVQY

SEQ ID NO: 3218 - protein, 7 aa, Artificial Sequence
  Synthetic construct
GVGHVDF

SEQ ID NO: 3219 - protein, 7 aa, Artificial Sequence
  Synthetic construct
GVGHVDY

SEQ ID NO: 3220 - protein, 7 aa, Artificial Sequence
  Synthetic construct
GVGHVVF

SEQ ID NO: 3221 - protein, 7 aa, Artificial Sequence
  Synthetic construct
GVGHVVY

SEQ ID NO: 3222 - protein, 7 aa, Artificial Sequence
  Synthetic construct
GVGHTFF

SEQ ID NO: 3223 - protein, 7 aa, Artificial Sequence
  Synthetic construct
GVGHTFY

SEQ ID NO: 3224 - protein, 7 aa, Artificial Sequence
  Synthetic construct
GVGHTRF

SEQ ID NO: 3225 - protein, 7 aa, Artificial Sequence
  Synthetic construct
GVGHTRY

SEQ ID NO: 3226 - protein, 7 aa, Artificial Sequence
  Synthetic construct
GVGHTCF

SEQ ID NO: 3227 - protein, 7 aa, Artificial Sequence
  Synthetic construct
GVGHTCY

SEQ ID NO: 3228 - protein, 7 aa, Artificial Sequence
  Synthetic construct
GVGHTLF

SEQ ID NO: 3229 - protein, 7 aa, Artificial Sequence
  Synthetic construct
GVGHTLY

SEQ ID NO: 3230 - protein, 7 aa, Artificial Sequence
  Synthetic construct
GVGHTAF

SEQ ID NO: 3231 - protein, 7 aa, Artificial Sequence
  Synthetic construct
GVGHTAY

SEQ ID NO: 3232 - protein, 7 aa, Artificial Sequence
  Synthetic construct
GVGHTQF

SEQ ID NO: 3233 - protein, 7 aa, Artificial Sequence
  Synthetic construct
GVGHTQY

SEQ ID NO: 3234 - protein, 7 aa, Artificial Sequence
  Synthetic construct
GVGHTDF

SEQ ID NO: 3235 - protein, 7 aa, Artificial Sequence
  Synthetic construct
GVGHTDY

SEQ ID NO: 3236 - protein, 7 aa, Artificial Sequence
  Synthetic construct
GVGHTVF

SEQ ID NO: 3237 - protein, 7 aa, Artificial Sequence
  Synthetic construct
GVGHTVY

SEQ ID NO: 3238 - protein, 7 aa, Artificial Sequence
  Synthetic construct
GVGHGFF

SEQ ID NO: 3239 - protein, 7 aa, Artificial Sequence
  Synthetic construct
GVGHGFY

SEQ ID NO: 3240 - protein, 7 aa, Artificial Sequence
  Synthetic construct
GVGHGRF

SEQ ID NO: 3241 - protein, 7 aa, Artificial Sequence
  Synthetic construct
GVGHGRY

SEQ ID NO: 3242 - protein, 7 aa, Artificial Sequence
  Synthetic construct
GVGHGCF

SEQ ID NO: 3243 - protein, 7 aa, Artificial Sequence
  Synthetic construct
GVGHGCY

SEQ ID NO: 3244 - protein, 7 aa, Artificial Sequence
  Synthetic construct
GVGHGLF

SEQ ID NO: 3245 - protein, 7 aa, Artificial Sequence
  Synthetic construct
GVGHGLY

SEQ ID NO: 3246 - protein, 7 aa, Artificial Sequence
  Synthetic construct
GVGHGAF

SEQ ID NO: 3247 - protein, 7 aa, Artificial Sequence
  Synthetic construct
GVGHGAY

SEQ ID NO: 3248 - protein, 7 aa, Artificial Sequence
  Synthetic construct
GVGHGQF

SEQ ID NO: 3249 - protein, 7 aa, Artificial Sequence
  Synthetic construct
GVGHGQY

SEQ ID NO: 3250 - protein, 7 aa, Artificial Sequence
  Synthetic construct
GVGHGDF

SEQ ID NO: 3251 - protein, 7 aa, Artificial Sequence
  Synthetic construct
GVGHGDY

SEQ ID NO: 3252 - protein, 7 aa, Artificial Sequence
  Synthetic construct
GVGHGVF

SEQ ID NO: 3253 - protein, 7 aa, Artificial Sequence
  Synthetic construct
GVGHGVY

SEQ ID NO: 3254 - protein, 7 aa, Artificial Sequence
  Synthetic construct
GVGHAFF

SEQ ID NO: 3255 - protein, 7 aa, Artificial Sequence
  Synthetic construct
GVGHAFY

SEQ ID NO: 3256 - protein, 7 aa, Artificial Sequence
  Synthetic construct
GVGHARF

SEQ ID NO: 3257 - protein, 7 aa, Artificial Sequence
  Synthetic construct
GVGHARY

SEQ ID NO: 3258 - protein, 7 aa, Artificial Sequence
  Synthetic construct
GVGHACF

SEQ ID NO: 3259 - protein, 7 aa, Artificial Sequence
  Synthetic construct
GVGHACY

SEQ ID NO: 3260 - protein, 7 aa, Artificial Sequence
  Synthetic construct
GVGHALF

SEQ ID NO: 3261 - protein, 7 aa, Artificial Sequence
  Synthetic construct
GVGHALY

SEQ ID NO: 3262 - protein, 7 aa, Artificial Sequence
  Synthetic construct
GVGHAAF

SEQ ID NO: 3263 - protein, 7 aa, Artificial Sequence
  Synthetic construct
GVGHAAY

SEQ ID NO: 3264 - protein, 7 aa, Artificial Sequence
  Synthetic construct
GVGHAQF

SEQ ID NO: 3265 - protein, 7 aa, Artificial Sequence
  Synthetic construct
GVGHAQY

SEQ ID NO: 3266 - protein, 7 aa, Artificial Sequence
  Synthetic construct
GVGHADF

SEQ ID NO: 3267 - protein, 7 aa, Artificial Sequence
  Synthetic construct
GVGHADY

SEQ ID NO: 3268 - protein, 7 aa, Artificial Sequence
  Synthetic construct
GVGHAVF

SEQ ID NO: 3269 - protein, 7 aa, Artificial Sequence
  Synthetic construct
GVGHAVY

SEQ ID NO: 3270 - protein, 7 aa, Artificial Sequence
  Synthetic construct
GVGHQFF

SEQ ID NO: 3271 - protein, 7 aa, Artificial Sequence
  Synthetic construct
GVGHQFY

SEQ ID NO: 3272 - protein, 7 aa, Artificial Sequence
  Synthetic construct
GVGHQRF

SEQ ID NO: 3273 - protein, 7 aa, Artificial Sequence
  Synthetic construct
GVGHQRY

SEQ ID NO: 3274 - protein, 7 aa, Artificial Sequence
  Synthetic construct
GVGHQCF

SEQ ID NO: 3275 - protein, 7 aa, Artificial Sequence
  Synthetic construct
GVGHQCY

SEQ ID NO: 3276 - protein, 7 aa, Artificial Sequence
  Synthetic construct
GVGHQLF

SEQ ID NO: 3277 - protein, 7 aa, Artificial Sequence
  Synthetic construct
GVGHQLY

SEQ ID NO: 3278 - protein, 7 aa, Artificial Sequence
  Synthetic construct
GVGHQAF

SEQ ID NO: 3279 - protein, 7 aa, Artificial Sequence
  Synthetic construct
GVGHQAY

SEQ ID NO: 3280 - protein, 7 aa, Artificial Sequence
  Synthetic construct
GVGHQQF

SEQ ID NO: 3281 - protein, 7 aa, Artificial Sequence
  Synthetic construct
GVGHQQY

SEQ ID NO: 3282 - protein, 7 aa, Artificial Sequence
  Synthetic construct
GVGHQDF

SEQ ID NO: 3283 - protein, 7 aa, Artificial Sequence
  Synthetic construct
GVGHQDY

SEQ ID NO: 3284 - protein, 7 aa, Artificial Sequence
  Synthetic construct
GVGHQVF

SEQ ID NO: 3285 - protein, 7 aa, Artificial Sequence
  Synthetic construct
GVGHQVY

SEQ ID NO: 3286 - protein, 7 aa, Artificial Sequence
  Synthetic construct
GVGLIFF

SEQ ID NO: 3287 - protein, 7 aa, Artificial Sequence
  Synthetic construct
GVGLIFY

SEQ ID NO: 3288 - protein, 7 aa, Artificial Sequence
  Synthetic construct
GVGLIRF

SEQ ID NO: 3289 - protein, 7 aa, Artificial Sequence
  Synthetic construct
GVGLIRY

SEQ ID NO: 3290 - protein, 7 aa, Artificial Sequence
  Synthetic construct
GVGLICF

SEQ ID NO: 3291 - protein, 7 aa, Artificial Sequence
  Synthetic construct
GVGLICY

SEQ ID NO: 3292 - protein, 7 aa, Artificial Sequence
  Synthetic construct
GVGLILF

SEQ ID NO: 3293 - protein, 7 aa, Artificial Sequence
  Synthetic construct
GVGLILY

SEQ ID NO: 3294 - protein, 7 aa, Artificial Sequence
  Synthetic construct
GVGLIAF

SEQ ID NO: 3295 - protein, 7 aa, Artificial Sequence
  Synthetic construct
GVGLIAY

SEQ ID NO: 3296 - protein, 7 aa, Artificial Sequence
  Synthetic construct
GVGLIQF

SEQ ID NO: 3297 - protein, 7 aa, Artificial Sequence
  Synthetic construct
GVGLIQY

SEQ ID NO: 3298 - protein, 7 aa, Artificial Sequence
  Synthetic construct
GVGLIDF

SEQ ID NO: 3299 - protein, 7 aa, Artificial Sequence
  Synthetic construct
GVGLIDY

SEQ ID NO: 3300 - protein, 7 aa, Artificial Sequence
  Synthetic construct
GVGLIVF

SEQ ID NO: 3301 - protein, 7 aa, Artificial Sequence
  Synthetic construct
GVGLIVY

SEQ ID NO: 3302 - protein, 7 aa, Artificial Sequence
  Synthetic construct
GVGLDFF

SEQ ID NO: 3303 - protein, 7 aa, Artificial Sequence
  Synthetic construct
GVGLDFY

SEQ ID NO: 3304 - protein, 7 aa, Artificial Sequence
  Synthetic construct
GVGLDRF

SEQ ID NO: 3305 - protein, 7 aa, Artificial Sequence
  Synthetic construct
GVGLDRY

SEQ ID NO: 3306 - protein, 7 aa, Artificial Sequence
  Synthetic construct
GVGLDCF

SEQ ID NO: 3307 - protein, 7 aa, Artificial Sequence
  Synthetic construct
GVGLDCY

SEQ ID NO: 3308 - protein, 7 aa, Artificial Sequence
  Synthetic construct
GVGLDLF

SEQ ID NO: 3309 - protein, 7 aa, Artificial Sequence
  Synthetic construct
GVGLDLY

SEQ ID NO: 3310 - protein, 7 aa, Artificial Sequence
  Synthetic construct
GVGLDAF

SEQ ID NO: 3311 - protein, 7 aa, Artificial Sequence
  Synthetic construct
GVGLDAY

SEQ ID NO: 3312 - protein, 7 aa, Artificial Sequence
  Synthetic construct
GVGLDQF

SEQ ID NO: 3313 - protein, 7 aa, Artificial Sequence
  Synthetic construct
GVGLDQY

SEQ ID NO: 3314 - protein, 7 aa, Artificial Sequence
  Synthetic construct
GVGLDDF

SEQ ID NO: 3315 - protein, 7 aa, Artificial Sequence
  Synthetic construct
GVGLDDY

SEQ ID NO: 3316 - protein, 7 aa, Artificial Sequence
  Synthetic construct
GVGLDVF

SEQ ID NO: 3317 - protein, 7 aa, Artificial Sequence
  Synthetic construct
GVGLDVY

SEQ ID NO: 3318 - protein, 7 aa, Artificial Sequence
  Synthetic construct
GVGLYFF

SEQ ID NO: 3319 - protein, 7 aa, Artificial Sequence
  Synthetic construct
GVGLYFY

SEQ ID NO: 3320 - protein, 7 aa, Artificial Sequence
  Synthetic construct
GVGLYRF

SEQ ID NO: 3321 - protein, 7 aa, Artificial Sequence
  Synthetic construct
GVGLYRY

SEQ ID NO: 3322 - protein, 7 aa, Artificial Sequence
  Synthetic construct
GVGLYCF

SEQ ID NO: 3323 - protein, 7 aa, Artificial Sequence
  Synthetic construct
GVGLYCY

SEQ ID NO: 3324 - protein, 7 aa, Artificial Sequence
  Synthetic construct
GVGLYLF

SEQ ID NO: 3325 - protein, 7 aa, Artificial Sequence
  Synthetic construct
GVGLYLY

SEQ ID NO: 3326 - protein, 7 aa, Artificial Sequence
  Synthetic construct
GVGLYAF

SEQ ID NO: 3327 - protein, 7 aa, Artificial Sequence
  Synthetic construct
GVGLYAY

SEQ ID NO: 3328 - protein, 7 aa, Artificial Sequence
  Synthetic construct
GVGLYQF

SEQ ID NO: 3329 - protein, 7 aa, Artificial Sequence
  Synthetic construct
GVGLYQY

SEQ ID NO: 3330 - protein, 7 aa, Artificial Sequence
  Synthetic construct
GVGLYDF

SEQ ID NO: 3331 - protein, 7 aa, Artificial Sequence
  Synthetic construct
GVGLYDY

SEQ ID NO: 3332 - protein, 7 aa, Artificial Sequence
  Synthetic construct
GVGLYVF

SEQ ID NO: 3333 - protein, 7 aa, Artificial Sequence
  Synthetic construct
GVGLYVY

SEQ ID NO: 3334 - protein, 7 aa, Artificial Sequence
  Synthetic construct
GVGLFFF

SEQ ID NO: 3335 - protein, 7 aa, Artificial Sequence
  Synthetic construct
GVGLFFY

SEQ ID NO: 3336 - protein, 7 aa, Artificial Sequence
  Synthetic construct
GVGLFRF

SEQ ID NO: 3337 - protein, 7 aa, Artificial Sequence
  Synthetic construct
GVGLFRY

SEQ ID NO: 3338 - protein, 7 aa, Artificial Sequence
  Synthetic construct
GVGLFCF

SEQ ID NO: 3339 - protein, 7 aa, Artificial Sequence
  Synthetic construct
GVGLFCY

SEQ ID NO: 3340 - protein, 7 aa, Artificial Sequence
  Synthetic construct
GVGLFLF

SEQ ID NO: 3341 - protein, 7 aa, Artificial Sequence
  Synthetic construct
GVGLFLY

SEQ ID NO: 3342 - protein, 7 aa, Artificial Sequence
  Synthetic construct
GVGLFAF

SEQ ID NO: 3343 - protein, 7 aa, Artificial Sequence
  Synthetic construct
GVGLFAY

SEQ ID NO: 3344 - protein, 7 aa, Artificial Sequence
  Synthetic construct
GVGLFQF

SEQ ID NO: 3345 - protein, 7 aa, Artificial Sequence
  Synthetic construct
GVGLFQY

SEQ ID NO: 3346 - protein, 7 aa, Artificial Sequence
  Synthetic construct
GVGLFDF

SEQ ID NO: 3347 - protein, 7 aa, Artificial Sequence
  Synthetic construct
GVGLFDY

SEQ ID NO: 3348 - protein, 7 aa, Artificial Sequence
  Synthetic construct
GVGLFVF

SEQ ID NO: 3349 - protein, 7 aa, Artificial Sequence
  Synthetic construct
GVGLFVY

SEQ ID NO: 3350 - protein, 7 aa, Artificial Sequence
  Synthetic construct
GVGLVFF

SEQ ID NO: 3351 - protein, 7 aa, Artificial Sequence
  Synthetic construct
GVGLVFY

SEQ ID NO: 3352 - protein, 7 aa, Artificial Sequence
  Synthetic construct
GVGLVRF

SEQ ID NO: 3353 - protein, 7 aa, Artificial Sequence
  Synthetic construct
GVGLVRY

SEQ ID NO: 3354 - protein, 7 aa, Artificial Sequence
  Synthetic construct
GVGLVCF

SEQ ID NO: 3355 - protein, 7 aa, Artificial Sequence
  Synthetic construct
GVGLVCY

SEQ ID NO: 3356 - protein, 7 aa, Artificial Sequence
  Synthetic construct
GVGLVLF

SEQ ID NO: 3357 - protein, 7 aa, Artificial Sequence
  Synthetic construct
GVGLVLY

SEQ ID NO: 3358 - protein, 7 aa, Artificial Sequence
  Synthetic construct
GVGLVAF

SEQ ID NO: 3359 - protein, 7 aa, Artificial Sequence
  Synthetic construct
GVGLVAY

SEQ ID NO: 3360 - protein, 7 aa, Artificial Sequence
  Synthetic construct
GVGLVQF

SEQ ID NO: 3361 - protein, 7 aa, Artificial Sequence
  Synthetic construct
GVGLVQY

SEQ ID NO: 3362 - protein, 7 aa, Artificial Sequence
  Synthetic construct
GVGLVDF

SEQ ID NO: 3363 - protein, 7 aa, Artificial Sequence
  Synthetic construct
GVGLVDY

SEQ ID NO: 3364 - protein, 7 aa, Artificial Sequence
  Synthetic construct
GVGLVVF

SEQ ID NO: 3365 - protein, 7 aa, Artificial Sequence
  Synthetic construct
GVGLVVY

SEQ ID NO: 3366 - protein, 7 aa, Artificial Sequence
  Synthetic construct
GVGLTFF

SEQ ID NO: 3367 - protein, 7 aa, Artificial Sequence
  Synthetic construct
GVGLTFY

SEQ ID NO: 3368 - protein, 7 aa, Artificial Sequence
  Synthetic construct
GVGLTRF

SEQ ID NO: 3369 - protein, 7 aa, Artificial Sequence
  Synthetic construct
GVGLTRY

SEQ ID NO: 3370 - protein, 7 aa, Artificial Sequence
  Synthetic construct
GVGLTCF

SEQ ID NO: 3371 - protein, 7 aa, Artificial Sequence
  Synthetic construct
GVGLTCY

SEQ ID NO: 3372 - protein, 7 aa, Artificial Sequence
  Synthetic construct
GVGLTLF

SEQ ID NO: 3373 - protein, 7 aa, Artificial Sequence
  Synthetic construct
GVGLTLY

SEQ ID NO: 3374 - protein, 7 aa, Artificial Sequence
  Synthetic construct
GVGLTAF

SEQ ID NO: 3375 - protein, 7 aa, Artificial Sequence
  Synthetic construct
GVGLTAY

SEQ ID NO: 3376 - protein, 7 aa, Artificial Sequence
  Synthetic construct
GVGLTQF

SEQ ID NO: 3377 - protein, 7 aa, Artificial Sequence
  Synthetic construct
GVGLTQY

SEQ ID NO: 3378 - protein, 7 aa, Artificial Sequence
  Synthetic construct
GVGLTDF

SEQ ID NO: 3379 - protein, 7 aa, Artificial Sequence
  Synthetic construct
GVGLTDY

SEQ ID NO: 3380 - protein, 7 aa, Artificial Sequence
  Synthetic construct
GVGLTVF

SEQ ID NO: 3381 - protein, 7 aa, Artificial Sequence
  Synthetic construct
GVGLTVY

SEQ ID NO: 3382 - protein, 7 aa, Artificial Sequence
  Synthetic construct
GVGLGFF

SEQ ID NO: 3383 - protein, 7 aa, Artificial Sequence
  Synthetic construct
GVGLGFY

SEQ ID NO: 3384 - protein, 7 aa, Artificial Sequence
  Synthetic construct
GVGLGRF

SEQ ID NO: 3385 - protein, 7 aa, Artificial Sequence
  Synthetic construct
GVGLGRY

SEQ ID NO: 3386 - protein, 7 aa, Artificial Sequence
  Synthetic construct
GVGLGCF

SEQ ID NO: 3387 - protein, 7 aa, Artificial Sequence
  Synthetic construct
GVGLGCY

SEQ ID NO: 3388 - protein, 7 aa, Artificial Sequence
  Synthetic construct
GVGLGLF

SEQ ID NO: 3389 - protein, 7 aa, Artificial Sequence
  Synthetic construct
GVGLGLY

SEQ ID NO: 3390 - protein, 7 aa, Artificial Sequence
  Synthetic construct
GVGLGAF

SEQ ID NO: 3391 - protein, 7 aa, Artificial Sequence
  Synthetic construct
GVGLGAY

SEQ ID NO: 3392 - protein, 7 aa, Artificial Sequence
  Synthetic construct
GVGLGQF

SEQ ID NO: 3393 - protein, 7 aa, Artificial Sequence
  Synthetic construct
GVGLGQY

SEQ ID NO: 3394 - protein, 7 aa, Artificial Sequence
  Synthetic construct
GVGLGDF

SEQ ID NO: 3395 - protein, 7 aa, Artificial Sequence
  Synthetic construct
GVGLGDY

SEQ ID NO: 3396 - protein, 7 aa, Artificial Sequence
  Synthetic construct
GVGLGVF

SEQ ID NO: 3397 - protein, 7 aa, Artificial Sequence
  Synthetic construct
GVGLGVY

SEQ ID NO: 3398 - protein, 7 aa, Artificial Sequence
  Synthetic construct
GVGLAFF

SEQ ID NO: 3399 - protein, 7 aa, Artificial Sequence
  Synthetic construct
GVGLAFY

SEQ ID NO: 3400 - protein, 7 aa, Artificial Sequence
  Synthetic construct
GVGLARF

SEQ ID NO: 3401 - protein, 7 aa, Artificial Sequence
  Synthetic construct
GVGLARY

SEQ ID NO: 3402 - protein, 7 aa, Artificial Sequence
  Synthetic construct
GVGLACF

SEQ ID NO: 3403 - protein, 7 aa, Artificial Sequence
  Synthetic construct
GVGLACY

SEQ ID NO: 3404 - protein, 7 aa, Artificial Sequence
  Synthetic construct
GVGLALF

SEQ ID NO: 3405 - protein, 7 aa, Artificial Sequence
  Synthetic construct
GVGLALY

SEQ ID NO: 3406 - protein, 7 aa, Artificial Sequence
  Synthetic construct
GVGLAAF

SEQ ID NO: 3407 - protein, 7 aa, Artificial Sequence
  Synthetic construct
GVGLAAY

SEQ ID NO: 3408 - protein, 7 aa, Artificial Sequence
  Synthetic construct
GVGLAQF

SEQ ID NO: 3409 - protein, 7 aa, Artificial Sequence
  Synthetic construct
GVGLAQY

SEQ ID NO: 3410 - protein, 7 aa, Artificial Sequence
  Synthetic construct
GVGLADF

SEQ ID NO: 3411 - protein, 7 aa, Artificial Sequence
  Synthetic construct
GVGLADY

SEQ ID NO: 3412 - protein, 7 aa, Artificial Sequence
  Synthetic construct
GVGLAVF

SEQ ID NO: 3413 - protein, 7 aa, Artificial Sequence
  Synthetic construct
GVGLAVY

SEQ ID NO: 3414 - protein, 7 aa, Artificial Sequence
  Synthetic construct
GVGLQFF

SEQ ID NO: 3415 - protein, 7 aa, Artificial Sequence
  Synthetic construct
GVGLQFY

SEQ ID NO: 3416 - protein, 7 aa, Artificial Sequence
  Synthetic construct
GVGLQRF

SEQ ID NO: 3417 - protein, 7 aa, Artificial Sequence
  Synthetic construct
GVGLQRY

SEQ ID NO: 3418 - protein, 7 aa, Artificial Sequence
  Synthetic construct
GVGLQCF

SEQ ID NO: 3419 - protein, 7 aa, Artificial Sequence
  Synthetic construct
GVGLQCY

SEQ ID NO: 3420 - protein, 7 aa, Artificial Sequence
  Synthetic construct
GVGLQLF

SEQ ID NO: 3421 - protein, 7 aa, Artificial Sequence
  Synthetic construct
GVGLQLY

SEQ ID NO: 3422 - protein, 7 aa, Artificial Sequence
  Synthetic construct
GVGLQAF

SEQ ID NO: 3423 - protein, 7 aa, Artificial Sequence
  Synthetic construct
GVGLQAY

SEQ ID NO: 3424 - protein, 7 aa, Artificial Sequence
  Synthetic construct
GVGLQQF

SEQ ID NO: 3425 - protein, 7 aa, Artificial Sequence
  Synthetic construct
GVGLQQY

SEQ ID NO: 3426 - protein, 7 aa, Artificial Sequence
  Synthetic construct
GVGLQDF

SEQ ID NO: 3427 - protein, 7 aa, Artificial Sequence
  Synthetic construct
GVGLQDY

SEQ ID NO: 3428 - protein, 7 aa, Artificial Sequence
  Synthetic construct
GVGLQVF

SEQ ID NO: 3429 - protein, 7 aa, Artificial Sequence
  Synthetic construct
GVGLQVY

SEQ ID NO: 3430 - protein, 7 aa, Artificial Sequence
  Synthetic construct
GVGFIFF

SEQ ID NO: 3431 - protein, 7 aa, Artificial Sequence
  Synthetic construct
GVGFIFY

SEQ ID NO: 3432 - protein, 7 aa, Artificial Sequence
  Synthetic construct
GVGFIRF

SEQ ID NO: 3433 - protein, 7 aa, Artificial Sequence
  Synthetic construct
GVGFIRY

SEQ ID NO: 3434 - protein, 7 aa, Artificial Sequence
  Synthetic construct
GVGFICF

SEQ ID NO: 3435 - protein, 7 aa, Artificial Sequence
  Synthetic construct
GVGFICY

SEQ ID NO: 3436 - protein, 7 aa, Artificial Sequence
  Synthetic construct
GVGFILF

SEQ ID NO: 3437 - protein, 7 aa, Artificial Sequence
  Synthetic construct
GVGFILY

SEQ ID NO: 3438 - protein, 7 aa, Artificial Sequence
  Synthetic construct
GVGFIAF

SEQ ID NO: 3439 - protein, 7 aa, Artificial Sequence
  Synthetic construct
GVGFIAY

SEQ ID NO: 3440 - protein, 7 aa, Artificial Sequence
  Synthetic construct
GVGFIQF

SEQ ID NO: 3441 - protein, 7 aa, Artificial Sequence
  Synthetic construct
GVGFIQY

SEQ ID NO: 3442 - protein, 7 aa, Artificial Sequence
  Synthetic construct
GVGFIDF

SEQ ID NO: 3443 - protein, 7 aa, Artificial Sequence
  Synthetic construct
GVGFIDY

SEQ ID NO: 3444 - protein, 7 aa, Artificial Sequence
  Synthetic construct
GVGFIVF

SEQ ID NO: 3445 - protein, 7 aa, Artificial Sequence
  Synthetic construct
GVGFIVY

SEQ ID NO: 3446 - protein, 7 aa, Artificial Sequence
  Synthetic construct
GVGFDFF

SEQ ID NO: 3447 - protein, 7 aa, Artificial Sequence
  Synthetic construct
GVGFDFY

SEQ ID NO: 3448 - protein, 7 aa, Artificial Sequence
  Synthetic construct
GVGFDRF

SEQ ID NO: 3449 - protein, 7 aa, Artificial Sequence
  Synthetic construct
GVGFDRY

SEQ ID NO: 3450 - protein, 7 aa, Artificial Sequence
  Synthetic construct
GVGFDCF

SEQ ID NO: 3451 - protein, 7 aa, Artificial Sequence
  Synthetic construct
GVGFDCY

SEQ ID NO: 3452 - protein, 7 aa, Artificial Sequence
  Synthetic construct
GVGFDLF

SEQ ID NO: 3453 - protein, 7 aa, Artificial Sequence
  Synthetic construct
GVGFDLY

SEQ ID NO: 3454 - protein, 7 aa, Artificial Sequence
  Synthetic construct
GVGFDAF

SEQ ID NO: 3455 - protein, 7 aa, Artificial Sequence
  Synthetic construct
GVGFDAY

SEQ ID NO: 3456 - protein, 7 aa, Artificial Sequence
  Synthetic construct
GVGFDQF

SEQ ID NO: 3457 - protein, 7 aa, Artificial Sequence
  Synthetic construct
GVGFDQY

SEQ ID NO: 3458 - protein, 7 aa, Artificial Sequence
  Synthetic construct
GVGFDDF

SEQ ID NO: 3459 - protein, 7 aa, Artificial Sequence
  Synthetic construct
GVGFDDY

SEQ ID NO: 3460 - protein, 7 aa, Artificial Sequence
  Synthetic construct
GVGFDVF

SEQ ID NO: 3461 - protein, 7 aa, Artificial Sequence
  Synthetic construct
GVGFDVY

SEQ ID NO: 3462 - protein, 7 aa, Artificial Sequence
  Synthetic construct
GVGFYFF

SEQ ID NO: 3463 - protein, 7 aa, Artificial Sequence
  Synthetic construct
GVGFYFY

SEQ ID NO: 3464 - protein, 7 aa, Artificial Sequence
  Synthetic construct
GVGFYRF

SEQ ID NO: 3465 - protein, 7 aa, Artificial Sequence
  Synthetic construct
GVGFYRY

SEQ ID NO: 3466 - protein, 7 aa, Artificial Sequence
  Synthetic construct
GVGFYCF

SEQ ID NO: 3467 - protein, 7 aa, Artificial Sequence
  Synthetic construct
GVGFYCY

SEQ ID NO: 3468 - protein, 7 aa, Artificial Sequence
  Synthetic construct
GVGFYLF

SEQ ID NO: 3469 - protein, 7 aa, Artificial Sequence
  Synthetic construct
GVGFYLY

SEQ ID NO: 3470 - protein, 7 aa, Artificial Sequence
  Synthetic construct
GVGFYAF

SEQ ID NO: 3471 - protein, 7 aa, Artificial Sequence
  Synthetic construct
GVGFYAY

SEQ ID NO: 3472 - protein, 7 aa, Artificial Sequence
  Synthetic construct
GVGFYQF

SEQ ID NO: 3473 - protein, 7 aa, Artificial Sequence
  Synthetic construct
GVGFYQY

SEQ ID NO: 3474 - protein, 7 aa, Artificial Sequence
  Synthetic construct
GVGFYDF

SEQ ID NO: 3475 - protein, 7 aa, Artificial Sequence
  Synthetic construct
GVGFYDY

SEQ ID NO: 3476 - protein, 7 aa, Artificial Sequence
  Synthetic construct
GVGFYVF

SEQ ID NO: 3477 - protein, 7 aa, Artificial Sequence
  Synthetic construct
GVGFYVY

SEQ ID NO: 3478 - protein, 7 aa, Artificial Sequence
  Synthetic construct
GVGFFFF

SEQ ID NO: 3479 - protein, 7 aa, Artificial Sequence
  Synthetic construct
GVGFFFY

SEQ ID NO: 3480 - protein, 7 aa, Artificial Sequence
  Synthetic construct
GVGFFRF

SEQ ID NO: 3481 - protein, 7 aa, Artificial Sequence
  Synthetic construct
GVGFFRY

SEQ ID NO: 3482 - protein, 7 aa, Artificial Sequence
  Synthetic construct
GVGFFCF

SEQ ID NO: 3483 - protein, 7 aa, Artificial Sequence
  Synthetic construct
GVGFFCY

SEQ ID NO: 3484 - protein, 7 aa, Artificial Sequence
  Synthetic construct
GVGFFLF

SEQ ID NO: 3485 - protein, 7 aa, Artificial Sequence
  Synthetic construct
GVGFFLY

SEQ ID NO: 3486 - protein, 7 aa, Artificial Sequence
  Synthetic construct
GVGFFAF

SEQ ID NO: 3487 - protein, 7 aa, Artificial Sequence
  Synthetic construct
GVGFFAY

SEQ ID NO: 3488 - protein, 7 aa, Artificial Sequence
  Synthetic construct
GVGFFQF

SEQ ID NO: 3489 - protein, 7 aa, Artificial Sequence
  Synthetic construct
GVGFFQY

SEQ ID NO: 3490 - protein, 7 aa, Artificial Sequence
  Synthetic construct
GVGFFDF

SEQ ID NO: 3491 - protein, 7 aa, Artificial Sequence
  Synthetic construct
GVGFFDY

SEQ ID NO: 3492 - protein, 7 aa, Artificial Sequence
  Synthetic construct
GVGFFVF

SEQ ID NO: 3493 - protein, 7 aa, Artificial Sequence
  Synthetic construct
GVGFFVY

SEQ ID NO: 3494 - protein, 7 aa, Artificial Sequence
  Synthetic construct
GVGFVFF

SEQ ID NO: 3495 - protein, 7 aa, Artificial Sequence
  Synthetic construct
GVGFVFY

SEQ ID NO: 3496 - protein, 7 aa, Artificial Sequence
  Synthetic construct
GVGFVRF

SEQ ID NO: 3497 - protein, 7 aa, Artificial Sequence
  Synthetic construct
GVGFVRY

SEQ ID NO: 3498 - protein, 7 aa, Artificial Sequence
  Synthetic construct
GVGFVCF

SEQ ID NO: 3499 - protein, 7 aa, Artificial Sequence
  Synthetic construct
GVGFVCY

SEQ ID NO: 3500 - protein, 7 aa, Artificial Sequence
  Synthetic construct
GVGFVLF

SEQ ID NO: 3501 - protein, 7 aa, Artificial Sequence
  Synthetic construct
GVGFVLY

SEQ ID NO: 3502 - protein, 7 aa, Artificial Sequence
  Synthetic construct
GVGFVAF

SEQ ID NO: 3503 - protein, 7 aa, Artificial Sequence
  Synthetic construct
GVGFVAY

SEQ ID NO: 3504 - protein, 7 aa, Artificial Sequence
  Synthetic construct
GVGFVQF

SEQ ID NO: 3505 - protein, 7 aa, Artificial Sequence
  Synthetic construct
GVGFVQY

SEQ ID NO: 3506 - protein, 7 aa, Artificial Sequence
  Synthetic construct
GVGFVDF

SEQ ID NO: 3507 - protein, 7 aa, Artificial Sequence
  Synthetic construct
GVGFVDY

SEQ ID NO: 3508 - protein, 7 aa, Artificial Sequence
  Synthetic construct
GVGFVVF

SEQ ID NO: 3509 - protein, 7 aa, Artificial Sequence
  Synthetic construct
GVGFVVY

SEQ ID NO: 3510 - protein, 7 aa, Artificial Sequence
  Synthetic construct
GVGFTFF

SEQ ID NO: 3511 - protein, 7 aa, Artificial Sequence
  Synthetic construct
GVGFTFY

SEQ ID NO: 3512 - protein, 7 aa, Artificial Sequence
  Synthetic construct
GVGFTRF

SEQ ID NO: 3513 - protein, 7 aa, Artificial Sequence
  Synthetic construct
GVGFTRY

SEQ ID NO: 3514 - protein, 7 aa, Artificial Sequence
  Synthetic construct
GVGFTCF

SEQ ID NO: 3515 - protein, 7 aa, Artificial Sequence
  Synthetic construct
GVGFTCY

SEQ ID NO: 3516 - protein, 7 aa, Artificial Sequence
  Synthetic construct
GVGFTLF

SEQ ID NO: 3517 - protein, 7 aa, Artificial Sequence
  Synthetic construct
GVGFTLY

SEQ ID NO: 3518 - protein, 7 aa, Artificial Sequence
  Synthetic construct
GVGFTAF

SEQ ID NO: 3519 - protein, 7 aa, Artificial Sequence
  Synthetic construct
GVGFTAY

SEQ ID NO: 3520 - protein, 7 aa, Artificial Sequence
  Synthetic construct
GVGFTQF

SEQ ID NO: 3521 - protein, 7 aa, Artificial Sequence
  Synthetic construct
GVGFTQY

SEQ ID NO: 3522 - protein, 7 aa, Artificial Sequence
  Synthetic construct
GVGFTDF

SEQ ID NO: 3523 - protein, 7 aa, Artificial Sequence
  Synthetic construct
GVGFTDY

SEQ ID NO: 3524 - protein, 7 aa, Artificial Sequence
  Synthetic construct
GVGFTVF

SEQ ID NO: 3525 - protein, 7 aa, Artificial Sequence
  Synthetic construct
GVGFTVY

SEQ ID NO: 3526 - protein, 7 aa, Artificial Sequence
  Synthetic construct
GVGFGFF

SEQ ID NO: 3527 - protein, 7 aa, Artificial Sequence
  Synthetic construct
GVGFGFY

SEQ ID NO: 3528 - protein, 7 aa, Artificial Sequence
  Synthetic construct
GVGFGRF

SEQ ID NO: 3529 - protein, 7 aa, Artificial Sequence
  Synthetic construct
GVGFGRY

SEQ ID NO: 3530 - protein, 7 aa, Artificial Sequence
  Synthetic construct
GVGFGCF

SEQ ID NO: 3531 - protein, 7 aa, Artificial Sequence
  Synthetic construct
GVGFGCY

SEQ ID NO: 3532 - protein, 7 aa, Artificial Sequence
  Synthetic construct
GVGFGLF

SEQ ID NO: 3533 - protein, 7 aa, Artificial Sequence
  Synthetic construct
GVGFGLY

SEQ ID NO: 3534 - protein, 7 aa, Artificial Sequence
  Synthetic construct
GVGFGAF

SEQ ID NO: 3535 - protein, 7 aa, Artificial Sequence
  Synthetic construct
GVGFGAY

SEQ ID NO: 3536 - protein, 7 aa, Artificial Sequence
  Synthetic construct
GVGFGQF

SEQ ID NO: 3537 - protein, 7 aa, Artificial Sequence
  Synthetic construct
GVGFGQY

SEQ ID NO: 3538 - protein, 7 aa, Artificial Sequence
  Synthetic construct
GVGFGDF

SEQ ID NO: 3539 - protein, 7 aa, Artificial Sequence
  Synthetic construct
GVGFGDY

SEQ ID NO: 3540 - protein, 7 aa, Artificial Sequence
  Synthetic construct
GVGFGVF

SEQ ID NO: 3541 - protein, 7 aa, Artificial Sequence
  Synthetic construct
GVGFGVY

SEQ ID NO: 3542 - protein, 7 aa, Artificial Sequence
  Synthetic construct
GVGFAFF

SEQ ID NO: 3543 - protein, 7 aa, Artificial Sequence
  Synthetic construct
GVGFAFY

SEQ ID NO: 3544 - protein, 7 aa, Artificial Sequence
  Synthetic construct
GVGFARF

SEQ ID NO: 3545 - protein, 7 aa, Artificial Sequence
  Synthetic construct
GVGFARY

SEQ ID NO: 3546 - protein, 7 aa, Artificial Sequence
  Synthetic construct
GVGFACF

SEQ ID NO: 3547 - protein, 7 aa, Artificial Sequence
  Synthetic construct
GVGFACY

SEQ ID NO: 3548 - protein, 7 aa, Artificial Sequence
  Synthetic construct
GVGFALF

SEQ ID NO: 3549 - protein, 7 aa, Artificial Sequence
  Synthetic construct
GVGFALY

SEQ ID NO: 3550 - protein, 7 aa, Artificial Sequence
  Synthetic construct
GVGFAAF

SEQ ID NO: 3551 - protein, 7 aa, Artificial Sequence
  Synthetic construct
GVGFAAY

SEQ ID NO: 3552 - protein, 7 aa, Artificial Sequence
  Synthetic construct
GVGFAQF

SEQ ID NO: 3553 - protein, 7 aa, Artificial Sequence
  Synthetic construct
GVGFAQY

SEQ ID NO: 3554 - protein, 7 aa, Artificial Sequence
  Synthetic construct
GVGFADF

SEQ ID NO: 3555 - protein, 7 aa, Artificial Sequence
  Synthetic construct
GVGFADY

SEQ ID NO: 3556 - protein, 7 aa, Artificial Sequence
  Synthetic construct
GVGFAVF

SEQ ID NO: 3557 - protein, 7 aa, Artificial Sequence
  Synthetic construct
GVGFAVY

SEQ ID NO: 3558 - protein, 7 aa, Artificial Sequence
  Synthetic construct
GVGFQFF

SEQ ID NO: 3559 - protein, 7 aa, Artificial Sequence
  Synthetic construct
GVGFQFY

SEQ ID NO: 3560 - protein, 7 aa, Artificial Sequence
  Synthetic construct
GVGFQRF

SEQ ID NO: 3561 - protein, 7 aa, Artificial Sequence
  Synthetic construct
GVGFQRY

SEQ ID NO: 3562 - protein, 7 aa, Artificial Sequence
  Synthetic construct
GVGFQCF

SEQ ID NO: 3563 - protein, 7 aa, Artificial Sequence
  Synthetic construct
GVGFQCY

SEQ ID NO: 3564 - protein, 7 aa, Artificial Sequence
  Synthetic construct
GVGFQLF

SEQ ID NO: 3565 - protein, 7 aa, Artificial Sequence
  Synthetic construct
GVGFQLY

SEQ ID NO: 3566 - protein, 7 aa, Artificial Sequence
  Synthetic construct
GVGFQAF

SEQ ID NO: 3567 - protein, 7 aa, Artificial Sequence
  Synthetic construct
GVGFQAY

SEQ ID NO: 3568 - protein, 7 aa, Artificial Sequence
  Synthetic construct
GVGFQQF

SEQ ID NO: 3569 - protein, 7 aa, Artificial Sequence
  Synthetic construct
GVGFQQY

SEQ ID NO: 3570 - protein, 7 aa, Artificial Sequence
  Synthetic construct
GVGFQDF

SEQ ID NO: 3571 - protein, 7 aa, Artificial Sequence
  Synthetic construct
GVGFQDY

SEQ ID NO: 3572 - protein, 7 aa, Artificial Sequence
  Synthetic construct
GVGFQVF

SEQ ID NO: 3573 - protein, 7 aa, Artificial Sequence
  Synthetic construct
GVGFQVY

SEQ ID NO: 3574 - protein, 7 aa, Artificial Sequence
  Synthetic construct
GIIYIFF

SEQ ID NO: 3575 - protein, 7 aa, Artificial Sequence
  Synthetic construct
GIIYIFY

SEQ ID NO: 3576 - protein, 7 aa, Artificial Sequence
  Synthetic construct
GIIYIRF

SEQ ID NO: 3577 - protein, 7 aa, Artificial Sequence
  Synthetic construct
GIIYIRY

SEQ ID NO: 3578 - protein, 7 aa, Artificial Sequence
  Synthetic construct
GIIYICF

SEQ ID NO: 3579 - protein, 7 aa, Artificial Sequence
  Synthetic construct
GIIYICY

SEQ ID NO: 3580 - protein, 7 aa, Artificial Sequence
  Synthetic construct
GIIYILF

SEQ ID NO: 3581 - protein, 7 aa, Artificial Sequence
  Synthetic construct
GIIYILY

SEQ ID NO: 3582 - protein, 7 aa, Artificial Sequence
  Synthetic construct
GIIYIAF

SEQ ID NO: 3583 - protein, 7 aa, Artificial Sequence
  Synthetic construct
GIIYIAY

SEQ ID NO: 3584 - protein, 7 aa, Artificial Sequence
  Synthetic construct
GIIYIQF

SEQ ID NO: 3585 - protein, 7 aa, Artificial Sequence
  Synthetic construct
GIIYIQY

SEQ ID NO: 3586 - protein, 7 aa, Artificial Sequence
  Synthetic construct
GIIYIDF

SEQ ID NO: 3587 - protein, 7 aa, Artificial Sequence
  Synthetic construct
GIIYIDY

SEQ ID NO: 3588 - protein, 7 aa, Artificial Sequence
  Synthetic construct
GIIYIVF

SEQ ID NO: 3589 - protein, 7 aa, Artificial Sequence
  Synthetic construct
GIIYIVY

SEQ ID NO: 3590 - protein, 7 aa, Artificial Sequence
  Synthetic construct
GIIYDFF

SEQ ID NO: 3591 - protein, 7 aa, Artificial Sequence
  Synthetic construct
GIIYDFY

SEQ ID NO: 3592 - protein, 7 aa, Artificial Sequence
  Synthetic construct
GIIYDRF

SEQ ID NO: 3593 - protein, 7 aa, Artificial Sequence
  Synthetic construct
GIIYDRY

SEQ ID NO: 3594 - protein, 7 aa, Artificial Sequence
  Synthetic construct
GIIYDCF

SEQ ID NO: 3595 - protein, 7 aa, Artificial Sequence
  Synthetic construct
GIIYDCY

SEQ ID NO: 3596 - protein, 7 aa, Artificial Sequence
  Synthetic construct
GIIYDLF

SEQ ID NO: 3597 - protein, 7 aa, Artificial Sequence
  Synthetic construct
GIIYDLY

SEQ ID NO: 3598 - protein, 7 aa, Artificial Sequence
  Synthetic construct
GIIYDAF

SEQ ID NO: 3599 - protein, 7 aa, Artificial Sequence
  Synthetic construct
GIIYDAY

SEQ ID NO: 3600 - protein, 7 aa, Artificial Sequence
  Synthetic construct
GIIYDQF

SEQ ID NO: 3601 - protein, 7 aa, Artificial Sequence
  Synthetic construct
GIIYDQY

SEQ ID NO: 3602 - protein, 7 aa, Artificial Sequence
  Synthetic construct
GIIYDDF

SEQ ID NO: 3603 - protein, 7 aa, Artificial Sequence
  Synthetic construct
GIIYDDY

SEQ ID NO: 3604 - protein, 7 aa, Artificial Sequence
  Synthetic construct
GIIYDVF

SEQ ID NO: 3605 - protein, 7 aa, Artificial Sequence
  Synthetic construct
GIIYDVY

SEQ ID NO: 3606 - protein, 7 aa, Artificial Sequence
  Synthetic construct
GIIYYFF

SEQ ID NO: 3607 - protein, 7 aa, Artificial Sequence
  Synthetic construct
GIIYYFY

SEQ ID NO: 3608 - protein, 7 aa, Artificial Sequence
  Synthetic construct
GIIYYRF

SEQ ID NO: 3609 - protein, 7 aa, Artificial Sequence
  Synthetic construct
GIIYYRY

SEQ ID NO: 3610 - protein, 7 aa, Artificial Sequence
  Synthetic construct
GIIYYCF

SEQ ID NO: 3611 - protein, 7 aa, Artificial Sequence
  Synthetic construct
GIIYYCY

SEQ ID NO: 3612 - protein, 7 aa, Artificial Sequence
  Synthetic construct
GIIYYLF

SEQ ID NO: 3613 - protein, 7 aa, Artificial Sequence
  Synthetic construct
GIIYYLY

SEQ ID NO: 3614 - protein, 7 aa, Artificial Sequence
  Synthetic construct
GIIYYAF

SEQ ID NO: 3615 - protein, 7 aa, Artificial Sequence
  Synthetic construct
GIIYYAY

SEQ ID NO: 3616 - protein, 7 aa, Artificial Sequence
  Synthetic construct
GIIYYQF

SEQ ID NO: 3617 - protein, 7 aa, Artificial Sequence
  Synthetic construct
GIIYYQY

SEQ ID NO: 3618 - protein, 7 aa, Artificial Sequence
  Synthetic construct
GIIYYDF

SEQ ID NO: 3619 - protein, 7 aa, Artificial Sequence
  Synthetic construct
GIIYYDY

SEQ ID NO: 3620 - protein, 7 aa, Artificial Sequence
  Synthetic construct
GIIYYVF

SEQ ID NO: 3621 - protein, 7 aa, Artificial Sequence
  Synthetic construct
GIIYYVY

SEQ ID NO: 3622 - protein, 7 aa, Artificial Sequence
  Synthetic construct
GIIYFFF

SEQ ID NO: 3623 - protein, 7 aa, Artificial Sequence
  Synthetic construct
GIIYFFY

SEQ ID NO: 3624 - protein, 7 aa, Artificial Sequence
  Synthetic construct
GIIYFRF

SEQ ID NO: 3625 - protein, 7 aa, Artificial Sequence
  Synthetic construct
GIIYFRY

SEQ ID NO: 3626 - protein, 7 aa, Artificial Sequence
  Synthetic construct
GIIYFCF

SEQ ID NO: 3627 - protein, 7 aa, Artificial Sequence
  Synthetic construct
GIIYFCY

SEQ ID NO: 3628 - protein, 7 aa, Artificial Sequence
  Synthetic construct
GIIYFLF

SEQ ID NO: 3629 - protein, 7 aa, Artificial Sequence
  Synthetic construct
GIIYFLY

SEQ ID NO: 3630 - protein, 7 aa, Artificial Sequence
  Synthetic construct
GIIYFAF

SEQ ID NO: 3631 - protein, 7 aa, Artificial Sequence
  Synthetic construct
GIIYFAY

SEQ ID NO: 3632 - protein, 7 aa, Artificial Sequence
  Synthetic construct
GIIYFQF

SEQ ID NO: 3633 - protein, 7 aa, Artificial Sequence
  Synthetic construct
GIIYFQY

SEQ ID NO: 3634 - protein, 7 aa, Artificial Sequence
  Synthetic construct
GIIYFDF

SEQ ID NO: 3635 - protein, 7 aa, Artificial Sequence
  Synthetic construct
GIIYFDY

SEQ ID NO: 3636 - protein, 7 aa, Artificial Sequence
  Synthetic construct
GIIYFVF

SEQ ID NO: 3637 - protein, 7 aa, Artificial Sequence
  Synthetic construct
GIIYFVY

SEQ ID NO: 3638 - protein, 7 aa, Artificial Sequence
  Synthetic construct
GIIYVFF

SEQ ID NO: 3639 - protein, 7 aa, Artificial Sequence
  Synthetic construct
GIIYVFY

SEQ ID NO: 3640 - protein, 7 aa, Artificial Sequence
  Synthetic construct
GIIYVRF

SEQ ID NO: 3641 - protein, 7 aa, Artificial Sequence
  Synthetic construct
GIIYVRY

SEQ ID NO: 3642 - protein, 7 aa, Artificial Sequence
  Synthetic construct
GIIYVCF

SEQ ID NO: 3643 - protein, 7 aa, Artificial Sequence
  Synthetic construct
GIIYVCY

SEQ ID NO: 3644 - protein, 7 aa, Artificial Sequence
  Synthetic construct
GIIYVLF

SEQ ID NO: 3645 - protein, 7 aa, Artificial Sequence
  Synthetic construct
GIIYVLY

SEQ ID NO: 3646 - protein, 7 aa, Artificial Sequence
  Synthetic construct
GIIYVAF

SEQ ID NO: 3647 - protein, 7 aa, Artificial Sequence
  Synthetic construct
GIIYVAY

SEQ ID NO: 3648 - protein, 7 aa, Artificial Sequence
  Synthetic construct
GIIYVQF

SEQ ID NO: 3649 - protein, 7 aa, Artificial Sequence
  Synthetic construct
GIIYVQY

SEQ ID NO: 3650 - protein, 7 aa, Artificial Sequence
  Synthetic construct
GIIYVDF

SEQ ID NO: 3651 - protein, 7 aa, Artificial Sequence
  Synthetic construct
GIIYVDY

SEQ ID NO: 3652 - protein, 7 aa, Artificial Sequence
  Synthetic construct
GIIYVVF

SEQ ID NO: 3653 - protein, 7 aa, Artificial Sequence
  Synthetic construct
GIIYVVY

SEQ ID NO: 3654 - protein, 7 aa, Artificial Sequence
  Synthetic construct
GIIYTFF

SEQ ID NO: 3655 - protein, 7 aa, Artificial Sequence
  Synthetic construct
GIIYTFY

SEQ ID NO: 3656 - protein, 7 aa, Artificial Sequence
  Synthetic construct
GIIYTRF

SEQ ID NO: 3657 - protein, 7 aa, Artificial Sequence
  Synthetic construct
GIIYTRY

SEQ ID NO: 3658 - protein, 7 aa, Artificial Sequence
  Synthetic construct
GIIYTCF

SEQ ID NO: 3659 - protein, 7 aa, Artificial Sequence
  Synthetic construct
GIIYTCY

SEQ ID NO: 3660 - protein, 7 aa, Artificial Sequence
  Synthetic construct
GIIYTLF

SEQ ID NO: 3661 - protein, 7 aa, Artificial Sequence
  Synthetic construct
GIIYTLY

SEQ ID NO: 3662 - protein, 7 aa, Artificial Sequence
  Synthetic construct
GIIYTAF

SEQ ID NO: 3663 - protein, 7 aa, Artificial Sequence
  Synthetic construct
GIIYTAY

SEQ ID NO: 3664 - protein, 7 aa, Artificial Sequence
  Synthetic construct
GIIYTQF

SEQ ID NO: 3665 - protein, 7 aa, Artificial Sequence
  Synthetic construct
GIIYTQY

SEQ ID NO: 3666 - protein, 7 aa, Artificial Sequence
  Synthetic construct
GIIYTDF

SEQ ID NO: 3667 - protein, 7 aa, Artificial Sequence
  Synthetic construct
GIIYTDY

SEQ ID NO: 3668 - protein, 7 aa, Artificial Sequence
  Synthetic construct
GIIYTVF

SEQ ID NO: 3669 - protein, 7 aa, Artificial Sequence
  Synthetic construct
GIIYTVY

SEQ ID NO: 3670 - protein, 7 aa, Artificial Sequence
  Synthetic construct
GIIYGFF

SEQ ID NO: 3671 - protein, 7 aa, Artificial Sequence
  Synthetic construct
GIIYGFY

SEQ ID NO: 3672 - protein, 7 aa, Artificial Sequence
  Synthetic construct
GIIYGRF

SEQ ID NO: 3673 - protein, 7 aa, Artificial Sequence
  Synthetic construct
GIIYGRY

SEQ ID NO: 3674 - protein, 7 aa, Artificial Sequence
  Synthetic construct
GIIYGCF

SEQ ID NO: 3675 - protein, 7 aa, Artificial Sequence
  Synthetic construct
GIIYGCY

SEQ ID NO: 3676 - protein, 7 aa, Artificial Sequence
  Synthetic construct
GIIYGLF

SEQ ID NO: 3677 - protein, 7 aa, Artificial Sequence
  Synthetic construct
GIIYGLY

SEQ ID NO: 3678 - protein, 7 aa, Artificial Sequence
  Synthetic construct
GIIYGAF

SEQ ID NO: 3679 - protein, 7 aa, Artificial Sequence
  Synthetic construct
GIIYGAY

SEQ ID NO: 3680 - protein, 7 aa, Artificial Sequence
  Synthetic construct
GIIYGQF

SEQ ID NO: 3681 - protein, 7 aa, Artificial Sequence
  Synthetic construct
GIIYGQY

SEQ ID NO: 3682 - protein, 7 aa, Artificial Sequence
  Synthetic construct
GIIYGDF

SEQ ID NO: 3683 - protein, 7 aa, Artificial Sequence
  Synthetic construct
GIIYGDY

SEQ ID NO: 3684 - protein, 7 aa, Artificial Sequence
  Synthetic construct
GIIYGVF

SEQ ID NO: 3685 - protein, 7 aa, Artificial Sequence
  Synthetic construct
GIIYGVY

SEQ ID NO: 3686 - protein, 7 aa, Artificial Sequence
  Synthetic construct
GIIYAFF

SEQ ID NO: 3687 - protein, 7 aa, Artificial Sequence
  Synthetic construct
GIIYAFY

SEQ ID NO: 3688 - protein, 7 aa, Artificial Sequence
  Synthetic construct
GIIYARF

SEQ ID NO: 3689 - protein, 7 aa, Artificial Sequence
  Synthetic construct
GIIYARY

SEQ ID NO: 3690 - protein, 7 aa, Artificial Sequence
  Synthetic construct
GIIYACF

SEQ ID NO: 3691 - protein, 7 aa, Artificial Sequence
  Synthetic construct
GIIYACY

SEQ ID NO: 3692 - protein, 7 aa, Artificial Sequence
  Synthetic construct
GIIYALF

SEQ ID NO: 3693 - protein, 7 aa, Artificial Sequence
  Synthetic construct
GIIYALY

SEQ ID NO: 3694 - protein, 7 aa, Artificial Sequence
  Synthetic construct
GIIYAAF

SEQ ID NO: 3695 - protein, 7 aa, Artificial Sequence
  Synthetic construct
GIIYAAY

SEQ ID NO: 3696 - protein, 7 aa, Artificial Sequence
  Synthetic construct
GIIYAQF

SEQ ID NO: 3697 - protein, 7 aa, Artificial Sequence
  Synthetic construct
GIIYAQY

SEQ ID NO: 3698 - protein, 7 aa, Artificial Sequence
  Synthetic construct
GIIYADF

SEQ ID NO: 3699 - protein, 7 aa, Artificial Sequence
  Synthetic construct
GIIYADY

SEQ ID NO: 3700 - protein, 7 aa, Artificial Sequence
  Synthetic construct
GIIYAVF

SEQ ID NO: 3701 - protein, 7 aa, Artificial Sequence
  Synthetic construct
GIIYAVY

SEQ ID NO: 3702 - protein, 7 aa, Artificial Sequence
  Synthetic construct
GIIYQFF

SEQ ID NO: 3703 - protein, 7 aa, Artificial Sequence
  Synthetic construct
GIIYQFY

SEQ ID NO: 3704 - protein, 7 aa, Artificial Sequence
  Synthetic construct
GIIYQRF

SEQ ID NO: 3705 - protein, 7 aa, Artificial Sequence
  Synthetic construct
GIIYQRY

SEQ ID NO: 3706 - protein, 7 aa, Artificial Sequence
  Synthetic construct
GIIYQCF

SEQ ID NO: 3707 - protein, 7 aa, Artificial Sequence
  Synthetic construct
GIIYQCY

SEQ ID NO: 3708 - protein, 7 aa, Artificial Sequence
  Synthetic construct
GIIYQLF

SEQ ID NO: 3709 - protein, 7 aa, Artificial Sequence
  Synthetic construct
GIIYQLY

SEQ ID NO: 3710 - protein, 7 aa, Artificial Sequence
  Synthetic construct
GIIYQAF

SEQ ID NO: 3711 - protein, 7 aa, Artificial Sequence
  Synthetic construct
GIIYQAY

SEQ ID NO: 3712 - protein, 7 aa, Artificial Sequence
  Synthetic construct
GIIYQQF

SEQ ID NO: 3713 - protein, 7 aa, Artificial Sequence
  Synthetic construct
GIIYQQY

SEQ ID NO: 3714 - protein, 7 aa, Artificial Sequence
  Synthetic construct
GIIYQDF

SEQ ID NO: 3715 - protein, 7 aa, Artificial Sequence
  Synthetic construct
GIIYQDY

SEQ ID NO: 3716 - protein, 7 aa, Artificial Sequence
  Synthetic construct
GIIYQVF

SEQ ID NO: 3717 - protein, 7 aa, Artificial Sequence
  Synthetic construct
GIIYQVY

SEQ ID NO: 3718 - protein, 7 aa, Artificial Sequence
  Synthetic construct
GIIPIFF

SEQ ID NO: 3719 - protein, 7 aa, Artificial Sequence
  Synthetic construct
GIIPIFY

SEQ ID NO: 3720 - protein, 7 aa, Artificial Sequence
  Synthetic construct
GIIPIRF

SEQ ID NO: 3721 - protein, 7 aa, Artificial Sequence
  Synthetic construct
GIIPIRY

SEQ ID NO: 3722 - protein, 7 aa, Artificial Sequence
  Synthetic construct
GIIPICF

SEQ ID NO: 3723 - protein, 7 aa, Artificial Sequence
  Synthetic construct
GIIPICY

SEQ ID NO: 3724 - protein, 7 aa, Artificial Sequence
  Synthetic construct
GIIPILF

SEQ ID NO: 3725 - protein, 7 aa, Artificial Sequence
  Synthetic construct
GIIPILY

SEQ ID NO: 3726 - protein, 7 aa, Artificial Sequence
  Synthetic construct
GIIPIAF

SEQ ID NO: 3727 - protein, 7 aa, Artificial Sequence
  Synthetic construct
GIIPIAY

SEQ ID NO: 3728 - protein, 7 aa, Artificial Sequence
  Synthetic construct
GIIPIQF

SEQ ID NO: 3729 - protein, 7 aa, Artificial Sequence
  Synthetic construct
GIIPIQY

SEQ ID NO: 3730 - protein, 7 aa, Artificial Sequence
  Synthetic construct
GIIPIDF

SEQ ID NO: 3731 - protein, 7 aa, Artificial Sequence
  Synthetic construct
GIIPIDY

SEQ ID NO: 3732 - protein, 7 aa, Artificial Sequence
  Synthetic construct
GIIPIVF

SEQ ID NO: 3733 - protein, 7 aa, Artificial Sequence
  Synthetic construct
GIIPIVY

SEQ ID NO: 3734 - protein, 7 aa, Artificial Sequence
  Synthetic construct
GIIPDFF

SEQ ID NO: 3735 - protein, 7 aa, Artificial Sequence
  Synthetic construct
GIIPDFY

SEQ ID NO: 3736 - protein, 7 aa, Artificial Sequence
  Synthetic construct
GIIPDRF

SEQ ID NO: 3737 - protein, 7 aa, Artificial Sequence
  Synthetic construct
GIIPDRY

SEQ ID NO: 3738 - protein, 7 aa, Artificial Sequence
  Synthetic construct
GIIPDCF

SEQ ID NO: 3739 - protein, 7 aa, Artificial Sequence
  Synthetic construct
GIIPDCY

SEQ ID NO: 3740 - protein, 7 aa, Artificial Sequence
  Synthetic construct
GIIPDLF

SEQ ID NO: 3741 - protein, 7 aa, Artificial Sequence
  Synthetic construct
GIIPDLY

SEQ ID NO: 3742 - protein, 7 aa, Artificial Sequence
  Synthetic construct
GIIPDAF

SEQ ID NO: 3743 - protein, 7 aa, Artificial Sequence
  Synthetic construct
GIIPDAY

SEQ ID NO: 3744 - protein, 7 aa, Artificial Sequence
  Synthetic construct
GIIPDQF

SEQ ID NO: 3745 - protein, 7 aa, Artificial Sequence
  Synthetic construct
GIIPDQY

SEQ ID NO: 3746 - protein, 7 aa, Artificial Sequence
  Synthetic construct
GIIPDDF

SEQ ID NO: 3747 - protein, 7 aa, Artificial Sequence
  Synthetic construct
GIIPDDY

SEQ ID NO: 3748 - protein, 7 aa, Artificial Sequence
  Synthetic construct
GIIPDVF

SEQ ID NO: 3749 - protein, 7 aa, Artificial Sequence
  Synthetic construct
GIIPDVY

SEQ ID NO: 3750 - protein, 7 aa, Artificial Sequence
  Synthetic construct
GIIPYFF

SEQ ID NO: 3751 - protein, 7 aa, Artificial Sequence
  Synthetic construct
GIIPYFY

SEQ ID NO: 3752 - protein, 7 aa, Artificial Sequence
  Synthetic construct
GIIPYRF

SEQ ID NO: 3753 - protein, 7 aa, Artificial Sequence
  Synthetic construct
GIIPYRY

SEQ ID NO: 3754 - protein, 7 aa, Artificial Sequence
  Synthetic construct
GIIPYCF

SEQ ID NO: 3755 - protein, 7 aa, Artificial Sequence
  Synthetic construct
GIIPYCY

SEQ ID NO: 3756 - protein, 7 aa, Artificial Sequence
  Synthetic construct
GIIPYLF

SEQ ID NO: 3757 - protein, 7 aa, Artificial Sequence
  Synthetic construct
GIIPYLY

SEQ ID NO: 3758 - protein, 7 aa, Artificial Sequence
  Synthetic construct
GIIPYAF

SEQ ID NO: 3759 - protein, 7 aa, Artificial Sequence
  Synthetic construct
GIIPYAY

SEQ ID NO: 3760 - protein, 7 aa, Artificial Sequence
  Synthetic construct
GIIPYQF

SEQ ID NO: 3761 - protein, 7 aa, Artificial Sequence
  Synthetic construct
GIIPYQY

SEQ ID NO: 3762 - protein, 7 aa, Artificial Sequence
  Synthetic construct
GIIPYDF

SEQ ID NO: 3763 - protein, 7 aa, Artificial Sequence
  Synthetic construct
GIIPYDY

SEQ ID NO: 3764 - protein, 7 aa, Artificial Sequence
  Synthetic construct
GIIPYVF

SEQ ID NO: 3765 - protein, 7 aa, Artificial Sequence
  Synthetic construct
GIIPYVY

SEQ ID NO: 3766 - protein, 7 aa, Artificial Sequence
  Synthetic construct
GIIPFFF

SEQ ID NO: 3767 - protein, 7 aa, Artificial Sequence
  Synthetic construct
GIIPFFY

SEQ ID NO: 3768 - protein, 7 aa, Artificial Sequence
  Synthetic construct
GIIPFRF

SEQ ID NO: 3769 - protein, 7 aa, Artificial Sequence
  Synthetic construct
GIIPFRY

SEQ ID NO: 3770 - protein, 7 aa, Artificial Sequence
  Synthetic construct
GIIPFCF

SEQ ID NO: 3771 - protein, 7 aa, Artificial Sequence
  Synthetic construct
GIIPFCY

SEQ ID NO: 3772 - protein, 7 aa, Artificial Sequence
  Synthetic construct
GIIPFLF

SEQ ID NO: 3773 - protein, 7 aa, Artificial Sequence
  Synthetic construct
GIIPFLY

SEQ ID NO: 3774 - protein, 7 aa, Artificial Sequence
  Synthetic construct
GIIPFAF

SEQ ID NO: 3775 - protein, 7 aa, Artificial Sequence
  Synthetic construct
GIIPFAY

SEQ ID NO: 3776 - protein, 7 aa, Artificial Sequence
  Synthetic construct
GIIPFQF

SEQ ID NO: 3777 - protein, 7 aa, Artificial Sequence
  Synthetic construct
GIIPFQY

SEQ ID NO: 3778 - protein, 7 aa, Artificial Sequence
  Synthetic construct
GIIPFDF

SEQ ID NO: 3779 - protein, 7 aa, Artificial Sequence
  Synthetic construct
GIIPFDY

SEQ ID NO: 3780 - protein, 7 aa, Artificial Sequence
  Synthetic construct
GIIPFVF

SEQ ID NO: 3781 - protein, 7 aa, Artificial Sequence
  Synthetic construct
GIIPFVY

SEQ ID NO: 3782 - protein, 7 aa, Artificial Sequence
  Synthetic construct
GIIPVFF

SEQ ID NO: 3783 - protein, 7 aa, Artificial Sequence
  Synthetic construct
GIIPVFY

SEQ ID NO: 3784 - protein, 7 aa, Artificial Sequence
  Synthetic construct
GIIPVRF

SEQ ID NO: 3785 - protein, 7 aa, Artificial Sequence
  Synthetic construct
GIIPVRY

SEQ ID NO: 3786 - protein, 7 aa, Artificial Sequence
  Synthetic construct
GIIPVCF

SEQ ID NO: 3787 - protein, 7 aa, Artificial Sequence
  Synthetic construct
GIIPVCY

SEQ ID NO: 3788 - protein, 7 aa, Artificial Sequence
  Synthetic construct
GIIPVLF

SEQ ID NO: 3789 - protein, 7 aa, Artificial Sequence
  Synthetic construct
GIIPVLY

SEQ ID NO: 3790 - protein, 7 aa, Artificial Sequence
  Synthetic construct
GIIPVAF

SEQ ID NO: 3791 - protein, 7 aa, Artificial Sequence
  Synthetic construct
GIIPVAY

SEQ ID NO: 3792 - protein, 7 aa, Artificial Sequence
  Synthetic construct
GIIPVQF

SEQ ID NO: 3793 - protein, 7 aa, Artificial Sequence
  Synthetic construct
GIIPVQY

SEQ ID NO: 3794 - protein, 7 aa, Artificial Sequence
  Synthetic construct
GIIPVDF

SEQ ID NO: 3795 - protein, 7 aa, Artificial Sequence
  Synthetic construct
GIIPVDY

SEQ ID NO: 3796 - protein, 7 aa, Artificial Sequence
  Synthetic construct
GIIPVVF

SEQ ID NO: 3797 - protein, 7 aa, Artificial Sequence
  Synthetic construct
GIIPVVY

SEQ ID NO: 3798 - protein, 7 aa, Artificial Sequence
  Synthetic construct
GIIPTFF

SEQ ID NO: 3799 - protein, 7 aa, Artificial Sequence
  Synthetic construct
GIIPTFY

SEQ ID NO: 3800 - protein, 7 aa, Artificial Sequence
  Synthetic construct
GIIPTRF

SEQ ID NO: 3801 - protein, 7 aa, Artificial Sequence
  Synthetic construct
GIIPTRY

SEQ ID NO: 3802 - protein, 7 aa, Artificial Sequence
  Synthetic construct
GIIPTCF

SEQ ID NO: 3803 - protein, 7 aa, Artificial Sequence
  Synthetic construct
GIIPTCY

SEQ ID NO: 3804 - protein, 7 aa, Artificial Sequence
  Synthetic construct
GIIPTLF

SEQ ID NO: 3805 - protein, 7 aa, Artificial Sequence
  Synthetic construct
GIIPTLY

SEQ ID NO: 3806 - protein, 7 aa, Artificial Sequence
  Synthetic construct
GIIPTAF

SEQ ID NO: 3807 - protein, 7 aa, Artificial Sequence
  Synthetic construct
GIIPTAY

SEQ ID NO: 3808 - protein, 7 aa, Artificial Sequence
  Synthetic construct
GIIPTQF

SEQ ID NO: 3809 - protein, 7 aa, Artificial Sequence
  Synthetic construct
GIIPTQY

SEQ ID NO: 3810 - protein, 7 aa, Artificial Sequence
  Synthetic construct
GIIPTDF

SEQ ID NO: 3811 - protein, 7 aa, Artificial Sequence
  Synthetic construct
GIIPTDY

SEQ ID NO: 3812 - protein, 7 aa, Artificial Sequence
  Synthetic construct
GIIPTVF

SEQ ID NO: 3813 - protein, 7 aa, Artificial Sequence
  Synthetic construct
GIIPTVY

SEQ ID NO: 3814 - protein, 7 aa, Artificial Sequence
  Synthetic construct
GIIPGFF

SEQ ID NO: 3815 - protein, 7 aa, Artificial Sequence
  Synthetic construct
GIIPGFY

SEQ ID NO: 3816 - protein, 7 aa, Artificial Sequence
  Synthetic construct
GIIPGRF

SEQ ID NO: 3817 - protein, 7 aa, Artificial Sequence
  Synthetic construct
GIIPGRY

SEQ ID NO: 3818 - protein, 7 aa, Artificial Sequence
  Synthetic construct
GIIPGCF

SEQ ID NO: 3819 - protein, 7 aa, Artificial Sequence
  Synthetic construct
GIIPGCY

SEQ ID NO: 3820 - protein, 7 aa, Artificial Sequence
  Synthetic construct
GIIPGLF

SEQ ID NO: 3821 - protein, 7 aa, Artificial Sequence
  Synthetic construct
GIIPGLY

SEQ ID NO: 3822 - protein, 7 aa, Artificial Sequence
  Synthetic construct
GIIPGAF

SEQ ID NO: 3823 - protein, 7 aa, Artificial Sequence
  Synthetic construct
GIIPGAY

SEQ ID NO: 3824 - protein, 7 aa, Artificial Sequence
  Synthetic construct
GIIPGQF

SEQ ID NO: 3825 - protein, 7 aa, Artificial Sequence
  Synthetic construct
GIIPGQY

SEQ ID NO: 3826 - protein, 7 aa, Artificial Sequence
  Synthetic construct
GIIPGDF

SEQ ID NO: 3827 - protein, 7 aa, Artificial Sequence
  Synthetic construct
GIIPGDY

SEQ ID NO: 3828 - protein, 7 aa, Artificial Sequence
  Synthetic construct
GIIPGVF

SEQ ID NO: 3829 - protein, 7 aa, Artificial Sequence
  Synthetic construct
GIIPGVY

SEQ ID NO: 3830 - protein, 7 aa, Artificial Sequence
  Synthetic construct
GIIPAFF

SEQ ID NO: 3831 - protein, 7 aa, Artificial Sequence
  Synthetic construct
GIIPAFY

SEQ ID NO: 3832 - protein, 7 aa, Artificial Sequence
  Synthetic construct
GIIPARF

SEQ ID NO: 3833 - protein, 7 aa, Artificial Sequence
  Synthetic construct
GIIPARY

SEQ ID NO: 3834 - protein, 7 aa, Artificial Sequence
  Synthetic construct
GIIPACF

SEQ ID NO: 3835 - protein, 7 aa, Artificial Sequence
  Synthetic construct
GIIPACY

SEQ ID NO: 3836 - protein, 7 aa, Artificial Sequence
  Synthetic construct
GIIPALF

SEQ ID NO: 3837 - protein, 7 aa, Artificial Sequence
  Synthetic construct
GIIPALY

SEQ ID NO: 3838 - protein, 7 aa, Artificial Sequence
  Synthetic construct
GIIPAAF

SEQ ID NO: 3839 - protein, 7 aa, Artificial Sequence
  Synthetic construct
GIIPAAY

SEQ ID NO: 3840 - protein, 7 aa, Artificial Sequence
  Synthetic construct
GIIPAQF

SEQ ID NO: 3841 - protein, 7 aa, Artificial Sequence
  Synthetic construct
GIIPAQY

SEQ ID NO: 3842 - protein, 7 aa, Artificial Sequence
  Synthetic construct
GIIPADF

SEQ ID NO: 3843 - protein, 7 aa, Artificial Sequence
  Synthetic construct
GIIPADY

SEQ ID NO: 3844 - protein, 7 aa, Artificial Sequence
  Synthetic construct
GIIPAVF

SEQ ID NO: 3845 - protein, 7 aa, Artificial Sequence
  Synthetic construct
GIIPAVY

SEQ ID NO: 3846 - protein, 7 aa, Artificial Sequence
  Synthetic construct
GIIPQFF

SEQ ID NO: 3847 - protein, 7 aa, Artificial Sequence
  Synthetic construct
GIIPQFY

SEQ ID NO: 3848 - protein, 7 aa, Artificial Sequence
  Synthetic construct
GIIPQRF

SEQ ID NO: 3849 - protein, 7 aa, Artificial Sequence
  Synthetic construct
GIIPQRY

SEQ ID NO: 3850 - protein, 7 aa, Artificial Sequence
  Synthetic construct
GIIPQCF

SEQ ID NO: 3851 - protein, 7 aa, Artificial Sequence
  Synthetic construct
GIIPQCY

SEQ ID NO: 3852 - protein, 7 aa, Artificial Sequence
  Synthetic construct
GIIPQLF

SEQ ID NO: 3853 - protein, 7 aa, Artificial Sequence
  Synthetic construct
GIIPQLY

SEQ ID NO: 3854 - protein, 7 aa, Artificial Sequence
  Synthetic construct
GIIPQAF

SEQ ID NO: 3855 - protein, 7 aa, Artificial Sequence
  Synthetic construct
GIIPQAY

SEQ ID NO: 3856 - protein, 7 aa, Artificial Sequence
  Synthetic construct
GIIPQQF

SEQ ID NO: 3857 - protein, 7 aa, Artificial Sequence
  Synthetic construct
GIIPQQY

SEQ ID NO: 3858 - protein, 7 aa, Artificial Sequence
  Synthetic construct
GIIPQDF

SEQ ID NO: 3859 - protein, 7 aa, Artificial Sequence
  Synthetic construct
GIIPQDY

SEQ ID NO: 3860 - protein, 7 aa, Artificial Sequence
  Synthetic construct
GIIPQVF

SEQ ID NO: 3861 - protein, 7 aa, Artificial Sequence
  Synthetic construct
GIIPQVY

SEQ ID NO: 3862 - protein, 7 aa, Artificial Sequence
  Synthetic construct
GIIHIFF

SEQ ID NO: 3863 - protein, 7 aa, Artificial Sequence
  Synthetic construct
GIIHIFY

SEQ ID NO: 3864 - protein, 7 aa, Artificial Sequence
  Synthetic construct
GIIHIRF

SEQ ID NO: 3865 - protein, 7 aa, Artificial Sequence
  Synthetic construct
GIIHIRY

SEQ ID NO: 3866 - protein, 7 aa, Artificial Sequence
  Synthetic construct
GIIHICF

SEQ ID NO: 3867 - protein, 7 aa, Artificial Sequence
  Synthetic construct
GIIHICY

SEQ ID NO: 3868 - protein, 7 aa, Artificial Sequence
  Synthetic construct
GIIHILF

SEQ ID NO: 3869 - protein, 7 aa, Artificial Sequence
  Synthetic construct
GIIHILY

SEQ ID NO: 3870 - protein, 7 aa, Artificial Sequence
  Synthetic construct
GIIHIAF

SEQ ID NO: 3871 - protein, 7 aa, Artificial Sequence
  Synthetic construct
GIIHIAY

SEQ ID NO: 3872 - protein, 7 aa, Artificial Sequence
  Synthetic construct
GIIHIQF

SEQ ID NO: 3873 - protein, 7 aa, Artificial Sequence
  Synthetic construct
GIIHIQY

SEQ ID NO: 3874 - protein, 7 aa, Artificial Sequence
  Synthetic construct
GIIHIDF

SEQ ID NO: 3875 - protein, 7 aa, Artificial Sequence
  Synthetic construct
GIIHIDY

SEQ ID NO: 3876 - protein, 7 aa, Artificial Sequence
  Synthetic construct
GIIHIVF

SEQ ID NO: 3877 - protein, 7 aa, Artificial Sequence
  Synthetic construct
GIIHIVY

SEQ ID NO: 3878 - protein, 7 aa, Artificial Sequence
  Synthetic construct
GIIHDFF

SEQ ID NO: 3879 - protein, 7 aa, Artificial Sequence
  Synthetic construct
GIIHDFY

SEQ ID NO: 3880 - protein, 7 aa, Artificial Sequence
  Synthetic construct
GIIHDRF

SEQ ID NO: 3881 - protein, 7 aa, Artificial Sequence
  Synthetic construct
GIIHDRY

SEQ ID NO: 3882 - protein, 7 aa, Artificial Sequence
  Synthetic construct
GIIHDCF

SEQ ID NO: 3883 - protein, 7 aa, Artificial Sequence
  Synthetic construct
GIIHDCY

SEQ ID NO: 3884 - protein, 7 aa, Artificial Sequence
  Synthetic construct
GIIHDLF

SEQ ID NO: 3885 - protein, 7 aa, Artificial Sequence
  Synthetic construct
GIIHDLY

SEQ ID NO: 3886 - protein, 7 aa, Artificial Sequence
  Synthetic construct
GIIHDAF

SEQ ID NO: 3887 - protein, 7 aa, Artificial Sequence
  Synthetic construct
GIIHDAY

SEQ ID NO: 3888 - protein, 7 aa, Artificial Sequence
  Synthetic construct
GIIHDQF

SEQ ID NO: 3889 - protein, 7 aa, Artificial Sequence
  Synthetic construct
GIIHDQY

SEQ ID NO: 3890 - protein, 7 aa, Artificial Sequence
  Synthetic construct
GIIHDDF

SEQ ID NO: 3891 - protein, 7 aa, Artificial Sequence
  Synthetic construct
GIIHDDY

SEQ ID NO: 3892 - protein, 7 aa, Artificial Sequence
  Synthetic construct
GIIHDVF

SEQ ID NO: 3893 - protein, 7 aa, Artificial Sequence
  Synthetic construct
GIIHDVY

SEQ ID NO: 3894 - protein, 7 aa, Artificial Sequence
  Synthetic construct
GIIHYFF

SEQ ID NO: 3895 - protein, 7 aa, Artificial Sequence
  Synthetic construct
GIIHYFY

SEQ ID NO: 3896 - protein, 7 aa, Artificial Sequence
  Synthetic construct
GIIHYRF

SEQ ID NO: 3897 - protein, 7 aa, Artificial Sequence
  Synthetic construct
GIIHYRY

SEQ ID NO: 3898 - protein, 7 aa, Artificial Sequence
  Synthetic construct
GIIHYCF

SEQ ID NO: 3899 - protein, 7 aa, Artificial Sequence
  Synthetic construct
GIIHYCY

SEQ ID NO: 3900 - protein, 7 aa, Artificial Sequence
  Synthetic construct
GIIHYLF

SEQ ID NO: 3901 - protein, 7 aa, Artificial Sequence
  Synthetic construct
GIIHYLY

SEQ ID NO: 3902 - protein, 7 aa, Artificial Sequence
  Synthetic construct
GIIHYAF

SEQ ID NO: 3903 - protein, 7 aa, Artificial Sequence
  Synthetic construct
GIIHYAY

SEQ ID NO: 3904 - protein, 7 aa, Artificial Sequence
  Synthetic construct
GIIHYQF

SEQ ID NO: 3905 - protein, 7 aa, Artificial Sequence
  Synthetic construct
GIIHYQY

SEQ ID NO: 3906 - protein, 7 aa, Artificial Sequence
  Synthetic construct
GIIHYDF

SEQ ID NO: 3907 - protein, 7 aa, Artificial Sequence
  Synthetic construct
GIIHYDY

SEQ ID NO: 3908 - protein, 7 aa, Artificial Sequence
  Synthetic construct
GIIHYVF

SEQ ID NO: 3909 - protein, 7 aa, Artificial Sequence
  Synthetic construct
GIIHYVY

SEQ ID NO: 3910 - protein, 7 aa, Artificial Sequence
  Synthetic construct
GIIHFFF

SEQ ID NO: 3911 - protein, 7 aa, Artificial Sequence
  Synthetic construct
GIIHFFY

SEQ ID NO: 3912 - protein, 7 aa, Artificial Sequence
  Synthetic construct
GIIHFRF

SEQ ID NO: 3913 - protein, 7 aa, Artificial Sequence
  Synthetic construct
GIIHFRY

SEQ ID NO: 3914 - protein, 7 aa, Artificial Sequence
  Synthetic construct
GIIHFCF

SEQ ID NO: 3915 - protein, 7 aa, Artificial Sequence
  Synthetic construct
GIIHFCY

SEQ ID NO: 3916 - protein, 7 aa, Artificial Sequence
  Synthetic construct
GIIHFLF

SEQ ID NO: 3917 - protein, 7 aa, Artificial Sequence
  Synthetic construct
GIIHFLY

SEQ ID NO: 3918 - protein, 7 aa, Artificial Sequence
  Synthetic construct
GIIHFAF

SEQ ID NO: 3919 - protein, 7 aa, Artificial Sequence
  Synthetic construct
GIIHFAY

SEQ ID NO: 3920 - protein, 7 aa, Artificial Sequence
  Synthetic construct
GIIHFQF

SEQ ID NO: 3921 - protein, 7 aa, Artificial Sequence
  Synthetic construct
GIIHFQY

SEQ ID NO: 3922 - protein, 7 aa, Artificial Sequence
  Synthetic construct
GIIHFDF

SEQ ID NO: 3923 - protein, 7 aa, Artificial Sequence
  Synthetic construct
GIIHFDY

SEQ ID NO: 3924 - protein, 7 aa, Artificial Sequence
  Synthetic construct
GIIHFVF

SEQ ID NO: 3925 - protein, 7 aa, Artificial Sequence
  Synthetic construct
GIIHFVY

SEQ ID NO: 3926 - protein, 7 aa, Artificial Sequence
  Synthetic construct
GIIHVFF

SEQ ID NO: 3927 - protein, 7 aa, Artificial Sequence
  Synthetic construct
GIIHVFY

SEQ ID NO: 3928 - protein, 7 aa, Artificial Sequence
  Synthetic construct
GIIHVRF

SEQ ID NO: 3929 - protein, 7 aa, Artificial Sequence
  Synthetic construct
GIIHVRY

SEQ ID NO: 3930 - protein, 7 aa, Artificial Sequence
  Synthetic construct
GIIHVCF

SEQ ID NO: 3931 - protein, 7 aa, Artificial Sequence
  Synthetic construct
GIIHVCY

SEQ ID NO: 3932 - protein, 7 aa, Artificial Sequence
  Synthetic construct
GIIHVLF

SEQ ID NO: 3933 - protein, 7 aa, Artificial Sequence
  Synthetic construct
GIIHVLY

SEQ ID NO: 3934 - protein, 7 aa, Artificial Sequence
  Synthetic construct
GIIHVAF

SEQ ID NO: 3935 - protein, 7 aa, Artificial Sequence
  Synthetic construct
GIIHVAY

SEQ ID NO: 3936 - protein, 7 aa, Artificial Sequence
  Synthetic construct
GIIHVQF

SEQ ID NO: 3937 - protein, 7 aa, Artificial Sequence
  Synthetic construct
GIIHVQY

SEQ ID NO: 3938 - protein, 7 aa, Artificial Sequence
  Synthetic construct
GIIHVDF

SEQ ID NO: 3939 - protein, 7 aa, Artificial Sequence
  Synthetic construct
GIIHVDY

SEQ ID NO: 3940 - protein, 7 aa, Artificial Sequence
  Synthetic construct
GIIHVVF

SEQ ID NO: 3941 - protein, 7 aa, Artificial Sequence
  Synthetic construct
GIIHVVY

SEQ ID NO: 3942 - protein, 7 aa, Artificial Sequence
  Synthetic construct
GIIHTFF

SEQ ID NO: 3943 - protein, 7 aa, Artificial Sequence
  Synthetic construct
GIIHTFY

SEQ ID NO: 3944 - protein, 7 aa, Artificial Sequence
  Synthetic construct
GIIHTRF

SEQ ID NO: 3945 - protein, 7 aa, Artificial Sequence
  Synthetic construct
GIIHTRY

SEQ ID NO: 3946 - protein, 7 aa, Artificial Sequence
  Synthetic construct
GIIHTCF

SEQ ID NO: 3947 - protein, 7 aa, Artificial Sequence
  Synthetic construct
GIIHTCY

SEQ ID NO: 3948 - protein, 7 aa, Artificial Sequence
  Synthetic construct
GIIHTLF

SEQ ID NO: 3949 - protein, 7 aa, Artificial Sequence
  Synthetic construct
GIIHTLY

SEQ ID NO: 3950 - protein, 7 aa, Artificial Sequence
  Synthetic construct
GIIHTAF

SEQ ID NO: 3951 - protein, 7 aa, Artificial Sequence
  Synthetic construct
GIIHTAY

SEQ ID NO: 3952 - protein, 7 aa, Artificial Sequence
  Synthetic construct
GIIHTQF

SEQ ID NO: 3953 - protein, 7 aa, Artificial Sequence
  Synthetic construct
GIIHTQY

SEQ ID NO: 3954 - protein, 7 aa, Artificial Sequence
  Synthetic construct
GIIHTDF

SEQ ID NO: 3955 - protein, 7 aa, Artificial Sequence
  Synthetic construct
GIIHTDY

SEQ ID NO: 3956 - protein, 7 aa, Artificial Sequence
  Synthetic construct
GIIHTVF

SEQ ID NO: 3957 - protein, 7 aa, Artificial Sequence
  Synthetic construct
GIIHTVY

SEQ ID NO: 3958 - protein, 7 aa, Artificial Sequence
  Synthetic construct
GIIHGFF

SEQ ID NO: 3959 - protein, 7 aa, Artificial Sequence
  Synthetic construct
GIIHGFY

SEQ ID NO: 3960 - protein, 7 aa, Artificial Sequence
  Synthetic construct
GIIHGRF

SEQ ID NO: 3961 - protein, 7 aa, Artificial Sequence
  Synthetic construct
GIIHGRY

SEQ ID NO: 3962 - protein, 7 aa, Artificial Sequence
  Synthetic construct
GIIHGCF

SEQ ID NO: 3963 - protein, 7 aa, Artificial Sequence
  Synthetic construct
GIIHGCY

SEQ ID NO: 3964 - protein, 7 aa, Artificial Sequence
  Synthetic construct
GIIHGLF

SEQ ID NO: 3965 - protein, 7 aa, Artificial Sequence
  Synthetic construct
GIIHGLY

SEQ ID NO: 3966 - protein, 7 aa, Artificial Sequence
  Synthetic construct
GIIHGAF

SEQ ID NO: 3967 - protein, 7 aa, Artificial Sequence
  Synthetic construct
GIIHGAY

SEQ ID NO: 3968 - protein, 7 aa, Artificial Sequence
  Synthetic construct
GIIHGQF

SEQ ID NO: 3969 - protein, 7 aa, Artificial Sequence
  Synthetic construct
GIIHGQY

SEQ ID NO: 3970 - protein, 7 aa, Artificial Sequence
  Synthetic construct
GIIHGDF

SEQ ID NO: 3971 - protein, 7 aa, Artificial Sequence
  Synthetic construct
GIIHGDY

SEQ ID NO: 3972 - protein, 7 aa, Artificial Sequence
  Synthetic construct
GIIHGVF

SEQ ID NO: 3973 - protein, 7 aa, Artificial Sequence
  Synthetic construct
GIIHGVY

SEQ ID NO: 3974 - protein, 7 aa, Artificial Sequence
  Synthetic construct
GIIHAFF

SEQ ID NO: 3975 - protein, 7 aa, Artificial Sequence
  Synthetic construct
GIIHAFY

SEQ ID NO: 3976 - protein, 7 aa, Artificial Sequence
  Synthetic construct
GIIHARF

SEQ ID NO: 3977 - protein, 7 aa, Artificial Sequence
  Synthetic construct
GIIHARY

SEQ ID NO: 3978 - protein, 7 aa, Artificial Sequence
  Synthetic construct
GIIHACF

SEQ ID NO: 3979 - protein, 7 aa, Artificial Sequence
  Synthetic construct
GIIHACY

SEQ ID NO: 3980 - protein, 7 aa, Artificial Sequence
  Synthetic construct
GIIHALF

SEQ ID NO: 3981 - protein, 7 aa, Artificial Sequence
  Synthetic construct
GIIHALY

SEQ ID NO: 3982 - protein, 7 aa, Artificial Sequence
  Synthetic construct
GIIHAAF

SEQ ID NO: 3983 - protein, 7 aa, Artificial Sequence
  Synthetic construct
GIIHAAY

SEQ ID NO: 3984 - protein, 7 aa, Artificial Sequence
  Synthetic construct
GIIHAQF

SEQ ID NO: 3985 - protein, 7 aa, Artificial Sequence
  Synthetic construct
GIIHAQY

SEQ ID NO: 3986 - protein, 7 aa, Artificial Sequence
  Synthetic construct
GIIHADF

SEQ ID NO: 3987 - protein, 7 aa, Artificial Sequence
  Synthetic construct
GIIHADY

SEQ ID NO: 3988 - protein, 7 aa, Artificial Sequence
  Synthetic construct
GIIHAVF

SEQ ID NO: 3989 - protein, 7 aa, Artificial Sequence
  Synthetic construct
GIIHAVY

SEQ ID NO: 3990 - protein, 7 aa, Artificial Sequence
  Synthetic construct
GIIHQFF

SEQ ID NO: 3991 - protein, 7 aa, Artificial Sequence
  Synthetic construct
GIIHQFY

SEQ ID NO: 3992 - protein, 7 aa, Artificial Sequence
  Synthetic construct
GIIHQRF

SEQ ID NO: 3993 - protein, 7 aa, Artificial Sequence
  Synthetic construct
GIIHQRY

SEQ ID NO: 3994 - protein, 7 aa, Artificial Sequence
  Synthetic construct
GIIHQCF

SEQ ID NO: 3995 - protein, 7 aa, Artificial Sequence
  Synthetic construct
GIIHQCY

SEQ ID NO: 3996 - protein, 7 aa, Artificial Sequence
  Synthetic construct
GIIHQLF

SEQ ID NO: 3997 - protein, 7 aa, Artificial Sequence
  Synthetic construct
GIIHQLY

SEQ ID NO: 3998 - protein, 7 aa, Artificial Sequence
  Synthetic construct
GIIHQAF

SEQ ID NO: 3999 - protein, 7 aa, Artificial Sequence
  Synthetic construct
GIIHQAY

SEQ ID NO: 4000 - protein, 7 aa, Artificial Sequence
  Synthetic construct
GIIHQQF

SEQ ID NO: 4001 - protein, 7 aa, Artificial Sequence
  Synthetic construct
GIIHQQY

SEQ ID NO: 4002 - protein, 7 aa, Artificial Sequence
  Synthetic construct
GIIHQDF

SEQ ID NO: 4003 - protein, 7 aa, Artificial Sequence
  Synthetic construct
GIIHQDY

SEQ ID NO: 4004 - protein, 7 aa, Artificial Sequence
  Synthetic construct
GIIHQVF

SEQ ID NO: 4005 - protein, 7 aa, Artificial Sequence
  Synthetic construct
GIIHQVY

SEQ ID NO: 4006 - protein, 7 aa, Artificial Sequence
  Synthetic construct
GIILIFF

SEQ ID NO: 4007 - protein, 7 aa, Artificial Sequence
  Synthetic construct
GIILIFY

SEQ ID NO: 4008 - protein, 7 aa, Artificial Sequence
  Synthetic construct
GIILIRF

SEQ ID NO: 4009 - protein, 7 aa, Artificial Sequence
  Synthetic construct
GIILIRY

SEQ ID NO: 4010 - protein, 7 aa, Artificial Sequence
  Synthetic construct
GIILICF

SEQ ID NO: 4011 - protein, 7 aa, Artificial Sequence
  Synthetic construct
GIILICY

SEQ ID NO: 4012 - protein, 7 aa, Artificial Sequence
  Synthetic construct
GIILILF

SEQ ID NO: 4013 - protein, 7 aa, Artificial Sequence
  Synthetic construct
GIILILY

SEQ ID NO: 4014 - protein, 7 aa, Artificial Sequence
  Synthetic construct
GIILIAF

SEQ ID NO: 4015 - protein, 7 aa, Artificial Sequence
  Synthetic construct
GIILIAY

SEQ ID NO: 4016 - protein, 7 aa, Artificial Sequence
  Synthetic construct
GIILIQF

SEQ ID NO: 4017 - protein, 7 aa, Artificial Sequence
  Synthetic construct
GIILIQY

SEQ ID NO: 4018 - protein, 7 aa, Artificial Sequence
  Synthetic construct
GIILIDF

SEQ ID NO: 4019 - protein, 7 aa, Artificial Sequence
  Synthetic construct
GIILIDY

SEQ ID NO: 4020 - protein, 7 aa, Artificial Sequence
  Synthetic construct
GIILIVF

SEQ ID NO: 4021 - protein, 7 aa, Artificial Sequence
  Synthetic construct
GIILIVY

SEQ ID NO: 4022 - protein, 7 aa, Artificial Sequence
  Synthetic construct
GIILDFF

SEQ ID NO: 4023 - protein, 7 aa, Artificial Sequence
  Synthetic construct
GIILDFY

SEQ ID NO: 4024 - protein, 7 aa, Artificial Sequence
  Synthetic construct
GIILDRF

SEQ ID NO: 4025 - protein, 7 aa, Artificial Sequence
  Synthetic construct
GIILDRY

SEQ ID NO: 4026 - protein, 7 aa, Artificial Sequence
  Synthetic construct
GIILDCF

SEQ ID NO: 4027 - protein, 7 aa, Artificial Sequence
  Synthetic construct
GIILDCY

SEQ ID NO: 4028 - protein, 7 aa, Artificial Sequence
  Synthetic construct
GIILDLF

SEQ ID NO: 4029 - protein, 7 aa, Artificial Sequence
  Synthetic construct
GIILDLY

SEQ ID NO: 4030 - protein, 7 aa, Artificial Sequence
  Synthetic construct
GIILDAF

SEQ ID NO: 4031 - protein, 7 aa, Artificial Sequence
  Synthetic construct
GIILDAY

SEQ ID NO: 4032 - protein, 7 aa, Artificial Sequence
  Synthetic construct
GIILDQF

SEQ ID NO: 4033 - protein, 7 aa, Artificial Sequence
  Synthetic construct
GIILDQY

SEQ ID NO: 4034 - protein, 7 aa, Artificial Sequence
  Synthetic construct
GIILDDF

SEQ ID NO: 4035 - protein, 7 aa, Artificial Sequence
  Synthetic construct
GIILDDY

SEQ ID NO: 4036 - protein, 7 aa, Artificial Sequence
  Synthetic construct
GIILDVF

SEQ ID NO: 4037 - protein, 7 aa, Artificial Sequence
  Synthetic construct
GIILDVY

SEQ ID NO: 4038 - protein, 7 aa, Artificial Sequence
  Synthetic construct
GIILYFF

SEQ ID NO: 4039 - protein, 7 aa, Artificial Sequence
  Synthetic construct
GIILYFY

SEQ ID NO: 4040 - protein, 7 aa, Artificial Sequence
  Synthetic construct
GIILYRF

SEQ ID NO: 4041 - protein, 7 aa, Artificial Sequence
  Synthetic construct
GIILYRY

SEQ ID NO: 4042 - protein, 7 aa, Artificial Sequence
  Synthetic construct
GIILYCF

SEQ ID NO: 4043 - protein, 7 aa, Artificial Sequence
  Synthetic construct
GIILYCY

SEQ ID NO: 4044 - protein, 7 aa, Artificial Sequence
  Synthetic construct
GIILYLF

SEQ ID NO: 4045 - protein, 7 aa, Artificial Sequence
  Synthetic construct
GIILYLY

SEQ ID NO: 4046 - protein, 7 aa, Artificial Sequence
  Synthetic construct
GIILYAF

SEQ ID NO: 4047 - protein, 7 aa, Artificial Sequence
  Synthetic construct
GIILYAY

SEQ ID NO: 4048 - protein, 7 aa, Artificial Sequence
  Synthetic construct
GIILYQF

SEQ ID NO: 4049 - protein, 7 aa, Artificial Sequence
  Synthetic construct
GIILYQY

SEQ ID NO: 4050 - protein, 7 aa, Artificial Sequence
  Synthetic construct
GIILYDF

SEQ ID NO: 4051 - protein, 7 aa, Artificial Sequence
  Synthetic construct
GIILYDY

SEQ ID NO: 4052 - protein, 7 aa, Artificial Sequence
  Synthetic construct
GIILYVF

SEQ ID NO: 4053 - protein, 7 aa, Artificial Sequence
  Synthetic construct
GIILYVY

SEQ ID NO: 4054 - protein, 7 aa, Artificial Sequence
  Synthetic construct
GIILFFF

SEQ ID NO: 4055 - protein, 7 aa, Artificial Sequence
  Synthetic construct
GIILFFY

SEQ ID NO: 4056 - protein, 7 aa, Artificial Sequence
  Synthetic construct
GIILFRF

SEQ ID NO: 4057 - protein, 7 aa, Artificial Sequence
  Synthetic construct
GIILFRY

SEQ ID NO: 4058 - protein, 7 aa, Artificial Sequence
  Synthetic construct
GIILFCF

SEQ ID NO: 4059 - protein, 7 aa, Artificial Sequence
  Synthetic construct
GIILFCY

SEQ ID NO: 4060 - protein, 7 aa, Artificial Sequence
  Synthetic construct
GIILFLF

SEQ ID NO: 4061 - protein, 7 aa, Artificial Sequence
  Synthetic construct
GIILFLY

SEQ ID NO: 4062 - protein, 7 aa, Artificial Sequence
  Synthetic construct
GIILFAF

SEQ ID NO: 4063 - protein, 7 aa, Artificial Sequence
  Synthetic construct
GIILFAY

SEQ ID NO: 4064 - protein, 7 aa, Artificial Sequence
  Synthetic construct
GIILFQF

SEQ ID NO: 4065 - protein, 7 aa, Artificial Sequence
  Synthetic construct
GIILFQY

SEQ ID NO: 4066 - protein, 7 aa, Artificial Sequence
  Synthetic construct
GIILFDF

SEQ ID NO: 4067 - protein, 7 aa, Artificial Sequence
  Synthetic construct
GIILFDY

SEQ ID NO: 4068 - protein, 7 aa, Artificial Sequence
  Synthetic construct
GIILFVF

SEQ ID NO: 4069 - protein, 7 aa, Artificial Sequence
  Synthetic construct
GIILFVY

SEQ ID NO: 4070 - protein, 7 aa, Artificial Sequence
  Synthetic construct
GIILVFF

SEQ ID NO: 4071 - protein, 7 aa, Artificial Sequence
  Synthetic construct
GIILVFY

SEQ ID NO: 4072 - protein, 7 aa, Artificial Sequence
  Synthetic construct
GIILVRF

SEQ ID NO: 4073 - protein, 7 aa, Artificial Sequence
  Synthetic construct
GIILVRY

SEQ ID NO: 4074 - protein, 7 aa, Artificial Sequence
  Synthetic construct
GIILVCF

SEQ ID NO: 4075 - protein, 7 aa, Artificial Sequence
  Synthetic construct
GIILVCY

SEQ ID NO: 4076 - protein, 7 aa, Artificial Sequence
  Synthetic construct
GIILVLF

SEQ ID NO: 4077 - protein, 7 aa, Artificial Sequence
  Synthetic construct
GIILVLY

SEQ ID NO: 4078 - protein, 7 aa, Artificial Sequence
  Synthetic construct
GIILVAF

SEQ ID NO: 4079 - protein, 7 aa, Artificial Sequence
  Synthetic construct
GIILVAY

SEQ ID NO: 4080 - protein, 7 aa, Artificial Sequence
  Synthetic construct
GIILVQF

SEQ ID NO: 4081 - protein, 7 aa, Artificial Sequence
  Synthetic construct
GIILVQY

SEQ ID NO: 4082 - protein, 7 aa, Artificial Sequence
  Synthetic construct
GIILVDF

SEQ ID NO: 4083 - protein, 7 aa, Artificial Sequence
  Synthetic construct
GIILVDY

SEQ ID NO: 4084 - protein, 7 aa, Artificial Sequence
  Synthetic construct
GIILVVF

SEQ ID NO: 4085 - protein, 7 aa, Artificial Sequence
  Synthetic construct
GIILVVY

SEQ ID NO: 4086 - protein, 7 aa, Artificial Sequence
  Synthetic construct
GIILTFF

SEQ ID NO: 4087 - protein, 7 aa, Artificial Sequence
  Synthetic construct
GIILTFY

SEQ ID NO: 4088 - protein, 7 aa, Artificial Sequence
  Synthetic construct
GIILTRF

SEQ ID NO: 4089 - protein, 7 aa, Artificial Sequence
  Synthetic construct
GIILTRY

SEQ ID NO: 4090 - protein, 7 aa, Artificial Sequence
  Synthetic construct
GIILTCF

SEQ ID NO: 4091 - protein, 7 aa, Artificial Sequence
  Synthetic construct
GIILTCY

SEQ ID NO: 4092 - protein, 7 aa, Artificial Sequence
  Synthetic construct
GIILTLF

SEQ ID NO: 4093 - protein, 7 aa, Artificial Sequence
  Synthetic construct
GIILTLY

SEQ ID NO: 4094 - protein, 7 aa, Artificial Sequence
  Synthetic construct
GIILTAF

SEQ ID NO: 4095 - protein, 7 aa, Artificial Sequence
  Synthetic construct
GIILTAY

SEQ ID NO: 4096 - protein, 7 aa, Artificial Sequence
  Synthetic construct
GIILTQF

SEQ ID NO: 4097 - protein, 7 aa, Artificial Sequence
  Synthetic construct
GIILTQY

SEQ ID NO: 4098 - protein, 7 aa, Artificial Sequence
  Synthetic construct
GIILTDF

SEQ ID NO: 4099 - protein, 7 aa, Artificial Sequence
  Synthetic construct
GIILTDY

SEQ ID NO: 4100 - protein, 7 aa, Artificial Sequence
  Synthetic construct
GIILTVF

SEQ ID NO: 4101 - protein, 7 aa, Artificial Sequence
  Synthetic construct
GIILTVY

SEQ ID NO: 4102 - protein, 7 aa, Artificial Sequence
  Synthetic construct
GIILGFF

SEQ ID NO: 4103 - protein, 7 aa, Artificial Sequence
  Synthetic construct
GIILGFY

SEQ ID NO: 4104 - protein, 7 aa, Artificial Sequence
  Synthetic construct
GIILGRF

SEQ ID NO: 4105 - protein, 7 aa, Artificial Sequence
  Synthetic construct
GIILGRY

SEQ ID NO: 4106 - protein, 7 aa, Artificial Sequence
  Synthetic construct
GIILGCF

SEQ ID NO: 4107 - protein, 7 aa, Artificial Sequence
  Synthetic construct
GIILGCY

SEQ ID NO: 4108 - protein, 7 aa, Artificial Sequence
  Synthetic construct
GIILGLF

SEQ ID NO: 4109 - protein, 7 aa, Artificial Sequence
  Synthetic construct
GIILGLY

SEQ ID NO: 4110 - protein, 7 aa, Artificial Sequence
  Synthetic construct
GIILGAF

SEQ ID NO: 4111 - protein, 7 aa, Artificial Sequence
  Synthetic construct
GIILGAY

SEQ ID NO: 4112 - protein, 7 aa, Artificial Sequence
  Synthetic construct
GIILGQF

SEQ ID NO: 4113 - protein, 7 aa, Artificial Sequence
  Synthetic construct
GIILGQY

SEQ ID NO: 4114 - protein, 7 aa, Artificial Sequence
  Synthetic construct
GIILGDF

SEQ ID NO: 4115 - protein, 7 aa, Artificial Sequence
  Synthetic construct
GIILGDY

SEQ ID NO: 4116 - protein, 7 aa, Artificial Sequence
  Synthetic construct
GIILGVF

SEQ ID NO: 4117 - protein, 7 aa, Artificial Sequence
  Synthetic construct
GIILGVY

SEQ ID NO: 4118 - protein, 7 aa, Artificial Sequence
  Synthetic construct
GIILAFF

SEQ ID NO: 4119 - protein, 7 aa, Artificial Sequence
  Synthetic construct
GIILAFY

SEQ ID NO: 4120 - protein, 7 aa, Artificial Sequence
  Synthetic construct
GIILARF

SEQ ID NO: 4121 - protein, 7 aa, Artificial Sequence
  Synthetic construct
GIILARY

SEQ ID NO: 4122 - protein, 7 aa, Artificial Sequence
  Synthetic construct
GIILACF

SEQ ID NO: 4123 - protein, 7 aa, Artificial Sequence
  Synthetic construct
GIILACY

SEQ ID NO: 4124 - protein, 7 aa, Artificial Sequence
  Synthetic construct
GIILALF

SEQ ID NO: 4125 - protein, 7 aa, Artificial Sequence
  Synthetic construct
GIILALY

SEQ ID NO: 4126 - protein, 7 aa, Artificial Sequence
  Synthetic construct
GIILAAF

SEQ ID NO: 4127 - protein, 7 aa, Artificial Sequence
  Synthetic construct
GIILAAY

SEQ ID NO: 4128 - protein, 7 aa, Artificial Sequence
  Synthetic construct
GIILAQF

SEQ ID NO: 4129 - protein, 7 aa, Artificial Sequence
  Synthetic construct
GIILAQY

SEQ ID NO: 4130 - protein, 7 aa, Artificial Sequence
  Synthetic construct
GIILADF

SEQ ID NO: 4131 - protein, 7 aa, Artificial Sequence
  Synthetic construct
GIILADY

SEQ ID NO: 4132 - protein, 7 aa, Artificial Sequence
  Synthetic construct
GIILAVF

SEQ ID NO: 4133 - protein, 7 aa, Artificial Sequence
  Synthetic construct
GIILAVY

SEQ ID NO: 4134 - protein, 7 aa, Artificial Sequence
  Synthetic construct
GIILQFF

SEQ ID NO: 4135 - protein, 7 aa, Artificial Sequence
  Synthetic construct
GIILQFY

SEQ ID NO: 4136 - protein, 7 aa, Artificial Sequence
  Synthetic construct
GIILQRF

SEQ ID NO: 4137 - protein, 7 aa, Artificial Sequence
  Synthetic construct
GIILQRY

SEQ ID NO: 4138 - protein, 7 aa, Artificial Sequence
  Synthetic construct
GIILQCF

SEQ ID NO: 4139 - protein, 7 aa, Artificial Sequence
  Synthetic construct
GIILQCY

SEQ ID NO: 4140 - protein, 7 aa, Artificial Sequence
  Synthetic construct
GIILQLF

SEQ ID NO: 4141 - protein, 7 aa, Artificial Sequence
  Synthetic construct
GIILQLY

SEQ ID NO: 4142 - protein, 7 aa, Artificial Sequence
  Synthetic construct
GIILQAF

SEQ ID NO: 4143 - protein, 7 aa, Artificial Sequence
  Synthetic construct
GIILQAY

SEQ ID NO: 4144 - protein, 7 aa, Artificial Sequence
  Synthetic construct
GIILQQF

SEQ ID NO: 4145 - protein, 7 aa, Artificial Sequence
  Synthetic construct
GIILQQY

SEQ ID NO: 4146 - protein, 7 aa, Artificial Sequence
  Synthetic construct
GIILQDF

SEQ ID NO: 4147 - protein, 7 aa, Artificial Sequence
  Synthetic construct
GIILQDY

SEQ ID NO: 4148 - protein, 7 aa, Artificial Sequence
  Synthetic construct
GIILQVF

SEQ ID NO: 4149 - protein, 7 aa, Artificial Sequence
  Synthetic construct
GIILQVY

SEQ ID NO: 4150 - protein, 7 aa, Artificial Sequence
  Synthetic construct
GIIFIFF

SEQ ID NO: 4151 - protein, 7 aa, Artificial Sequence
  Synthetic construct
GIIFIFY

SEQ ID NO: 4152 - protein, 7 aa, Artificial Sequence
  Synthetic construct
GIIFIRF

SEQ ID NO: 4153 - protein, 7 aa, Artificial Sequence
  Synthetic construct
GIIFIRY

SEQ ID NO: 4154 - protein, 7 aa, Artificial Sequence
  Synthetic construct
GIIFICF

SEQ ID NO: 4155 - protein, 7 aa, Artificial Sequence
  Synthetic construct
GIIFICY

SEQ ID NO: 4156 - protein, 7 aa, Artificial Sequence
  Synthetic construct
GIIFILF

SEQ ID NO: 4157 - protein, 7 aa, Artificial Sequence
  Synthetic construct
GIIFILY

SEQ ID NO: 4158 - protein, 7 aa, Artificial Sequence
  Synthetic construct
GIIFIAF

SEQ ID NO: 4159 - protein, 7 aa, Artificial Sequence
  Synthetic construct
GIIFIAY

SEQ ID NO: 4160 - protein, 7 aa, Artificial Sequence
  Synthetic construct
GIIFIQF

SEQ ID NO: 4161 - protein, 7 aa, Artificial Sequence
  Synthetic construct
GIIFIQY

SEQ ID NO: 4162 - protein, 7 aa, Artificial Sequence
  Synthetic construct
GIIFIDF

SEQ ID NO: 4163 - protein, 7 aa, Artificial Sequence
  Synthetic construct
GIIFIDY

SEQ ID NO: 4164 - protein, 7 aa, Artificial Sequence
  Synthetic construct
GIIFIVF

SEQ ID NO: 4165 - protein, 7 aa, Artificial Sequence
  Synthetic construct
GIIFIVY

SEQ ID NO: 4166 - protein, 7 aa, Artificial Sequence
  Synthetic construct
GIIFDFF

SEQ ID NO: 4167 - protein, 7 aa, Artificial Sequence
  Synthetic construct
GIIFDFY

SEQ ID NO: 4168 - protein, 7 aa, Artificial Sequence
  Synthetic construct
GIIFDRF

SEQ ID NO: 4169 - protein, 7 aa, Artificial Sequence
  Synthetic construct
GIIFDRY

SEQ ID NO: 4170 - protein, 7 aa, Artificial Sequence
  Synthetic construct
GIIFDCF

SEQ ID NO: 4171 - protein, 7 aa, Artificial Sequence
  Synthetic construct
GIIFDCY

SEQ ID NO: 4172 - protein, 7 aa, Artificial Sequence
  Synthetic construct
GIIFDLF

SEQ ID NO: 4173 - protein, 7 aa, Artificial Sequence
  Synthetic construct
GIIFDLY

SEQ ID NO: 4174 - protein, 7 aa, Artificial Sequence
  Synthetic construct
GIIFDAF

SEQ ID NO: 4175 - protein, 7 aa, Artificial Sequence
  Synthetic construct
GIIFDAY

SEQ ID NO: 4176 - protein, 7 aa, Artificial Sequence
  Synthetic construct
GIIFDQF

SEQ ID NO: 4177 - protein, 7 aa, Artificial Sequence
  Synthetic construct
GIIFDQY

SEQ ID NO: 4178 - protein, 7 aa, Artificial Sequence
  Synthetic construct
GIIFDDF

SEQ ID NO: 4179 - protein, 7 aa, Artificial Sequence
  Synthetic construct
GIIFDDY

SEQ ID NO: 4180 - protein, 7 aa, Artificial Sequence
  Synthetic construct
GIIFDVF

SEQ ID NO: 4181 - protein, 7 aa, Artificial Sequence
  Synthetic construct
GIIFDVY

SEQ ID NO: 4182 - protein, 7 aa, Artificial Sequence
  Synthetic construct
GIIFYFF

SEQ ID NO: 4183 - protein, 7 aa, Artificial Sequence
  Synthetic construct
GIIFYFY

SEQ ID NO: 4184 - protein, 7 aa, Artificial Sequence
  Synthetic construct
GIIFYRF

SEQ ID NO: 4185 - protein, 7 aa, Artificial Sequence
  Synthetic construct
GIIFYRY

SEQ ID NO: 4186 - protein, 7 aa, Artificial Sequence
  Synthetic construct
GIIFYCF

SEQ ID NO: 4187 - protein, 7 aa, Artificial Sequence
  Synthetic construct
GIIFYCY

SEQ ID NO: 4188 - protein, 7 aa, Artificial Sequence
  Synthetic construct
GIIFYLF

SEQ ID NO: 4189 - protein, 7 aa, Artificial Sequence
  Synthetic construct
GIIFYLY

SEQ ID NO: 4190 - protein, 7 aa, Artificial Sequence
  Synthetic construct
GIIFYAF

SEQ ID NO: 4191 - protein, 7 aa, Artificial Sequence
  Synthetic construct
GIIFYAY

SEQ ID NO: 4192 - protein, 7 aa, Artificial Sequence
  Synthetic construct
GIIFYQF

SEQ ID NO: 4193 - protein, 7 aa, Artificial Sequence
  Synthetic construct
GIIFYQY

SEQ ID NO: 4194 - protein, 7 aa, Artificial Sequence
  Synthetic construct
GIIFYDF

SEQ ID NO: 4195 - protein, 7 aa, Artificial Sequence
  Synthetic construct
GIIFYDY

SEQ ID NO: 4196 - protein, 7 aa, Artificial Sequence
  Synthetic construct
GIIFYVF

SEQ ID NO: 4197 - protein, 7 aa, Artificial Sequence
  Synthetic construct
GIIFYVY

SEQ ID NO: 4198 - protein, 7 aa, Artificial Sequence
  Synthetic construct
GIIFFFF

SEQ ID NO: 4199 - protein, 7 aa, Artificial Sequence
  Synthetic construct
GIIFFFY

SEQ ID NO: 4200 - protein, 7 aa, Artificial Sequence
  Synthetic construct
GIIFFRF

SEQ ID NO: 4201 - protein, 7 aa, Artificial Sequence
  Synthetic construct
GIIFFRY

SEQ ID NO: 4202 - protein, 7 aa, Artificial Sequence
  Synthetic construct
GIIFFCF

SEQ ID NO: 4203 - protein, 7 aa, Artificial Sequence
  Synthetic construct
GIIFFCY

SEQ ID NO: 4204 - protein, 7 aa, Artificial Sequence
  Synthetic construct
GIIFFLF

SEQ ID NO: 4205 - protein, 7 aa, Artificial Sequence
  Synthetic construct
GIIFFLY

SEQ ID NO: 4206 - protein, 7 aa, Artificial Sequence
  Synthetic construct
GIIFFAF

SEQ ID NO: 4207 - protein, 7 aa, Artificial Sequence
  Synthetic construct
GIIFFAY

SEQ ID NO: 4208 - protein, 7 aa, Artificial Sequence
  Synthetic construct
GIIFFQF

SEQ ID NO: 4209 - protein, 7 aa, Artificial Sequence
  Synthetic construct
GIIFFQY

SEQ ID NO: 4210 - protein, 7 aa, Artificial Sequence
  Synthetic construct
GIIFFDF

SEQ ID NO: 4211 - protein, 7 aa, Artificial Sequence
  Synthetic construct
GIIFFDY

SEQ ID NO: 4212 - protein, 7 aa, Artificial Sequence
  Synthetic construct
GIIFFVF

SEQ ID NO: 4213 - protein, 7 aa, Artificial Sequence
  Synthetic construct
GIIFFVY

SEQ ID NO: 4214 - protein, 7 aa, Artificial Sequence
  Synthetic construct
GIIFVFF

SEQ ID NO: 4215 - protein, 7 aa, Artificial Sequence
  Synthetic construct
GIIFVFY

SEQ ID NO: 4216 - protein, 7 aa, Artificial Sequence
  Synthetic construct
GIIFVRF

SEQ ID NO: 4217 - protein, 7 aa, Artificial Sequence
  Synthetic construct
GIIFVRY

SEQ ID NO: 4218 - protein, 7 aa, Artificial Sequence
  Synthetic construct
GIIFVCF

SEQ ID NO: 4219 - protein, 7 aa, Artificial Sequence
  Synthetic construct
GIIFVCY

SEQ ID NO: 4220 - protein, 7 aa, Artificial Sequence
  Synthetic construct
GIIFVLF

SEQ ID NO: 4221 - protein, 7 aa, Artificial Sequence
  Synthetic construct
GIIFVLY

SEQ ID NO: 4222 - protein, 7 aa, Artificial Sequence
  Synthetic construct
GIIFVAF

SEQ ID NO: 4223 - protein, 7 aa, Artificial Sequence
  Synthetic construct
GIIFVAY

SEQ ID NO: 4224 - protein, 7 aa, Artificial Sequence
  Synthetic construct
GIIFVQF

SEQ ID NO: 4225 - protein, 7 aa, Artificial Sequence
  Synthetic construct
GIIFVQY

SEQ ID NO: 4226 - protein, 7 aa, Artificial Sequence
  Synthetic construct
GIIFVDF

SEQ ID NO: 4227 - protein, 7 aa, Artificial Sequence
  Synthetic construct
GIIFVDY

SEQ ID NO: 4228 - protein, 7 aa, Artificial Sequence
  Synthetic construct
GIIFVVF

SEQ ID NO: 4229 - protein, 7 aa, Artificial Sequence
  Synthetic construct
GIIFVVY

SEQ ID NO: 4230 - protein, 7 aa, Artificial Sequence
  Synthetic construct
GIIFTFF

SEQ ID NO: 4231 - protein, 7 aa, Artificial Sequence
  Synthetic construct
GIIFTFY

SEQ ID NO: 4232 - protein, 7 aa, Artificial Sequence
  Synthetic construct
GIIFTRF

SEQ ID NO: 4233 - protein, 7 aa, Artificial Sequence
  Synthetic construct
GIIFTRY

SEQ ID NO: 4234 - protein, 7 aa, Artificial Sequence
  Synthetic construct
GIIFTCF

SEQ ID NO: 4235 - protein, 7 aa, Artificial Sequence
  Synthetic construct
GIIFTCY

SEQ ID NO: 4236 - protein, 7 aa, Artificial Sequence
  Synthetic construct
GIIFTLF

SEQ ID NO: 4237 - protein, 7 aa, Artificial Sequence
  Synthetic construct
GIIFTLY

SEQ ID NO: 4238 - protein, 7 aa, Artificial Sequence
  Synthetic construct
GIIFTAF

SEQ ID NO: 4239 - protein, 7 aa, Artificial Sequence
  Synthetic construct
GIIFTAY

SEQ ID NO: 4240 - protein, 7 aa, Artificial Sequence
  Synthetic construct
GIIFTQF

SEQ ID NO: 4241 - protein, 7 aa, Artificial Sequence
  Synthetic construct
GIIFTQY

SEQ ID NO: 4242 - protein, 7 aa, Artificial Sequence
  Synthetic construct
GIIFTDF

SEQ ID NO: 4243 - protein, 7 aa, Artificial Sequence
  Synthetic construct
GIIFTDY

SEQ ID NO: 4244 - protein, 7 aa, Artificial Sequence
  Synthetic construct
GIIFTVF

SEQ ID NO: 4245 - protein, 7 aa, Artificial Sequence
  Synthetic construct
GIIFTVY

SEQ ID NO: 4246 - protein, 7 aa, Artificial Sequence
  Synthetic construct
GIIFGFF

SEQ ID NO: 4247 - protein, 7 aa, Artificial Sequence
  Synthetic construct
GIIFGFY

SEQ ID NO: 4248 - protein, 7 aa, Artificial Sequence
  Synthetic construct
GIIFGRF

SEQ ID NO: 4249 - protein, 7 aa, Artificial Sequence
  Synthetic construct
GIIFGRY

SEQ ID NO: 4250 - protein, 7 aa, Artificial Sequence
  Synthetic construct
GIIFGCF

SEQ ID NO: 4251 - protein, 7 aa, Artificial Sequence
  Synthetic construct
GIIFGCY

SEQ ID NO: 4252 - protein, 7 aa, Artificial Sequence
  Synthetic construct
GIIFGLF

SEQ ID NO: 4253 - protein, 7 aa, Artificial Sequence
  Synthetic construct
GIIFGLY

SEQ ID NO: 4254 - protein, 7 aa, Artificial Sequence
  Synthetic construct
GIIFGAF

SEQ ID NO: 4255 - protein, 7 aa, Artificial Sequence
  Synthetic construct
GIIFGAY

SEQ ID NO: 4256 - protein, 7 aa, Artificial Sequence
  Synthetic construct
GIIFGQF

SEQ ID NO: 4257 - protein, 7 aa, Artificial Sequence
  Synthetic construct
GIIFGQY

SEQ ID NO: 4258 - protein, 7 aa, Artificial Sequence
  Synthetic construct
GIIFGDF

SEQ ID NO: 4259 - protein, 7 aa, Artificial Sequence
  Synthetic construct
GIIFGDY

SEQ ID NO: 4260 - protein, 7 aa, Artificial Sequence
  Synthetic construct
GIIFGVF

SEQ ID NO: 4261 - protein, 7 aa, Artificial Sequence
  Synthetic construct
GIIFGVY

SEQ ID NO: 4262 - protein, 7 aa, Artificial Sequence
  Synthetic construct
GIIFAFF

SEQ ID NO: 4263 - protein, 7 aa, Artificial Sequence
  Synthetic construct
GIIFAFY

SEQ ID NO: 4264 - protein, 7 aa, Artificial Sequence
  Synthetic construct
GIIFARF

SEQ ID NO: 4265 - protein, 7 aa, Artificial Sequence
  Synthetic construct
GIIFARY

SEQ ID NO: 4266 - protein, 7 aa, Artificial Sequence
  Synthetic construct
GIIFACF

SEQ ID NO: 4267 - protein, 7 aa, Artificial Sequence
  Synthetic construct
GIIFACY

SEQ ID NO: 4268 - protein, 7 aa, Artificial Sequence
  Synthetic construct
GIIFALF

SEQ ID NO: 4269 - protein, 7 aa, Artificial Sequence
  Synthetic construct
GIIFALY

SEQ ID NO: 4270 - protein, 7 aa, Artificial Sequence
  Synthetic construct
GIIFAAF

SEQ ID NO: 4271 - protein, 7 aa, Artificial Sequence
  Synthetic construct
GIIFAAY

SEQ ID NO: 4272 - protein, 7 aa, Artificial Sequence
  Synthetic construct
GIIFAQF

SEQ ID NO: 4273 - protein, 7 aa, Artificial Sequence
  Synthetic construct
GIIFAQY

SEQ ID NO: 4274 - protein, 7 aa, Artificial Sequence
  Synthetic construct
GIIFADF

SEQ ID NO: 4275 - protein, 7 aa, Artificial Sequence
  Synthetic construct
GIIFADY

SEQ ID NO: 4276 - protein, 7 aa, Artificial Sequence
  Synthetic construct
GIIFAVF

SEQ ID NO: 4277 - protein, 7 aa, Artificial Sequence
  Synthetic construct
GIIFAVY

SEQ ID NO: 4278 - protein, 7 aa, Artificial Sequence
  Synthetic construct
GIIFQFF

SEQ ID NO: 4279 - protein, 7 aa, Artificial Sequence
  Synthetic construct
GIIFQFY

SEQ ID NO: 4280 - protein, 7 aa, Artificial Sequence
  Synthetic construct
GIIFQRF

SEQ ID NO: 4281 - protein, 7 aa, Artificial Sequence
  Synthetic construct
GIIFQRY

SEQ ID NO: 4282 - protein, 7 aa, Artificial Sequence
  Synthetic construct
GIIFQCF

SEQ ID NO: 4283 - protein, 7 aa, Artificial Sequence
  Synthetic construct
GIIFQCY

SEQ ID NO: 4284 - protein, 7 aa, Artificial Sequence
  Synthetic construct
GIIFQLF

SEQ ID NO: 4285 - protein, 7 aa, Artificial Sequence
  Synthetic construct
GIIFQLY

SEQ ID NO: 4286 - protein, 7 aa, Artificial Sequence
  Synthetic construct
GIIFQAF

SEQ ID NO: 4287 - protein, 7 aa, Artificial Sequence
  Synthetic construct
GIIFQAY

SEQ ID NO: 4288 - protein, 7 aa, Artificial Sequence
  Synthetic construct
GIIFQQF

SEQ ID NO: 4289 - protein, 7 aa, Artificial Sequence
  Synthetic construct
GIIFQQY

SEQ ID NO: 4290 - protein, 7 aa, Artificial Sequence
  Synthetic construct
GIIFQDF

SEQ ID NO: 4291 - protein, 7 aa, Artificial Sequence
  Synthetic construct
GIIFQDY

SEQ ID NO: 4292 - protein, 7 aa, Artificial Sequence
  Synthetic construct
GIIFQVF

SEQ ID NO: 4293 - protein, 7 aa, Artificial Sequence
  Synthetic construct
GIIFQVY

SEQ ID NO: 4294 - protein, 7 aa, Artificial Sequence
  Synthetic construct
GIGYIFF

SEQ ID NO: 4295 - protein, 7 aa, Artificial Sequence
  Synthetic construct
GIGYIFY

SEQ ID NO: 4296 - protein, 7 aa, Artificial Sequence
  Synthetic construct
GIGYIRF

SEQ ID NO: 4297 - protein, 7 aa, Artificial Sequence
  Synthetic construct
GIGYIRY

SEQ ID NO: 4298 - protein, 7 aa, Artificial Sequence
  Synthetic construct
GIGYICF

SEQ ID NO: 4299 - protein, 7 aa, Artificial Sequence
  Synthetic construct
GIGYICY

SEQ ID NO: 4300 - protein, 7 aa, Artificial Sequence
  Synthetic construct
GIGYILF

SEQ ID NO: 4301 - protein, 7 aa, Artificial Sequence
  Synthetic construct
GIGYILY

SEQ ID NO: 4302 - protein, 7 aa, Artificial Sequence
  Synthetic construct
GIGYIAF

SEQ ID NO: 4303 - protein, 7 aa, Artificial Sequence
  Synthetic construct
GIGYIAY

SEQ ID NO: 4304 - protein, 7 aa, Artificial Sequence
  Synthetic construct
GIGYIQF

SEQ ID NO: 4305 - protein, 7 aa, Artificial Sequence
  Synthetic construct
GIGYIQY

SEQ ID NO: 4306 - protein, 7 aa, Artificial Sequence
  Synthetic construct
GIGYIDF

SEQ ID NO: 4307 - protein, 7 aa, Artificial Sequence
  Synthetic construct
GIGYIDY

SEQ ID NO: 4308 - protein, 7 aa, Artificial Sequence
  Synthetic construct
GIGYIVF

SEQ ID NO: 4309 - protein, 7 aa, Artificial Sequence
  Synthetic construct
GIGYIVY

SEQ ID NO: 4310 - protein, 7 aa, Artificial Sequence
  Synthetic construct
GIGYDFF

SEQ ID NO: 4311 - protein, 7 aa, Artificial Sequence
  Synthetic construct
GIGYDFY

SEQ ID NO: 4312 - protein, 7 aa, Artificial Sequence
  Synthetic construct
GIGYDRF

SEQ ID NO: 4313 - protein, 7 aa, Artificial Sequence
  Synthetic construct
GIGYDRY

SEQ ID NO: 4314 - protein, 7 aa, Artificial Sequence
  Synthetic construct
GIGYDCF

SEQ ID NO: 4315 - protein, 7 aa, Artificial Sequence
  Synthetic construct
GIGYDCY

SEQ ID NO: 4316 - protein, 7 aa, Artificial Sequence
  Synthetic construct
GIGYDLF

SEQ ID NO: 4317 - protein, 7 aa, Artificial Sequence
  Synthetic construct
GIGYDLY

SEQ ID NO: 4318 - protein, 7 aa, Artificial Sequence
  Synthetic construct
GIGYDAF

SEQ ID NO: 4319 - protein, 7 aa, Artificial Sequence
  Synthetic construct
GIGYDAY

SEQ ID NO: 4320 - protein, 7 aa, Artificial Sequence
  Synthetic construct
GIGYDQF

SEQ ID NO: 4321 - protein, 7 aa, Artificial Sequence
  Synthetic construct
GIGYDQY

SEQ ID NO: 4322 - protein, 7 aa, Artificial Sequence
  Synthetic construct
GIGYDDF

SEQ ID NO: 4323 - protein, 7 aa, Artificial Sequence
  Synthetic construct
GIGYDDY

SEQ ID NO: 4324 - protein, 7 aa, Artificial Sequence
  Synthetic construct
GIGYDVF

SEQ ID NO: 4325 - protein, 7 aa, Artificial Sequence
  Synthetic construct
GIGYDVY

SEQ ID NO: 4326 - protein, 7 aa, Artificial Sequence
  Synthetic construct
GIGYYFF

SEQ ID NO: 4327 - protein, 7 aa, Artificial Sequence
  Synthetic construct
GIGYYFY

SEQ ID NO: 4328 - protein, 7 aa, Artificial Sequence
  Synthetic construct
GIGYYRF

SEQ ID NO: 4329 - protein, 7 aa, Artificial Sequence
  Synthetic construct
GIGYYRY

SEQ ID NO: 4330 - protein, 7 aa, Artificial Sequence
  Synthetic construct
GIGYYCF

SEQ ID NO: 4331 - protein, 7 aa, Artificial Sequence
  Synthetic construct
GIGYYCY

SEQ ID NO: 4332 - protein, 7 aa, Artificial Sequence
  Synthetic construct
GIGYYLF

SEQ ID NO: 4333 - protein, 7 aa, Artificial Sequence
  Synthetic construct
GIGYYLY

SEQ ID NO: 4334 - protein, 7 aa, Artificial Sequence
  Synthetic construct
GIGYYAF

SEQ ID NO: 4335 - protein, 7 aa, Artificial Sequence
  Synthetic construct
GIGYYAY

SEQ ID NO: 4336 - protein, 7 aa, Artificial Sequence
  Synthetic construct
GIGYYQF

SEQ ID NO: 4337 - protein, 7 aa, Artificial Sequence
  Synthetic construct
GIGYYQY

SEQ ID NO: 4338 - protein, 7 aa, Artificial Sequence
  Synthetic construct
GIGYYDF

SEQ ID NO: 4339 - protein, 7 aa, Artificial Sequence
  Synthetic construct
GIGYYDY

SEQ ID NO: 4340 - protein, 7 aa, Artificial Sequence
  Synthetic construct
GIGYYVF

SEQ ID NO: 4341 - protein, 7 aa, Artificial Sequence
  Synthetic construct
GIGYYVY

SEQ ID NO: 4342 - protein, 7 aa, Artificial Sequence
  Synthetic construct
GIGYFFF

SEQ ID NO: 4343 - protein, 7 aa, Artificial Sequence
  Synthetic construct
GIGYFFY

SEQ ID NO: 4344 - protein, 7 aa, Artificial Sequence
  Synthetic construct
GIGYFRF

SEQ ID NO: 4345 - protein, 7 aa, Artificial Sequence
  Synthetic construct
GIGYFRY

SEQ ID NO: 4346 - protein, 7 aa, Artificial Sequence
  Synthetic construct
GIGYFCF

SEQ ID NO: 4347 - protein, 7 aa, Artificial Sequence
  Synthetic construct
GIGYFCY

SEQ ID NO: 4348 - protein, 7 aa, Artificial Sequence
  Synthetic construct
GIGYFLF

SEQ ID NO: 4349 - protein, 7 aa, Artificial Sequence
  Synthetic construct
GIGYFLY

SEQ ID NO: 4350 - protein, 7 aa, Artificial Sequence
  Synthetic construct
GIGYFAF

SEQ ID NO: 4351 - protein, 7 aa, Artificial Sequence
  Synthetic construct
GIGYFAY

SEQ ID NO: 4352 - protein, 7 aa, Artificial Sequence
  Synthetic construct
GIGYFQF

SEQ ID NO: 4353 - protein, 7 aa, Artificial Sequence
  Synthetic construct
GIGYFQY

SEQ ID NO: 4354 - protein, 7 aa, Artificial Sequence
  Synthetic construct
GIGYFDF

SEQ ID NO: 4355 - protein, 7 aa, Artificial Sequence
  Synthetic construct
GIGYFDY

SEQ ID NO: 4356 - protein, 7 aa, Artificial Sequence
  Synthetic construct
GIGYFVF

SEQ ID NO: 4357 - protein, 7 aa, Artificial Sequence
  Synthetic construct
GIGYFVY

SEQ ID NO: 4358 - protein, 7 aa, Artificial Sequence
  Synthetic construct
GIGYVFF

SEQ ID NO: 4359 - protein, 7 aa, Artificial Sequence
  Synthetic construct
GIGYVFY

SEQ ID NO: 4360 - protein, 7 aa, Artificial Sequence
  Synthetic construct
GIGYVRF

SEQ ID NO: 4361 - protein, 7 aa, Artificial Sequence
  Synthetic construct
GIGYVRY

SEQ ID NO: 4362 - protein, 7 aa, Artificial Sequence
  Synthetic construct
GIGYVCF

SEQ ID NO: 4363 - protein, 7 aa, Artificial Sequence
  Synthetic construct
GIGYVCY

SEQ ID NO: 4364 - protein, 7 aa, Artificial Sequence
  Synthetic construct
GIGYVLF

SEQ ID NO: 4365 - protein, 7 aa, Artificial Sequence
  Synthetic construct
GIGYVLY

SEQ ID NO: 4366 - protein, 7 aa, Artificial Sequence
  Synthetic construct
GIGYVAF

SEQ ID NO: 4367 - protein, 7 aa, Artificial Sequence
  Synthetic construct
GIGYVAY

SEQ ID NO: 4368 - protein, 7 aa, Artificial Sequence
  Synthetic construct
GIGYVQF

SEQ ID NO: 4369 - protein, 7 aa, Artificial Sequence
  Synthetic construct
GIGYVQY

SEQ ID NO: 4370 - protein, 7 aa, Artificial Sequence
  Synthetic construct
GIGYVDF

SEQ ID NO: 4371 - protein, 7 aa, Artificial Sequence
  Synthetic construct
GIGYVDY

SEQ ID NO: 4372 - protein, 7 aa, Artificial Sequence
  Synthetic construct
GIGYVVF

SEQ ID NO: 4373 - protein, 7 aa, Artificial Sequence
  Synthetic construct
GIGYVVY

SEQ ID NO: 4374 - protein, 7 aa, Artificial Sequence
  Synthetic construct
GIGYTFF

SEQ ID NO: 4375 - protein, 7 aa, Artificial Sequence
  Synthetic construct
GIGYTFY

SEQ ID NO: 4376 - protein, 7 aa, Artificial Sequence
  Synthetic construct
GIGYTRF

SEQ ID NO: 4377 - protein, 7 aa, Artificial Sequence
  Synthetic construct
GIGYTRY

SEQ ID NO: 4378 - protein, 7 aa, Artificial Sequence
  Synthetic construct
GIGYTCF

SEQ ID NO: 4379 - protein, 7 aa, Artificial Sequence
  Synthetic construct
GIGYTCY

SEQ ID NO: 4380 - protein, 7 aa, Artificial Sequence
  Synthetic construct
GIGYTLF

SEQ ID NO: 4381 - protein, 7 aa, Artificial Sequence
  Synthetic construct
GIGYTLY

SEQ ID NO: 4382 - protein, 7 aa, Artificial Sequence
  Synthetic construct
GIGYTAF

SEQ ID NO: 4383 - protein, 7 aa, Artificial Sequence
  Synthetic construct
GIGYTAY

SEQ ID NO: 4384 - protein, 7 aa, Artificial Sequence
  Synthetic construct
GIGYTQF

SEQ ID NO: 4385 - protein, 7 aa, Artificial Sequence
  Synthetic construct
GIGYTQY

SEQ ID NO: 4386 - protein, 7 aa, Artificial Sequence
  Synthetic construct
GIGYTDF

SEQ ID NO: 4387 - protein, 7 aa, Artificial Sequence
  Synthetic construct
GIGYTDY

SEQ ID NO: 4388 - protein, 7 aa, Artificial Sequence
  Synthetic construct
GIGYTVF

SEQ ID NO: 4389 - protein, 7 aa, Artificial Sequence
  Synthetic construct
GIGYTVY

SEQ ID NO: 4390 - protein, 7 aa, Artificial Sequence
  Synthetic construct
GIGYGFF

SEQ ID NO: 4391 - protein, 7 aa, Artificial Sequence
  Synthetic construct
GIGYGFY

SEQ ID NO: 4392 - protein, 7 aa, Artificial Sequence
  Synthetic construct
GIGYGRF

SEQ ID NO: 4393 - protein, 7 aa, Artificial Sequence
  Synthetic construct
GIGYGRY

SEQ ID NO: 4394 - protein, 7 aa, Artificial Sequence
  Synthetic construct
GIGYGCF

SEQ ID NO: 4395 - protein, 7 aa, Artificial Sequence
  Synthetic construct
GIGYGCY

SEQ ID NO: 4396 - protein, 7 aa, Artificial Sequence
  Synthetic construct
GIGYGLF

SEQ ID NO: 4397 - protein, 7 aa, Artificial Sequence
  Synthetic construct
GIGYGLY

SEQ ID NO: 4398 - protein, 7 aa, Artificial Sequence
  Synthetic construct
GIGYGAF

SEQ ID NO: 4399 - protein, 7 aa, Artificial Sequence
  Synthetic construct
GIGYGAY

SEQ ID NO: 4400 - protein, 7 aa, Artificial Sequence
  Synthetic construct
GIGYGQF

SEQ ID NO: 4401 - protein, 7 aa, Artificial Sequence
  Synthetic construct
GIGYGQY

SEQ ID NO: 4402 - protein, 7 aa, Artificial Sequence
  Synthetic construct
GIGYGDF

SEQ ID NO: 4403 - protein, 7 aa, Artificial Sequence
  Synthetic construct
GIGYGDY

SEQ ID NO: 4404 - protein, 7 aa, Artificial Sequence
  Synthetic construct
GIGYGVF

SEQ ID NO: 4405 - protein, 7 aa, Artificial Sequence
  Synthetic construct
GIGYGVY

SEQ ID NO: 4406 - protein, 7 aa, Artificial Sequence
  Synthetic construct
GIGYAFF

SEQ ID NO: 4407 - protein, 7 aa, Artificial Sequence
  Synthetic construct
GIGYAFY

SEQ ID NO: 4408 - protein, 7 aa, Artificial Sequence
  Synthetic construct
GIGYARF

SEQ ID NO: 4409 - protein, 7 aa, Artificial Sequence
  Synthetic construct
GIGYARY

SEQ ID NO: 4410 - protein, 7 aa, Artificial Sequence
  Synthetic construct
GIGYACF

SEQ ID NO: 4411 - protein, 7 aa, Artificial Sequence
  Synthetic construct
GIGYACY

SEQ ID NO: 4412 - protein, 7 aa, Artificial Sequence
  Synthetic construct
GIGYALF

SEQ ID NO: 4413 - protein, 7 aa, Artificial Sequence
  Synthetic construct
GIGYALY

SEQ ID NO: 4414 - protein, 7 aa, Artificial Sequence
  Synthetic construct
GIGYAAF

SEQ ID NO: 4415 - protein, 7 aa, Artificial Sequence
  Synthetic construct
GIGYAAY

SEQ ID NO: 4416 - protein, 7 aa, Artificial Sequence
  Synthetic construct
GIGYAQF

SEQ ID NO: 4417 - protein, 7 aa, Artificial Sequence
  Synthetic construct
GIGYAQY

SEQ ID NO: 4418 - protein, 7 aa, Artificial Sequence
  Synthetic construct
GIGYADF

SEQ ID NO: 4419 - protein, 7 aa, Artificial Sequence
  Synthetic construct
GIGYADY

SEQ ID NO: 4420 - protein, 7 aa, Artificial Sequence
  Synthetic construct
GIGYAVF

SEQ ID NO: 4421 - protein, 7 aa, Artificial Sequence
  Synthetic construct
GIGYAVY

SEQ ID NO: 4422 - protein, 7 aa, Artificial Sequence
  Synthetic construct
GIGYQFF

SEQ ID NO: 4423 - protein, 7 aa, Artificial Sequence
  Synthetic construct
GIGYQFY

SEQ ID NO: 4424 - protein, 7 aa, Artificial Sequence
  Synthetic construct
GIGYQRF

SEQ ID NO: 4425 - protein, 7 aa, Artificial Sequence
  Synthetic construct
GIGYQRY

SEQ ID NO: 4426 - protein, 7 aa, Artificial Sequence
  Synthetic construct
GIGYQCF

SEQ ID NO: 4427 - protein, 7 aa, Artificial Sequence
  Synthetic construct
GIGYQCY

SEQ ID NO: 4428 - protein, 7 aa, Artificial Sequence
  Synthetic construct
GIGYQLF

SEQ ID NO: 4429 - protein, 7 aa, Artificial Sequence
  Synthetic construct
GIGYQLY

SEQ ID NO: 4430 - protein, 7 aa, Artificial Sequence
  Synthetic construct
GIGYQAF

SEQ ID NO: 4431 - protein, 7 aa, Artificial Sequence
  Synthetic construct
GIGYQAY

SEQ ID NO: 4432 - protein, 7 aa, Artificial Sequence
  Synthetic construct
GIGYQQF

SEQ ID NO: 4433 - protein, 7 aa, Artificial Sequence
  Synthetic construct
GIGYQQY

SEQ ID NO: 4434 - protein, 7 aa, Artificial Sequence
  Synthetic construct
GIGYQDF

SEQ ID NO: 4435 - protein, 7 aa, Artificial Sequence
  Synthetic construct
GIGYQDY

SEQ ID NO: 4436 - protein, 7 aa, Artificial Sequence
  Synthetic construct
GIGYQVF

SEQ ID NO: 4437 - protein, 7 aa, Artificial Sequence
  Synthetic construct
GIGYQVY

SEQ ID NO: 4438 - protein, 7 aa, Artificial Sequence
  Synthetic construct
GIGPIFF

SEQ ID NO: 4439 - protein, 7 aa, Artificial Sequence
  Synthetic construct
GIGPIFY

SEQ ID NO: 4440 - protein, 7 aa, Artificial Sequence
  Synthetic construct
GIGPIRF

SEQ ID NO: 4441 - protein, 7 aa, Artificial Sequence
  Synthetic construct
GIGPIRY

SEQ ID NO: 4442 - protein, 7 aa, Artificial Sequence
  Synthetic construct
GIGPICF

SEQ ID NO: 4443 - protein, 7 aa, Artificial Sequence
  Synthetic construct
GIGPICY

SEQ ID NO: 4444 - protein, 7 aa, Artificial Sequence
  Synthetic construct
GIGPILF

SEQ ID NO: 4445 - protein, 7 aa, Artificial Sequence
  Synthetic construct
GIGPILY

SEQ ID NO: 4446 - protein, 7 aa, Artificial Sequence
  Synthetic construct
GIGPIAF

SEQ ID NO: 4447 - protein, 7 aa, Artificial Sequence
  Synthetic construct
GIGPIAY

SEQ ID NO: 4448 - protein, 7 aa, Artificial Sequence
  Synthetic construct
GIGPIQF

SEQ ID NO: 4449 - protein, 7 aa, Artificial Sequence
  Synthetic construct
GIGPIQY

SEQ ID NO: 4450 - protein, 7 aa, Artificial Sequence
  Synthetic construct
GIGPIDF

SEQ ID NO: 4451 - protein, 7 aa, Artificial Sequence
  Synthetic construct
GIGPIDY

SEQ ID NO: 4452 - protein, 7 aa, Artificial Sequence
  Synthetic construct
GIGPIVF

SEQ ID NO: 4453 - protein, 7 aa, Artificial Sequence
  Synthetic construct
GIGPIVY

SEQ ID NO: 4454 - protein, 7 aa, Artificial Sequence
  Synthetic construct
GIGPDFF

SEQ ID NO: 4455 - protein, 7 aa, Artificial Sequence
  Synthetic construct
GIGPDFY

SEQ ID NO: 4456 - protein, 7 aa, Artificial Sequence
  Synthetic construct
GIGPDRF

SEQ ID NO: 4457 - protein, 7 aa, Artificial Sequence
  Synthetic construct
GIGPDRY

SEQ ID NO: 4458 - protein, 7 aa, Artificial Sequence
  Synthetic construct
GIGPDCF

SEQ ID NO: 4459 - protein, 7 aa, Artificial Sequence
  Synthetic construct
GIGPDCY

SEQ ID NO: 4460 - protein, 7 aa, Artificial Sequence
  Synthetic construct
GIGPDLF

SEQ ID NO: 4461 - protein, 7 aa, Artificial Sequence
  Synthetic construct
GIGPDLY

SEQ ID NO: 4462 - protein, 7 aa, Artificial Sequence
  Synthetic construct
GIGPDAF

SEQ ID NO: 4463 - protein, 7 aa, Artificial Sequence
  Synthetic construct
GIGPDAY

SEQ ID NO: 4464 - protein, 7 aa, Artificial Sequence
  Synthetic construct
GIGPDQF

SEQ ID NO: 4465 - protein, 7 aa, Artificial Sequence
  Synthetic construct
GIGPDQY

SEQ ID NO: 4466 - protein, 7 aa, Artificial Sequence
  Synthetic construct
GIGPDDF

SEQ ID NO: 4467 - protein, 7 aa, Artificial Sequence
  Synthetic construct
GIGPDDY

SEQ ID NO: 4468 - protein, 7 aa, Artificial Sequence
  Synthetic construct
GIGPDVF

SEQ ID NO: 4469 - protein, 7 aa, Artificial Sequence
  Synthetic construct
GIGPDVY

SEQ ID NO: 4470 - protein, 7 aa, Artificial Sequence
  Synthetic construct
GIGPYFF

SEQ ID NO: 4471 - protein, 7 aa, Artificial Sequence
  Synthetic construct
GIGPYFY

SEQ ID NO: 4472 - protein, 7 aa, Artificial Sequence
  Synthetic construct
GIGPYRF

SEQ ID NO: 4473 - protein, 7 aa, Artificial Sequence
  Synthetic construct
GIGPYRY

SEQ ID NO: 4474 - protein, 7 aa, Artificial Sequence
  Synthetic construct
GIGPYCF

SEQ ID NO: 4475 - protein, 7 aa, Artificial Sequence
  Synthetic construct
GIGPYCY

SEQ ID NO: 4476 - protein, 7 aa, Artificial Sequence
  Synthetic construct
GIGPYLF

SEQ ID NO: 4477 - protein, 7 aa, Artificial Sequence
  Synthetic construct
GIGPYLY

SEQ ID NO: 4478 - protein, 7 aa, Artificial Sequence
  Synthetic construct
GIGPYAF

SEQ ID NO: 4479 - protein, 7 aa, Artificial Sequence
  Synthetic construct
GIGPYAY

SEQ ID NO: 4480 - protein, 7 aa, Artificial Sequence
  Synthetic construct
GIGPYQF

SEQ ID NO: 4481 - protein, 7 aa, Artificial Sequence
  Synthetic construct
GIGPYQY

SEQ ID NO: 4482 - protein, 7 aa, Artificial Sequence
  Synthetic construct
GIGPYDF

SEQ ID NO: 4483 - protein, 7 aa, Artificial Sequence
  Synthetic construct
GIGPYDY

SEQ ID NO: 4484 - protein, 7 aa, Artificial Sequence
  Synthetic construct
GIGPYVF

SEQ ID NO: 4485 - protein, 7 aa, Artificial Sequence
  Synthetic construct
GIGPYVY

SEQ ID NO: 4486 - protein, 7 aa, Artificial Sequence
  Synthetic construct
GIGPFFF

SEQ ID NO: 4487 - protein, 7 aa, Artificial Sequence
  Synthetic construct
GIGPFFY

SEQ ID NO: 4488 - protein, 7 aa, Artificial Sequence
  Synthetic construct
GIGPFRF

SEQ ID NO: 4489 - protein, 7 aa, Artificial Sequence
  Synthetic construct
GIGPFRY

SEQ ID NO: 4490 - protein, 7 aa, Artificial Sequence
  Synthetic construct
GIGPFCF

SEQ ID NO: 4491 - protein, 7 aa, Artificial Sequence
  Synthetic construct
GIGPFCY

SEQ ID NO: 4492 - protein, 7 aa, Artificial Sequence
  Synthetic construct
GIGPFLF

SEQ ID NO: 4493 - protein, 7 aa, Artificial Sequence
  Synthetic construct
GIGPFLY

SEQ ID NO: 4494 - protein, 7 aa, Artificial Sequence
  Synthetic construct
GIGPFAF

SEQ ID NO: 4495 - protein, 7 aa, Artificial Sequence
  Synthetic construct
GIGPFAY

SEQ ID NO: 4496 - protein, 7 aa, Artificial Sequence
  Synthetic construct
GIGPFQF

SEQ ID NO: 4497 - protein, 7 aa, Artificial Sequence
  Synthetic construct
GIGPFQY

SEQ ID NO: 4498 - protein, 7 aa, Artificial Sequence
  Synthetic construct
GIGPFDF

SEQ ID NO: 4499 - protein, 7 aa, Artificial Sequence
  Synthetic construct
GIGPFDY

SEQ ID NO: 4500 - protein, 7 aa, Artificial Sequence
  Synthetic construct
GIGPFVF

SEQ ID NO: 4501 - protein, 7 aa, Artificial Sequence
  Synthetic construct
GIGPFVY

SEQ ID NO: 4502 - protein, 7 aa, Artificial Sequence
  Synthetic construct
GIGPVFF

SEQ ID NO: 4503 - protein, 7 aa, Artificial Sequence
  Synthetic construct
GIGPVFY

SEQ ID NO: 4504 - protein, 7 aa, Artificial Sequence
  Synthetic construct
GIGPVRF

SEQ ID NO: 4505 - protein, 7 aa, Artificial Sequence
  Synthetic construct
GIGPVRY

SEQ ID NO: 4506 - protein, 7 aa, Artificial Sequence
  Synthetic construct
GIGPVCF

SEQ ID NO: 4507 - protein, 7 aa, Artificial Sequence
  Synthetic construct
GIGPVCY

SEQ ID NO: 4508 - protein, 7 aa, Artificial Sequence
  Synthetic construct
GIGPVLF

SEQ ID NO: 4509 - protein, 7 aa, Artificial Sequence
  Synthetic construct
GIGPVLY

SEQ ID NO: 4510 - protein, 7 aa, Artificial Sequence
  Synthetic construct
GIGPVAF

SEQ ID NO: 4511 - protein, 7 aa, Artificial Sequence
  Synthetic construct
GIGPVAY

SEQ ID NO: 4512 - protein, 7 aa, Artificial Sequence
  Synthetic construct
GIGPVQF

SEQ ID NO: 4513 - protein, 7 aa, Artificial Sequence
  Synthetic construct
GIGPVQY

SEQ ID NO: 4514 - protein, 7 aa, Artificial Sequence
  Synthetic construct
GIGPVDF

SEQ ID NO: 4515 - protein, 7 aa, Artificial Sequence
  Synthetic construct
GIGPVDY

SEQ ID NO: 4516 - protein, 7 aa, Artificial Sequence
  Synthetic construct
GIGPVVF

SEQ ID NO: 4517 - protein, 7 aa, Artificial Sequence
  Synthetic construct
GIGPVVY

SEQ ID NO: 4518 - protein, 7 aa, Artificial Sequence
  Synthetic construct
GIGPTFF

SEQ ID NO: 4519 - protein, 7 aa, Artificial Sequence
  Synthetic construct
GIGPTFY

SEQ ID NO: 4520 - protein, 7 aa, Artificial Sequence
  Synthetic construct
GIGPTRF

SEQ ID NO: 4521 - protein, 7 aa, Artificial Sequence
  Synthetic construct
GIGPTRY

SEQ ID NO: 4522 - protein, 7 aa, Artificial Sequence
  Synthetic construct
GIGPTCF

SEQ ID NO: 4523 - protein, 7 aa, Artificial Sequence
  Synthetic construct
GIGPTCY

SEQ ID NO: 4524 - protein, 7 aa, Artificial Sequence
  Synthetic construct
GIGPTLF

SEQ ID NO: 4525 - protein, 7 aa, Artificial Sequence
  Synthetic construct
GIGPTLY

SEQ ID NO: 4526 - protein, 7 aa, Artificial Sequence
  Synthetic construct
GIGPTAF

SEQ ID NO: 4527 - protein, 7 aa, Artificial Sequence
  Synthetic construct
GIGPTAY

SEQ ID NO: 4528 - protein, 7 aa, Artificial Sequence
  Synthetic construct
GIGPTQF

SEQ ID NO: 4529 - protein, 7 aa, Artificial Sequence
  Synthetic construct
GIGPTQY

SEQ ID NO: 4530 - protein, 7 aa, Artificial Sequence
  Synthetic construct
GIGPTDF

SEQ ID NO: 4531 - protein, 7 aa, Artificial Sequence
  Synthetic construct
GIGPTDY

SEQ ID NO: 4532 - protein, 7 aa, Artificial Sequence
  Synthetic construct
GIGPTVF

SEQ ID NO: 4533 - protein, 7 aa, Artificial Sequence
  Synthetic construct
GIGPTVY

SEQ ID NO: 4534 - protein, 7 aa, Artificial Sequence
  Synthetic construct
GIGPGFF

SEQ ID NO: 4535 - protein, 7 aa, Artificial Sequence
  Synthetic construct
GIGPGFY

SEQ ID NO: 4536 - protein, 7 aa, Artificial Sequence
  Synthetic construct
GIGPGRF

SEQ ID NO: 4537 - protein, 7 aa, Artificial Sequence
  Synthetic construct
GIGPGRY

SEQ ID NO: 4538 - protein, 7 aa, Artificial Sequence
  Synthetic construct
GIGPGCF

SEQ ID NO: 4539 - protein, 7 aa, Artificial Sequence
  Synthetic construct
GIGPGCY

SEQ ID NO: 4540 - protein, 7 aa, Artificial Sequence
  Synthetic construct
GIGPGLF

SEQ ID NO: 4541 - protein, 7 aa, Artificial Sequence
  Synthetic construct
GIGPGLY

SEQ ID NO: 4542 - protein, 7 aa, Artificial Sequence
  Synthetic construct
GIGPGAF

SEQ ID NO: 4543 - protein, 7 aa, Artificial Sequence
  Synthetic construct
GIGPGAY

SEQ ID NO: 4544 - protein, 7 aa, Artificial Sequence
  Synthetic construct
GIGPGQF

SEQ ID NO: 4545 - protein, 7 aa, Artificial Sequence
  Synthetic construct
GIGPGQY

SEQ ID NO: 4546 - protein, 7 aa, Artificial Sequence
  Synthetic construct
GIGPGDF

SEQ ID NO: 4547 - protein, 7 aa, Artificial Sequence
  Synthetic construct
GIGPGDY

SEQ ID NO: 4548 - protein, 7 aa, Artificial Sequence
  Synthetic construct
GIGPGVF

SEQ ID NO: 4549 - protein, 7 aa, Artificial Sequence
  Synthetic construct
GIGPGVY

SEQ ID NO: 4550 - protein, 7 aa, Artificial Sequence
  Synthetic construct
GIGPAFF

SEQ ID NO: 4551 - protein, 7 aa, Artificial Sequence
  Synthetic construct
GIGPAFY

SEQ ID NO: 4552 - protein, 7 aa, Artificial Sequence
  Synthetic construct
GIGPARF

SEQ ID NO: 4553 - protein, 7 aa, Artificial Sequence
  Synthetic construct
GIGPARY

SEQ ID NO: 4554 - protein, 7 aa, Artificial Sequence
  Synthetic construct
GIGPACF

SEQ ID NO: 4555 - protein, 7 aa, Artificial Sequence
  Synthetic construct
GIGPACY

SEQ ID NO: 4556 - protein, 7 aa, Artificial Sequence
  Synthetic construct
GIGPALF

SEQ ID NO: 4557 - protein, 7 aa, Artificial Sequence
  Synthetic construct
GIGPALY

SEQ ID NO: 4558 - protein, 7 aa, Artificial Sequence
  Synthetic construct
GIGPAAF

SEQ ID NO: 4559 - protein, 7 aa, Artificial Sequence
  Synthetic construct
GIGPAAY

SEQ ID NO: 4560 - protein, 7 aa, Artificial Sequence
  Synthetic construct
GIGPAQF

SEQ ID NO: 4561 - protein, 7 aa, Artificial Sequence
  Synthetic construct
GIGPAQY

SEQ ID NO: 4562 - protein, 7 aa, Artificial Sequence
  Synthetic construct
GIGPADF

SEQ ID NO: 4563 - protein, 7 aa, Artificial Sequence
  Synthetic construct
GIGPADY

SEQ ID NO: 4564 - protein, 7 aa, Artificial Sequence
  Synthetic construct
GIGPAVF

SEQ ID NO: 4565 - protein, 7 aa, Artificial Sequence
  Synthetic construct
GIGPAVY

SEQ ID NO: 4566 - protein, 7 aa, Artificial Sequence
  Synthetic construct
GIGPQFF

SEQ ID NO: 4567 - protein, 7 aa, Artificial Sequence
  Synthetic construct
GIGPQFY

SEQ ID NO: 4568 - protein, 7 aa, Artificial Sequence
  Synthetic construct
GIGPQRF

SEQ ID NO: 4569 - protein, 7 aa, Artificial Sequence
  Synthetic construct
GIGPQRY

SEQ ID NO: 4570 - protein, 7 aa, Artificial Sequence
  Synthetic construct
GIGPQCF

SEQ ID NO: 4571 - protein, 7 aa, Artificial Sequence
  Synthetic construct
GIGPQCY

SEQ ID NO: 4572 - protein, 7 aa, Artificial Sequence
  Synthetic construct
GIGPQLF

SEQ ID NO: 4573 - protein, 7 aa, Artificial Sequence
  Synthetic construct
GIGPQLY

SEQ ID NO: 4574 - protein, 7 aa, Artificial Sequence
  Synthetic construct
GIGPQAF

SEQ ID NO: 4575 - protein, 7 aa, Artificial Sequence
  Synthetic construct
GIGPQAY

SEQ ID NO: 4576 - protein, 7 aa, Artificial Sequence
  Synthetic construct
GIGPQQF

SEQ ID NO: 4577 - protein, 7 aa, Artificial Sequence
  Synthetic construct
GIGPQQY

SEQ ID NO: 4578 - protein, 7 aa, Artificial Sequence
  Synthetic construct
GIGPQDF

SEQ ID NO: 4579 - protein, 7 aa, Artificial Sequence
  Synthetic construct
GIGPQDY

SEQ ID NO: 4580 - protein, 7 aa, Artificial Sequence
  Synthetic construct
GIGPQVF

SEQ ID NO: 4581 - protein, 7 aa, Artificial Sequence
  Synthetic construct
GIGPQVY

SEQ ID NO: 4582 - protein, 7 aa, Artificial Sequence
  Synthetic construct
GIGHIFF

SEQ ID NO: 4583 - protein, 7 aa, Artificial Sequence
  Synthetic construct
GIGHIFY

SEQ ID NO: 4584 - protein, 7 aa, Artificial Sequence
  Synthetic construct
GIGHIRF

SEQ ID NO: 4585 - protein, 7 aa, Artificial Sequence
  Synthetic construct
GIGHIRY

SEQ ID NO: 4586 - protein, 7 aa, Artificial Sequence
  Synthetic construct
GIGHICF

SEQ ID NO: 4587 - protein, 7 aa, Artificial Sequence
  Synthetic construct
GIGHICY

SEQ ID NO: 4588 - protein, 7 aa, Artificial Sequence
  Synthetic construct
GIGHILF

SEQ ID NO: 4589 - protein, 7 aa, Artificial Sequence
  Synthetic construct
GIGHILY

SEQ ID NO: 4590 - protein, 7 aa, Artificial Sequence
  Synthetic construct
GIGHIAF

SEQ ID NO: 4591 - protein, 7 aa, Artificial Sequence
  Synthetic construct
GIGHIAY

SEQ ID NO: 4592 - protein, 7 aa, Artificial Sequence
  Synthetic construct
GIGHIQF

SEQ ID NO: 4593 - protein, 7 aa, Artificial Sequence
  Synthetic construct
GIGHIQY

SEQ ID NO: 4594 - protein, 7 aa, Artificial Sequence
  Synthetic construct
GIGHIDF

SEQ ID NO: 4595 - protein, 7 aa, Artificial Sequence
  Synthetic construct
GIGHIDY

SEQ ID NO: 4596 - protein, 7 aa, Artificial Sequence
  Synthetic construct
GIGHIVF

SEQ ID NO: 4597 - protein, 7 aa, Artificial Sequence
  Synthetic construct
GIGHIVY

SEQ ID NO: 4598 - protein, 7 aa, Artificial Sequence
  Synthetic construct
GIGHDFF

SEQ ID NO: 4599 - protein, 7 aa, Artificial Sequence
  Synthetic construct
GIGHDFY

SEQ ID NO: 4600 - protein, 7 aa, Artificial Sequence
  Synthetic construct
GIGHDRF

SEQ ID NO: 4601 - protein, 7 aa, Artificial Sequence
  Synthetic construct
GIGHDRY

SEQ ID NO: 4602 - protein, 7 aa, Artificial Sequence
  Synthetic construct
GIGHDCF

SEQ ID NO: 4603 - protein, 7 aa, Artificial Sequence
  Synthetic construct
GIGHDCY

SEQ ID NO: 4604 - protein, 7 aa, Artificial Sequence
  Synthetic construct
GIGHDLF

SEQ ID NO: 4605 - protein, 7 aa, Artificial Sequence
  Synthetic construct
GIGHDLY

SEQ ID NO: 4606 - protein, 7 aa, Artificial Sequence
  Synthetic construct
GIGHDAF

SEQ ID NO: 4607 - protein, 7 aa, Artificial Sequence
  Synthetic construct
GIGHDAY

SEQ ID NO: 4608 - protein, 7 aa, Artificial Sequence
  Synthetic construct
GIGHDQF

SEQ ID NO: 4609 - protein, 7 aa, Artificial Sequence
  Synthetic construct
GIGHDQY

SEQ ID NO: 4610 - protein, 7 aa, Artificial Sequence
  Synthetic construct
GIGHDDF

SEQ ID NO: 4611 - protein, 7 aa, Artificial Sequence
  Synthetic construct
GIGHDDY

SEQ ID NO: 4612 - protein, 7 aa, Artificial Sequence
  Synthetic construct
GIGHDVF

SEQ ID NO: 4613 - protein, 7 aa, Artificial Sequence
  Synthetic construct
GIGHDVY

SEQ ID NO: 4614 - protein, 7 aa, Artificial Sequence
  Synthetic construct
GIGHYFF

SEQ ID NO: 4615 - protein, 7 aa, Artificial Sequence
  Synthetic construct
GIGHYFY

SEQ ID NO: 4616 - protein, 7 aa, Artificial Sequence
  Synthetic construct
GIGHYRF

SEQ ID NO: 4617 - protein, 7 aa, Artificial Sequence
  Synthetic construct
GIGHYRY

SEQ ID NO: 4618 - protein, 7 aa, Artificial Sequence
  Synthetic construct
GIGHYCF

SEQ ID NO: 4619 - protein, 7 aa, Artificial Sequence
  Synthetic construct
GIGHYCY

SEQ ID NO: 4620 - protein, 7 aa, Artificial Sequence
  Synthetic construct
GIGHYLF

SEQ ID NO: 4621 - protein, 7 aa, Artificial Sequence
  Synthetic construct
GIGHYLY

SEQ ID NO: 4622 - protein, 7 aa, Artificial Sequence
  Synthetic construct
GIGHYAF

SEQ ID NO: 4623 - protein, 7 aa, Artificial Sequence
  Synthetic construct
GIGHYAY

SEQ ID NO: 4624 - protein, 7 aa, Artificial Sequence
  Synthetic construct
GIGHYQF

SEQ ID NO: 4625 - protein, 7 aa, Artificial Sequence
  Synthetic construct
GIGHYQY

SEQ ID NO: 4626 - protein, 7 aa, Artificial Sequence
  Synthetic construct
GIGHYDF

SEQ ID NO: 4627 - protein, 7 aa, Artificial Sequence
  Synthetic construct
GIGHYDY

SEQ ID NO: 4628 - protein, 7 aa, Artificial Sequence
  Synthetic construct
GIGHYVF

SEQ ID NO: 4629 - protein, 7 aa, Artificial Sequence
  Synthetic construct
GIGHYVY

SEQ ID NO: 4630 - protein, 7 aa, Artificial Sequence
  Synthetic construct
GIGHFFF

SEQ ID NO: 4631 - protein, 7 aa, Artificial Sequence
  Synthetic construct
GIGHFFY

SEQ ID NO: 4632 - protein, 7 aa, Artificial Sequence
  Synthetic construct
GIGHFRF

SEQ ID NO: 4633 - protein, 7 aa, Artificial Sequence
  Synthetic construct
GIGHFRY

SEQ ID NO: 4634 - protein, 7 aa, Artificial Sequence
  Synthetic construct
GIGHFCF

SEQ ID NO: 4635 - protein, 7 aa, Artificial Sequence
  Synthetic construct
GIGHFCY

SEQ ID NO: 4636 - protein, 7 aa, Artificial Sequence
  Synthetic construct
GIGHFLF

SEQ ID NO: 4637 - protein, 7 aa, Artificial Sequence
  Synthetic construct
GIGHFLY

SEQ ID NO: 4638 - protein, 7 aa, Artificial Sequence
  Synthetic construct
GIGHFAF

SEQ ID NO: 4639 - protein, 7 aa, Artificial Sequence
  Synthetic construct
GIGHFAY

SEQ ID NO: 4640 - protein, 7 aa, Artificial Sequence
  Synthetic construct
GIGHFQF

SEQ ID NO: 4641 - protein, 7 aa, Artificial Sequence
  Synthetic construct
GIGHFQY

SEQ ID NO: 4642 - protein, 7 aa, Artificial Sequence
  Synthetic construct
GIGHFDF

SEQ ID NO: 4643 - protein, 7 aa, Artificial Sequence
  Synthetic construct
GIGHFDY

SEQ ID NO: 4644 - protein, 7 aa, Artificial Sequence
  Synthetic construct
GIGHFVF

SEQ ID NO: 4645 - protein, 7 aa, Artificial Sequence
  Synthetic construct
GIGHFVY

SEQ ID NO: 4646 - protein, 7 aa, Artificial Sequence
  Synthetic construct
GIGHVFF

SEQ ID NO: 4647 - protein, 7 aa, Artificial Sequence
  Synthetic construct
GIGHVFY

SEQ ID NO: 4648 - protein, 7 aa, Artificial Sequence
  Synthetic construct
GIGHVRF

SEQ ID NO: 4649 - protein, 7 aa, Artificial Sequence
  Synthetic construct
GIGHVRY

SEQ ID NO: 4650 - protein, 7 aa, Artificial Sequence
  Synthetic construct
GIGHVCF

SEQ ID NO: 4651 - protein, 7 aa, Artificial Sequence
  Synthetic construct
GIGHVCY

SEQ ID NO: 4652 - protein, 7 aa, Artificial Sequence
  Synthetic construct
GIGHVLF

SEQ ID NO: 4653 - protein, 7 aa, Artificial Sequence
  Synthetic construct
GIGHVLY

SEQ ID NO: 4654 - protein, 7 aa, Artificial Sequence
  Synthetic construct
GIGHVAF

SEQ ID NO: 4655 - protein, 7 aa, Artificial Sequence
  Synthetic construct
GIGHVAY

SEQ ID NO: 4656 - protein, 7 aa, Artificial Sequence
  Synthetic construct
GIGHVQF

SEQ ID NO: 4657 - protein, 7 aa, Artificial Sequence
  Synthetic construct
GIGHVQY

SEQ ID NO: 4658 - protein, 7 aa, Artificial Sequence
  Synthetic construct
GIGHVDF

SEQ ID NO: 4659 - protein, 7 aa, Artificial Sequence
  Synthetic construct
GIGHVDY

SEQ ID NO: 4660 - protein, 7 aa, Artificial Sequence
  Synthetic construct
GIGHVVF

SEQ ID NO: 4661 - protein, 7 aa, Artificial Sequence
  Synthetic construct
GIGHVVY

SEQ ID NO: 4662 - protein, 7 aa, Artificial Sequence
  Synthetic construct
GIGHTFF

SEQ ID NO: 4663 - protein, 7 aa, Artificial Sequence
  Synthetic construct
GIGHTFY

SEQ ID NO: 4664 - protein, 7 aa, Artificial Sequence
  Synthetic construct
GIGHTRF

SEQ ID NO: 4665 - protein, 7 aa, Artificial Sequence
  Synthetic construct
GIGHTRY

SEQ ID NO: 4666 - protein, 7 aa, Artificial Sequence
  Synthetic construct
GIGHTCF

SEQ ID NO: 4667 - protein, 7 aa, Artificial Sequence
  Synthetic construct
GIGHTCY

SEQ ID NO: 4668 - protein, 7 aa, Artificial Sequence
  Synthetic construct
GIGHTLF

SEQ ID NO: 4669 - protein, 7 aa, Artificial Sequence
  Synthetic construct
GIGHTLY

SEQ ID NO: 4670 - protein, 7 aa, Artificial Sequence
  Synthetic construct
GIGHTAF

SEQ ID NO: 4671 - protein, 7 aa, Artificial Sequence
  Synthetic construct
GIGHTAY

SEQ ID NO: 4672 - protein, 7 aa, Artificial Sequence
  Synthetic construct
GIGHTQF

SEQ ID NO: 4673 - protein, 7 aa, Artificial Sequence
  Synthetic construct
GIGHTQY

SEQ ID NO: 4674 - protein, 7 aa, Artificial Sequence
  Synthetic construct
GIGHTDF

SEQ ID NO: 4675 - protein, 7 aa, Artificial Sequence
  Synthetic construct
GIGHTDY

SEQ ID NO: 4676 - protein, 7 aa, Artificial Sequence
  Synthetic construct
GIGHTVF

SEQ ID NO: 4677 - protein, 7 aa, Artificial Sequence
  Synthetic construct
GIGHTVY

SEQ ID NO: 4678 - protein, 7 aa, Artificial Sequence
  Synthetic construct
GIGHGFF

SEQ ID NO: 4679 - protein, 7 aa, Artificial Sequence
  Synthetic construct
GIGHGFY

SEQ ID NO: 4680 - protein, 7 aa, Artificial Sequence
  Synthetic construct
GIGHGRF

SEQ ID NO: 4681 - protein, 7 aa, Artificial Sequence
  Synthetic construct
GIGHGRY

SEQ ID NO: 4682 - protein, 7 aa, Artificial Sequence
  Synthetic construct
GIGHGCF

SEQ ID NO: 4683 - protein, 7 aa, Artificial Sequence
  Synthetic construct
GIGHGCY

SEQ ID NO: 4684 - protein, 7 aa, Artificial Sequence
  Synthetic construct
GIGHGLF

SEQ ID NO: 4685 - protein, 7 aa, Artificial Sequence
  Synthetic construct
GIGHGLY

SEQ ID NO: 4686 - protein, 7 aa, Artificial Sequence
  Synthetic construct
GIGHGAF

SEQ ID NO: 4687 - protein, 7 aa, Artificial Sequence
  Synthetic construct
GIGHGAY

SEQ ID NO: 4688 - protein, 7 aa, Artificial Sequence
  Synthetic construct
GIGHGQF

SEQ ID NO: 4689 - protein, 7 aa, Artificial Sequence
  Synthetic construct
GIGHGQY

SEQ ID NO: 4690 - protein, 7 aa, Artificial Sequence
  Synthetic construct
GIGHGDF

SEQ ID NO: 4691 - protein, 7 aa, Artificial Sequence
  Synthetic construct
GIGHGDY

SEQ ID NO: 4692 - protein, 7 aa, Artificial Sequence
  Synthetic construct
GIGHGVF

SEQ ID NO: 4693 - protein, 7 aa, Artificial Sequence
  Synthetic construct
GIGHGVY

SEQ ID NO: 4694 - protein, 7 aa, Artificial Sequence
  Synthetic construct
GIGHAFF

SEQ ID NO: 4695 - protein, 7 aa, Artificial Sequence
  Synthetic construct
GIGHAFY

SEQ ID NO: 4696 - protein, 7 aa, Artificial Sequence
  Synthetic construct
GIGHARF

SEQ ID NO: 4697 - protein, 7 aa, Artificial Sequence
  Synthetic construct
GIGHARY

SEQ ID NO: 4698 - protein, 7 aa, Artificial Sequence
  Synthetic construct
GIGHACF

SEQ ID NO: 4699 - protein, 7 aa, Artificial Sequence
  Synthetic construct
GIGHACY

SEQ ID NO: 4700 - protein, 7 aa, Artificial Sequence
  Synthetic construct
GIGHALF

SEQ ID NO: 4701 - protein, 7 aa, Artificial Sequence
  Synthetic construct
GIGHALY

SEQ ID NO: 4702 - protein, 7 aa, Artificial Sequence
  Synthetic construct
GIGHAAF

SEQ ID NO: 4703 - protein, 7 aa, Artificial Sequence
  Synthetic construct
GIGHAAY

SEQ ID NO: 4704 - protein, 7 aa, Artificial Sequence
  Synthetic construct
GIGHAQF

SEQ ID NO: 4705 - protein, 7 aa, Artificial Sequence
  Synthetic construct
GIGHAQY

SEQ ID NO: 4706 - protein, 7 aa, Artificial Sequence
  Synthetic construct
GIGHADF

SEQ ID NO: 4707 - protein, 7 aa, Artificial Sequence
  Synthetic construct
GIGHADY

SEQ ID NO: 4708 - protein, 7 aa, Artificial Sequence
  Synthetic construct
GIGHAVF

SEQ ID NO: 4709 - protein, 7 aa, Artificial Sequence
  Synthetic construct
GIGHAVY

SEQ ID NO: 4710 - protein, 7 aa, Artificial Sequence
  Synthetic construct
GIGHQFF

SEQ ID NO: 4711 - protein, 7 aa, Artificial Sequence
  Synthetic construct
GIGHQFY

SEQ ID NO: 4712 - protein, 7 aa, Artificial Sequence
  Synthetic construct
GIGHQRF

SEQ ID NO: 4713 - protein, 7 aa, Artificial Sequence
  Synthetic construct
GIGHQRY

SEQ ID NO: 4714 - protein, 7 aa, Artificial Sequence
  Synthetic construct
GIGHQCF

SEQ ID NO: 4715 - protein, 7 aa, Artificial Sequence
  Synthetic construct
GIGHQCY

SEQ ID NO: 4716 - protein, 7 aa, Artificial Sequence
  Synthetic construct
GIGHQLF

SEQ ID NO: 4717 - protein, 7 aa, Artificial Sequence
  Synthetic construct
GIGHQLY

SEQ ID NO: 4718 - protein, 7 aa, Artificial Sequence
  Synthetic construct
GIGHQAF

SEQ ID NO: 4719 - protein, 7 aa, Artificial Sequence
  Synthetic construct
GIGHQAY

SEQ ID NO: 4720 - protein, 7 aa, Artificial Sequence
  Synthetic construct
GIGHQQF

SEQ ID NO: 4721 - protein, 7 aa, Artificial Sequence
  Synthetic construct
GIGHQQY

SEQ ID NO: 4722 - protein, 7 aa, Artificial Sequence
  Synthetic construct
GIGHQDF

SEQ ID NO: 4723 - protein, 7 aa, Artificial Sequence
  Synthetic construct
GIGHQDY

SEQ ID NO: 4724 - protein, 7 aa, Artificial Sequence
  Synthetic construct
GIGHQVF

SEQ ID NO: 4725 - protein, 7 aa, Artificial Sequence
  Synthetic construct
GIGHQVY

SEQ ID NO: 4726 - protein, 7 aa, Artificial Sequence
  Synthetic construct
GIGLIFF

SEQ ID NO: 4727 - protein, 7 aa, Artificial Sequence
  Synthetic construct
GIGLIFY

SEQ ID NO: 4728 - protein, 7 aa, Artificial Sequence
  Synthetic construct
GIGLIRF

SEQ ID NO: 4729 - protein, 7 aa, Artificial Sequence
  Synthetic construct
GIGLIRY

SEQ ID NO: 4730 - protein, 7 aa, Artificial Sequence
  Synthetic construct
GIGLICF

SEQ ID NO: 4731 - protein, 7 aa, Artificial Sequence
  Synthetic construct
GIGLICY

SEQ ID NO: 4732 - protein, 7 aa, Artificial Sequence
  Synthetic construct
GIGLILF

SEQ ID NO: 4733 - protein, 7 aa, Artificial Sequence
  Synthetic construct
GIGLILY

SEQ ID NO: 4734 - protein, 7 aa, Artificial Sequence
  Synthetic construct
GIGLIAF

SEQ ID NO: 4735 - protein, 7 aa, Artificial Sequence
  Synthetic construct
GIGLIAY

SEQ ID NO: 4736 - protein, 7 aa, Artificial Sequence
  Synthetic construct
GIGLIQF

SEQ ID NO: 4737 - protein, 7 aa, Artificial Sequence
  Synthetic construct
GIGLIQY

SEQ ID NO: 4738 - protein, 7 aa, Artificial Sequence
  Synthetic construct
GIGLIDF

SEQ ID NO: 4739 - protein, 7 aa, Artificial Sequence
  Synthetic construct
GIGLIDY

SEQ ID NO: 4740 - protein, 7 aa, Artificial Sequence
  Synthetic construct
GIGLIVF

SEQ ID NO: 4741 - protein, 7 aa, Artificial Sequence
  Synthetic construct
GIGLIVY

SEQ ID NO: 4742 - protein, 7 aa, Artificial Sequence
  Synthetic construct
GIGLDFF

SEQ ID NO: 4743 - protein, 7 aa, Artificial Sequence
  Synthetic construct
GIGLDFY

SEQ ID NO: 4744 - protein, 7 aa, Artificial Sequence
  Synthetic construct
GIGLDRF

SEQ ID NO: 4745 - protein, 7 aa, Artificial Sequence
  Synthetic construct
GIGLDRY

SEQ ID NO: 4746 - protein, 7 aa, Artificial Sequence
  Synthetic construct
GIGLDCF

SEQ ID NO: 4747 - protein, 7 aa, Artificial Sequence
  Synthetic construct
GIGLDCY

SEQ ID NO: 4748 - protein, 7 aa, Artificial Sequence
  Synthetic construct
GIGLDLF

SEQ ID NO: 4749 - protein, 7 aa, Artificial Sequence
  Synthetic construct
GIGLDLY

SEQ ID NO: 4750 - protein, 7 aa, Artificial Sequence
  Synthetic construct
GIGLDAF

SEQ ID NO: 4751 - protein, 7 aa, Artificial Sequence
  Synthetic construct
GIGLDAY

SEQ ID NO: 4752 - protein, 7 aa, Artificial Sequence
  Synthetic construct
GIGLDQF

SEQ ID NO: 4753 - protein, 7 aa, Artificial Sequence
  Synthetic construct
GIGLDQY

SEQ ID NO: 4754 - protein, 7 aa, Artificial Sequence
  Synthetic construct
GIGLDDF

SEQ ID NO: 4755 - protein, 7 aa, Artificial Sequence
  Synthetic construct
GIGLDDY

SEQ ID NO: 4756 - protein, 7 aa, Artificial Sequence
  Synthetic construct
GIGLDVF

SEQ ID NO: 4757 - protein, 7 aa, Artificial Sequence
  Synthetic construct
GIGLDVY

SEQ ID NO: 4758 - protein, 7 aa, Artificial Sequence
  Synthetic construct
GIGLYFF

SEQ ID NO: 4759 - protein, 7 aa, Artificial Sequence
  Synthetic construct
GIGLYFY

SEQ ID NO: 4760 - protein, 7 aa, Artificial Sequence
  Synthetic construct
GIGLYRF

SEQ ID NO: 4761 - protein, 7 aa, Artificial Sequence
  Synthetic construct
GIGLYRY

SEQ ID NO: 4762 - protein, 7 aa, Artificial Sequence
  Synthetic construct
GIGLYCF

SEQ ID NO: 4763 - protein, 7 aa, Artificial Sequence
  Synthetic construct
GIGLYCY

SEQ ID NO: 4764 - protein, 7 aa, Artificial Sequence
  Synthetic construct
GIGLYLF

SEQ ID NO: 4765 - protein, 7 aa, Artificial Sequence
  Synthetic construct
GIGLYLY

SEQ ID NO: 4766 - protein, 7 aa, Artificial Sequence
  Synthetic construct
GIGLYAF

SEQ ID NO: 4767 - protein, 7 aa, Artificial Sequence
  Synthetic construct
GIGLYAY

SEQ ID NO: 4768 - protein, 7 aa, Artificial Sequence
  Synthetic construct
GIGLYQF

SEQ ID NO: 4769 - protein, 7 aa, Artificial Sequence
  Synthetic construct
GIGLYQY

SEQ ID NO: 4770 - protein, 7 aa, Artificial Sequence
  Synthetic construct
GIGLYDF

SEQ ID NO: 4771 - protein, 7 aa, Artificial Sequence
  Synthetic construct
GIGLYDY

SEQ ID NO: 4772 - protein, 7 aa, Artificial Sequence
  Synthetic construct
GIGLYVF

SEQ ID NO: 4773 - protein, 7 aa, Artificial Sequence
  Synthetic construct
GIGLYVY

SEQ ID NO: 4774 - protein, 7 aa, Artificial Sequence
  Synthetic construct
GIGLFFF

SEQ ID NO: 4775 - protein, 7 aa, Artificial Sequence
  Synthetic construct
GIGLFFY

SEQ ID NO: 4776 - protein, 7 aa, Artificial Sequence
  Synthetic construct
GIGLFRF

SEQ ID NO: 4777 - protein, 7 aa, Artificial Sequence
  Synthetic construct
GIGLFRY

SEQ ID NO: 4778 - protein, 7 aa, Artificial Sequence
  Synthetic construct
GIGLFCF

SEQ ID NO: 4779 - protein, 7 aa, Artificial Sequence
  Synthetic construct
GIGLFCY

SEQ ID NO: 4780 - protein, 7 aa, Artificial Sequence
  Synthetic construct
GIGLFLF

SEQ ID NO: 4781 - protein, 7 aa, Artificial Sequence
  Synthetic construct
GIGLFLY

SEQ ID NO: 4782 - protein, 7 aa, Artificial Sequence
  Synthetic construct
GIGLFAF

SEQ ID NO: 4783 - protein, 7 aa, Artificial Sequence
  Synthetic construct
GIGLFAY

SEQ ID NO: 4784 - protein, 7 aa, Artificial Sequence
  Synthetic construct
GIGLFQF

SEQ ID NO: 4785 - protein, 7 aa, Artificial Sequence
  Synthetic construct
GIGLFQY

SEQ ID NO: 4786 - protein, 7 aa, Artificial Sequence
  Synthetic construct
GIGLFDF

SEQ ID NO: 4787 - protein, 7 aa, Artificial Sequence
  Synthetic construct
GIGLFDY

SEQ ID NO: 4788 - protein, 7 aa, Artificial Sequence
  Synthetic construct
GIGLFVF

SEQ ID NO: 4789 - protein, 7 aa, Artificial Sequence
  Synthetic construct
GIGLFVY

SEQ ID NO: 4790 - protein, 7 aa, Artificial Sequence
  Synthetic construct
GIGLVFF

SEQ ID NO: 4791 - protein, 7 aa, Artificial Sequence
  Synthetic construct
GIGLVFY

SEQ ID NO: 4792 - protein, 7 aa, Artificial Sequence
  Synthetic construct
GIGLVRF

SEQ ID NO: 4793 - protein, 7 aa, Artificial Sequence
  Synthetic construct
GIGLVRY

SEQ ID NO: 4794 - protein, 7 aa, Artificial Sequence
  Synthetic construct
GIGLVCF

SEQ ID NO: 4795 - protein, 7 aa, Artificial Sequence
  Synthetic construct
GIGLVCY

SEQ ID NO: 4796 - protein, 7 aa, Artificial Sequence
  Synthetic construct
GIGLVLF

SEQ ID NO: 4797 - protein, 7 aa, Artificial Sequence
  Synthetic construct
GIGLVLY

SEQ ID NO: 4798 - protein, 7 aa, Artificial Sequence
  Synthetic construct
GIGLVAF

SEQ ID NO: 4799 - protein, 7 aa, Artificial Sequence
  Synthetic construct
GIGLVAY

SEQ ID NO: 4800 - protein, 7 aa, Artificial Sequence
  Synthetic construct
GIGLVQF

SEQ ID NO: 4801 - protein, 7 aa, Artificial Sequence
  Synthetic construct
GIGLVQY

SEQ ID NO: 4802 - protein, 7 aa, Artificial Sequence
  Synthetic construct
GIGLVDF

SEQ ID NO: 4803 - protein, 7 aa, Artificial Sequence
  Synthetic construct
GIGLVDY

SEQ ID NO: 4804 - protein, 7 aa, Artificial Sequence
  Synthetic construct
GIGLVVF

SEQ ID NO: 4805 - protein, 7 aa, Artificial Sequence
  Synthetic construct
GIGLVVY

SEQ ID NO: 4806 - protein, 7 aa, Artificial Sequence
  Synthetic construct
GIGLTFF

SEQ ID NO: 4807 - protein, 7 aa, Artificial Sequence
  Synthetic construct
GIGLTFY

SEQ ID NO: 4808 - protein, 7 aa, Artificial Sequence
  Synthetic construct
GIGLTRF

SEQ ID NO: 4809 - protein, 7 aa, Artificial Sequence
  Synthetic construct
GIGLTRY

SEQ ID NO: 4810 - protein, 7 aa, Artificial Sequence
  Synthetic construct
GIGLTCF

SEQ ID NO: 4811 - protein, 7 aa, Artificial Sequence
  Synthetic construct
GIGLTCY

SEQ ID NO: 4812 - protein, 7 aa, Artificial Sequence
  Synthetic construct
GIGLTLF

SEQ ID NO: 4813 - protein, 7 aa, Artificial Sequence
  Synthetic construct
GIGLTLY

SEQ ID NO: 4814 - protein, 7 aa, Artificial Sequence
  Synthetic construct
GIGLTAF

SEQ ID NO: 4815 - protein, 7 aa, Artificial Sequence
  Synthetic construct
GIGLTAY

SEQ ID NO: 4816 - protein, 7 aa, Artificial Sequence
  Synthetic construct
GIGLTQF

SEQ ID NO: 4817 - protein, 7 aa, Artificial Sequence
  Synthetic construct
GIGLTQY

SEQ ID NO: 4818 - protein, 7 aa, Artificial Sequence
  Synthetic construct
GIGLTDF

SEQ ID NO: 4819 - protein, 7 aa, Artificial Sequence
  Synthetic construct
GIGLTDY

SEQ ID NO: 4820 - protein, 7 aa, Artificial Sequence
  Synthetic construct
GIGLTVF

SEQ ID NO: 4821 - protein, 7 aa, Artificial Sequence
  Synthetic construct
GIGLTVY

SEQ ID NO: 4822 - protein, 7 aa, Artificial Sequence
  Synthetic construct
GIGLGFF

SEQ ID NO: 4823 - protein, 7 aa, Artificial Sequence
  Synthetic construct
GIGLGFY

SEQ ID NO: 4824 - protein, 7 aa, Artificial Sequence
  Synthetic construct
GIGLGRF

SEQ ID NO: 4825 - protein, 7 aa, Artificial Sequence
  Synthetic construct
GIGLGRY

SEQ ID NO: 4826 - protein, 7 aa, Artificial Sequence
  Synthetic construct
GIGLGCF

SEQ ID NO: 4827 - protein, 7 aa, Artificial Sequence
  Synthetic construct
GIGLGCY

SEQ ID NO: 4828 - protein, 7 aa, Artificial Sequence
  Synthetic construct
GIGLGLF

SEQ ID NO: 4829 - protein, 7 aa, Artificial Sequence
  Synthetic construct
GIGLGLY

SEQ ID NO: 4830 - protein, 7 aa, Artificial Sequence
  Synthetic construct
GIGLGAF

SEQ ID NO: 4831 - protein, 7 aa, Artificial Sequence
  Synthetic construct
GIGLGAY

SEQ ID NO: 4832 - protein, 7 aa, Artificial Sequence
  Synthetic construct
GIGLGQF

SEQ ID NO: 4833 - protein, 7 aa, Artificial Sequence
  Synthetic construct
GIGLGQY

SEQ ID NO: 4834 - protein, 7 aa, Artificial Sequence
  Synthetic construct
GIGLGDF

SEQ ID NO: 4835 - protein, 7 aa, Artificial Sequence
  Synthetic construct
GIGLGDY

SEQ ID NO: 4836 - protein, 7 aa, Artificial Sequence
  Synthetic construct
GIGLGVF

SEQ ID NO: 4837 - protein, 7 aa, Artificial Sequence
  Synthetic construct
GIGLGVY

SEQ ID NO: 4838 - protein, 7 aa, Artificial Sequence
  Synthetic construct
GIGLAFF

SEQ ID NO: 4839 - protein, 7 aa, Artificial Sequence
  Synthetic construct
GIGLAFY

SEQ ID NO: 4840 - protein, 7 aa, Artificial Sequence
  Synthetic construct
GIGLARF

SEQ ID NO: 4841 - protein, 7 aa, Artificial Sequence
  Synthetic construct
GIGLARY

SEQ ID NO: 4842 - protein, 7 aa, Artificial Sequence
  Synthetic construct
GIGLACF

SEQ ID NO: 4843 - protein, 7 aa, Artificial Sequence
  Synthetic construct
GIGLACY

SEQ ID NO: 4844 - protein, 7 aa, Artificial Sequence
  Synthetic construct
GIGLALF

SEQ ID NO: 4845 - protein, 7 aa, Artificial Sequence
  Synthetic construct
GIGLALY

SEQ ID NO: 4846 - protein, 7 aa, Artificial Sequence
  Synthetic construct
GIGLAAF

SEQ ID NO: 4847 - protein, 7 aa, Artificial Sequence
  Synthetic construct
GIGLAAY

SEQ ID NO: 4848 - protein, 7 aa, Artificial Sequence
  Synthetic construct
GIGLAQF

SEQ ID NO: 4849 - protein, 7 aa, Artificial Sequence
  Synthetic construct
GIGLAQY

SEQ ID NO: 4850 - protein, 7 aa, Artificial Sequence
  Synthetic construct
GIGLADF

SEQ ID NO: 4851 - protein, 7 aa, Artificial Sequence
  Synthetic construct
GIGLADY

SEQ ID NO: 4852 - protein, 7 aa, Artificial Sequence
  Synthetic construct
GIGLAVF

SEQ ID NO: 4853 - protein, 7 aa, Artificial Sequence
  Synthetic construct
GIGLAVY

SEQ ID NO: 4854 - protein, 7 aa, Artificial Sequence
  Synthetic construct
GIGLQFF

SEQ ID NO: 4855 - protein, 7 aa, Artificial Sequence
  Synthetic construct
GIGLQFY

SEQ ID NO: 4856 - protein, 7 aa, Artificial Sequence
  Synthetic construct
GIGLQRF

SEQ ID NO: 4857 - protein, 7 aa, Artificial Sequence
  Synthetic construct
GIGLQRY

SEQ ID NO: 4858 - protein, 7 aa, Artificial Sequence
  Synthetic construct
GIGLQCF

SEQ ID NO: 4859 - protein, 7 aa, Artificial Sequence
  Synthetic construct
GIGLQCY

SEQ ID NO: 4860 - protein, 7 aa, Artificial Sequence
  Synthetic construct
GIGLQLF

SEQ ID NO: 4861 - protein, 7 aa, Artificial Sequence
  Synthetic construct
GIGLQLY

SEQ ID NO: 4862 - protein, 7 aa, Artificial Sequence
  Synthetic construct
GIGLQAF

SEQ ID NO: 4863 - protein, 7 aa, Artificial Sequence
  Synthetic construct
GIGLQAY

SEQ ID NO: 4864 - protein, 7 aa, Artificial Sequence
  Synthetic construct
GIGLQQF

SEQ ID NO: 4865 - protein, 7 aa, Artificial Sequence
  Synthetic construct
GIGLQQY

SEQ ID NO: 4866 - protein, 7 aa, Artificial Sequence
  Synthetic construct
GIGLQDF

SEQ ID NO: 4867 - protein, 7 aa, Artificial Sequence
  Synthetic construct
GIGLQDY

SEQ ID NO: 4868 - protein, 7 aa, Artificial Sequence
  Synthetic construct
GIGLQVF

SEQ ID NO: 4869 - protein, 7 aa, Artificial Sequence
  Synthetic construct
GIGLQVY

SEQ ID NO: 4870 - protein, 7 aa, Artificial Sequence
  Synthetic construct
GIGFIFF

SEQ ID NO: 4871 - protein, 7 aa, Artificial Sequence
  Synthetic construct
GIGFIFY

SEQ ID NO: 4872 - protein, 7 aa, Artificial Sequence
  Synthetic construct
GIGFIRF

SEQ ID NO: 4873 - protein, 7 aa, Artificial Sequence
  Synthetic construct
GIGFIRY

SEQ ID NO: 4874 - protein, 7 aa, Artificial Sequence
  Synthetic construct
GIGFICF

SEQ ID NO: 4875 - protein, 7 aa, Artificial Sequence
  Synthetic construct
GIGFICY

SEQ ID NO: 4876 - protein, 7 aa, Artificial Sequence
  Synthetic construct
GIGFILF

SEQ ID NO: 4877 - protein, 7 aa, Artificial Sequence
  Synthetic construct
GIGFILY

SEQ ID NO: 4878 - protein, 7 aa, Artificial Sequence
  Synthetic construct
GIGFIAF

SEQ ID NO: 4879 - protein, 7 aa, Artificial Sequence
  Synthetic construct
GIGFIAY

SEQ ID NO: 4880 - protein, 7 aa, Artificial Sequence
  Synthetic construct
GIGFIQF

SEQ ID NO: 4881 - protein, 7 aa, Artificial Sequence
  Synthetic construct
GIGFIQY

SEQ ID NO: 4882 - protein, 7 aa, Artificial Sequence
  Synthetic construct
GIGFIDF

SEQ ID NO: 4883 - protein, 7 aa, Artificial Sequence
  Synthetic construct
GIGFIDY

SEQ ID NO: 4884 - protein, 7 aa, Artificial Sequence
  Synthetic construct
GIGFIVF

SEQ ID NO: 4885 - protein, 7 aa, Artificial Sequence
  Synthetic construct
GIGFIVY

SEQ ID NO: 4886 - protein, 7 aa, Artificial Sequence
  Synthetic construct
GIGFDFF

SEQ ID NO: 4887 - protein, 7 aa, Artificial Sequence
  Synthetic construct
GIGFDFY

SEQ ID NO: 4888 - protein, 7 aa, Artificial Sequence
  Synthetic construct
GIGFDRF

SEQ ID NO: 4889 - protein, 7 aa, Artificial Sequence
  Synthetic construct
GIGFDRY

SEQ ID NO: 4890 - protein, 7 aa, Artificial Sequence
  Synthetic construct
GIGFDCF

SEQ ID NO: 4891 - protein, 7 aa, Artificial Sequence
  Synthetic construct
GIGFDCY

SEQ ID NO: 4892 - protein, 7 aa, Artificial Sequence
  Synthetic construct
GIGFDLF

SEQ ID NO: 4893 - protein, 7 aa, Artificial Sequence
  Synthetic construct
GIGFDLY

SEQ ID NO: 4894 - protein, 7 aa, Artificial Sequence
  Synthetic construct
GIGFDAF

SEQ ID NO: 4895 - protein, 7 aa, Artificial Sequence
  Synthetic construct
GIGFDAY

SEQ ID NO: 4896 - protein, 7 aa, Artificial Sequence
  Synthetic construct
GIGFDQF

SEQ ID NO: 4897 - protein, 7 aa, Artificial Sequence
  Synthetic construct
GIGFDQY

SEQ ID NO: 4898 - protein, 7 aa, Artificial Sequence
  Synthetic construct
GIGFDDF

SEQ ID NO: 4899 - protein, 7 aa, Artificial Sequence
  Synthetic construct
GIGFDDY

SEQ ID NO: 4900 - protein, 7 aa, Artificial Sequence
  Synthetic construct
GIGFDVF

SEQ ID NO: 4901 - protein, 7 aa, Artificial Sequence
  Synthetic construct
GIGFDVY

SEQ ID NO: 4902 - protein, 7 aa, Artificial Sequence
  Synthetic construct
GIGFYFF

SEQ ID NO: 4903 - protein, 7 aa, Artificial Sequence
  Synthetic construct
GIGFYFY

SEQ ID NO: 4904 - protein, 7 aa, Artificial Sequence
  Synthetic construct
GIGFYRF

SEQ ID NO: 4905 - protein, 7 aa, Artificial Sequence
  Synthetic construct
GIGFYRY

SEQ ID NO: 4906 - protein, 7 aa, Artificial Sequence
  Synthetic construct
GIGFYCF

SEQ ID NO: 4907 - protein, 7 aa, Artificial Sequence
  Synthetic construct
GIGFYCY

SEQ ID NO: 4908 - protein, 7 aa, Artificial Sequence
  Synthetic construct
GIGFYLF

SEQ ID NO: 4909 - protein, 7 aa, Artificial Sequence
  Synthetic construct
GIGFYLY

SEQ ID NO: 4910 - protein, 7 aa, Artificial Sequence
  Synthetic construct
GIGFYAF

SEQ ID NO: 4911 - protein, 7 aa, Artificial Sequence
  Synthetic construct
GIGFYAY

SEQ ID NO: 4912 - protein, 7 aa, Artificial Sequence
  Synthetic construct
GIGFYQF

SEQ ID NO: 4913 - protein, 7 aa, Artificial Sequence
  Synthetic construct
GIGFYQY

SEQ ID NO: 4914 - protein, 7 aa, Artificial Sequence
  Synthetic construct
GIGFYDF

SEQ ID NO: 4915 - protein, 7 aa, Artificial Sequence
  Synthetic construct
GIGFYDY

SEQ ID NO: 4916 - protein, 7 aa, Artificial Sequence
  Synthetic construct
GIGFYVF

SEQ ID NO: 4917 - protein, 7 aa, Artificial Sequence
  Synthetic construct
GIGFYVY

SEQ ID NO: 4918 - protein, 7 aa, Artificial Sequence
  Synthetic construct
GIGFFFF

SEQ ID NO: 4919 - protein, 7 aa, Artificial Sequence
  Synthetic construct
GIGFFFY

SEQ ID NO: 4920 - protein, 7 aa, Artificial Sequence
  Synthetic construct
GIGFFRF

SEQ ID NO: 4921 - protein, 7 aa, Artificial Sequence
  Synthetic construct
GIGFFRY

SEQ ID NO: 4922 - protein, 7 aa, Artificial Sequence
  Synthetic construct
GIGFFCF

SEQ ID NO: 4923 - protein, 7 aa, Artificial Sequence
  Synthetic construct
GIGFFCY

SEQ ID NO: 4924 - protein, 7 aa, Artificial Sequence
  Synthetic construct
GIGFFLF

SEQ ID NO: 4925 - protein, 7 aa, Artificial Sequence
  Synthetic construct
GIGFFLY

SEQ ID NO: 4926 - protein, 7 aa, Artificial Sequence
  Synthetic construct
GIGFFAF

SEQ ID NO: 4927 - protein, 7 aa, Artificial Sequence
  Synthetic construct
GIGFFAY

SEQ ID NO: 4928 - protein, 7 aa, Artificial Sequence
  Synthetic construct
GIGFFQF

SEQ ID NO: 4929 - protein, 7 aa, Artificial Sequence
  Synthetic construct
GIGFFQY

SEQ ID NO: 4930 - protein, 7 aa, Artificial Sequence
  Synthetic construct
GIGFFDF

SEQ ID NO: 4931 - protein, 7 aa, Artificial Sequence
  Synthetic construct
GIGFFDY

SEQ ID NO: 4932 - protein, 7 aa, Artificial Sequence
  Synthetic construct
GIGFFVF

SEQ ID NO: 4933 - protein, 7 aa, Artificial Sequence
  Synthetic construct
GIGFFVY

SEQ ID NO: 4934 - protein, 7 aa, Artificial Sequence
  Synthetic construct
GIGFVFF

SEQ ID NO: 4935 - protein, 7 aa, Artificial Sequence
  Synthetic construct
GIGFVFY

SEQ ID NO: 4936 - protein, 7 aa, Artificial Sequence
  Synthetic construct
GIGFVRF

SEQ ID NO: 4937 - protein, 7 aa, Artificial Sequence
  Synthetic construct
GIGFVRY

SEQ ID NO: 4938 - protein, 7 aa, Artificial Sequence
  Synthetic construct
GIGFVCF

SEQ ID NO: 4939 - protein, 7 aa, Artificial Sequence
  Synthetic construct
GIGFVCY

SEQ ID NO: 4940 - protein, 7 aa, Artificial Sequence
  Synthetic construct
GIGFVLF

SEQ ID NO: 4941 - protein, 7 aa, Artificial Sequence
  Synthetic construct
GIGFVLY

SEQ ID NO: 4942 - protein, 7 aa, Artificial Sequence
  Synthetic construct
GIGFVAF

SEQ ID NO: 4943 - protein, 7 aa, Artificial Sequence
  Synthetic construct
GIGFVAY

SEQ ID NO: 4944 - protein, 7 aa, Artificial Sequence
  Synthetic construct
GIGFVQF

SEQ ID NO: 4945 - protein, 7 aa, Artificial Sequence
  Synthetic construct
GIGFVQY

SEQ ID NO: 4946 - protein, 7 aa, Artificial Sequence
  Synthetic construct
GIGFVDF

SEQ ID NO: 4947 - protein, 7 aa, Artificial Sequence
  Synthetic construct
GIGFVDY

SEQ ID NO: 4948 - protein, 7 aa, Artificial Sequence
  Synthetic construct
GIGFVVF

SEQ ID NO: 4949 - protein, 7 aa, Artificial Sequence
  Synthetic construct
GIGFVVY

SEQ ID NO: 4950 - protein, 7 aa, Artificial Sequence
  Synthetic construct
GIGFTFF

SEQ ID NO: 4951 - protein, 7 aa, Artificial Sequence
  Synthetic construct
GIGFTFY

SEQ ID NO: 4952 - protein, 7 aa, Artificial Sequence
  Synthetic construct
GIGFTRF

SEQ ID NO: 4953 - protein, 7 aa, Artificial Sequence
  Synthetic construct
GIGFTRY

SEQ ID NO: 4954 - protein, 7 aa, Artificial Sequence
  Synthetic construct
GIGFTCF

SEQ ID NO: 4955 - protein, 7 aa, Artificial Sequence
  Synthetic construct
GIGFTCY

SEQ ID NO: 4956 - protein, 7 aa, Artificial Sequence
  Synthetic construct
GIGFTLF

SEQ ID NO: 4957 - protein, 7 aa, Artificial Sequence
  Synthetic construct
GIGFTLY

SEQ ID NO: 4958 - protein, 7 aa, Artificial Sequence
  Synthetic construct
GIGFTAF

SEQ ID NO: 4959 - protein, 7 aa, Artificial Sequence
  Synthetic construct
GIGFTAY

SEQ ID NO: 4960 - protein, 7 aa, Artificial Sequence
  Synthetic construct
GIGFTQF

SEQ ID NO: 4961 - protein, 7 aa, Artificial Sequence
  Synthetic construct
GIGFTQY

SEQ ID NO: 4962 - protein, 7 aa, Artificial Sequence
  Synthetic construct
GIGFTDF

SEQ ID NO: 4963 - protein, 7 aa, Artificial Sequence
  Synthetic construct
GIGFTDY

SEQ ID NO: 4964 - protein, 7 aa, Artificial Sequence
  Synthetic construct
GIGFTVF

SEQ ID NO: 4965 - protein, 7 aa, Artificial Sequence
  Synthetic construct
GIGFTVY

SEQ ID NO: 4966 - protein, 7 aa, Artificial Sequence
  Synthetic construct
GIGFGFF

SEQ ID NO: 4967 - protein, 7 aa, Artificial Sequence
  Synthetic construct
GIGFGFY

SEQ ID NO: 4968 - protein, 7 aa, Artificial Sequence
  Synthetic construct
GIGFGRF

SEQ ID NO: 4969 - protein, 7 aa, Artificial Sequence
  Synthetic construct
GIGFGRY

SEQ ID NO: 4970 - protein, 7 aa, Artificial Sequence
  Synthetic construct
GIGFGCF

SEQ ID NO: 4971 - protein, 7 aa, Artificial Sequence
  Synthetic construct
GIGFGCY

SEQ ID NO: 4972 - protein, 7 aa, Artificial Sequence
  Synthetic construct
GIGFGLF

SEQ ID NO: 4973 - protein, 7 aa, Artificial Sequence
  Synthetic construct
GIGFGLY

SEQ ID NO: 4974 - protein, 7 aa, Artificial Sequence
  Synthetic construct
GIGFGAF

SEQ ID NO: 4975 - protein, 7 aa, Artificial Sequence
  Synthetic construct
GIGFGAY

SEQ ID NO: 4976 - protein, 7 aa, Artificial Sequence
  Synthetic construct
GIGFGQF

SEQ ID NO: 4977 - protein, 7 aa, Artificial Sequence
  Synthetic construct
GIGFGQY

SEQ ID NO: 4978 - protein, 7 aa, Artificial Sequence
  Synthetic construct
GIGFGDF

SEQ ID NO: 4979 - protein, 7 aa, Artificial Sequence
  Synthetic construct
GIGFGDY

SEQ ID NO: 4980 - protein, 7 aa, Artificial Sequence
  Synthetic construct
GIGFGVF

SEQ ID NO: 4981 - protein, 7 aa, Artificial Sequence
  Synthetic construct
GIGFGVY

SEQ ID NO: 4982 - protein, 7 aa, Artificial Sequence
  Synthetic construct
GIGFAFF

SEQ ID NO: 4983 - protein, 7 aa, Artificial Sequence
  Synthetic construct
GIGFAFY

SEQ ID NO: 4984 - protein, 7 aa, Artificial Sequence
  Synthetic construct
GIGFARF

SEQ ID NO: 4985 - protein, 7 aa, Artificial Sequence
  Synthetic construct
GIGFARY

SEQ ID NO: 4986 - protein, 7 aa, Artificial Sequence
  Synthetic construct
GIGFACF

SEQ ID NO: 4987 - protein, 7 aa, Artificial Sequence
  Synthetic construct
GIGFACY

SEQ ID NO: 4988 - protein, 7 aa, Artificial Sequence
  Synthetic construct
GIGFALF

SEQ ID NO: 4989 - protein, 7 aa, Artificial Sequence
  Synthetic construct
GIGFALY

SEQ ID NO: 4990 - protein, 7 aa, Artificial Sequence
  Synthetic construct
GIGFAAF

SEQ ID NO: 4991 - protein, 7 aa, Artificial Sequence
  Synthetic construct
GIGFAAY

SEQ ID NO: 4992 - protein, 7 aa, Artificial Sequence
  Synthetic construct
GIGFAQF

SEQ ID NO: 4993 - protein, 7 aa, Artificial Sequence
  Synthetic construct
GIGFAQY

SEQ ID NO: 4994 - protein, 7 aa, Artificial Sequence
  Synthetic construct
GIGFADF

SEQ ID NO: 4995 - protein, 7 aa, Artificial Sequence
  Synthetic construct
GIGFADY

SEQ ID NO: 4996 - protein, 7 aa, Artificial Sequence
  Synthetic construct
GIGFAVF

SEQ ID NO: 4997 - protein, 7 aa, Artificial Sequence
  Synthetic construct
GIGFAVY

SEQ ID NO: 4998 - protein, 7 aa, Artificial Sequence
  Synthetic construct
GIGFQFF

SEQ ID NO: 4999 - protein, 7 aa, Artificial Sequence
  Synthetic construct
GIGFQFY

SEQ ID NO: 5000 - protein, 7 aa, Artificial Sequence
  Synthetic construct
GIGFQRF

SEQ ID NO: 5001 - protein, 7 aa, Artificial Sequence
  Synthetic construct
GIGFQRY

SEQ ID NO: 5002 - protein, 7 aa, Artificial Sequence
  Synthetic construct
GIGFQCF

SEQ ID NO: 5003 - protein, 7 aa, Artificial Sequence
  Synthetic construct
GIGFQCY

SEQ ID NO: 5004 - protein, 7 aa, Artificial Sequence
  Synthetic construct
GIGFQLF

SEQ ID NO: 5005 - protein, 7 aa, Artificial Sequence
  Synthetic construct
GIGFQLY

SEQ ID NO: 5006 - protein, 7 aa, Artificial Sequence
  Synthetic construct
GIGFQAF

SEQ ID NO: 5007 - protein, 7 aa, Artificial Sequence
  Synthetic construct
GIGFQAY

SEQ ID NO: 5008 - protein, 7 aa, Artificial Sequence
  Synthetic construct
GIGFQQF

SEQ ID NO: 5009 - protein, 7 aa, Artificial Sequence
  Synthetic construct
GIGFQQY

SEQ ID NO: 5010 - protein, 7 aa, Artificial Sequence
  Synthetic construct
GIGFQDF

SEQ ID NO: 5011 - protein, 7 aa, Artificial Sequence
  Synthetic construct
GIGFQDY

SEQ ID NO: 5012 - protein, 7 aa, Artificial Sequence
  Synthetic construct
GIGFQVF

SEQ ID NO: 5013 - protein, 7 aa, Artificial Sequence
  Synthetic construct
GIGFQVY

SEQ ID NO: 5014 - protein, 7 aa, Artificial Sequence
  Synthetic construct
GFIYIFF

SEQ ID NO: 5015 - protein, 7 aa, Artificial Sequence
  Synthetic construct
GFIYIFY

SEQ ID NO: 5016 - protein, 7 aa, Artificial Sequence
  Synthetic construct
GFIYIRF

SEQ ID NO: 5017 - protein, 7 aa, Artificial Sequence
  Synthetic construct
GFIYIRY

SEQ ID NO: 5018 - protein, 7 aa, Artificial Sequence
  Synthetic construct
GFIYICF

SEQ ID NO: 5019 - protein, 7 aa, Artificial Sequence
  Synthetic construct
GFIYICY

SEQ ID NO: 5020 - protein, 7 aa, Artificial Sequence
  Synthetic construct
GFIYILF

SEQ ID NO: 5021 - protein, 7 aa, Artificial Sequence
  Synthetic construct
GFIYILY

SEQ ID NO: 5022 - protein, 7 aa, Artificial Sequence
  Synthetic construct
GFIYIAF

SEQ ID NO: 5023 - protein, 7 aa, Artificial Sequence
  Synthetic construct
GFIYIAY

SEQ ID NO: 5024 - protein, 7 aa, Artificial Sequence
  Synthetic construct
GFIYIQF

SEQ ID NO: 5025 - protein, 7 aa, Artificial Sequence
  Synthetic construct
GFIYIQY

SEQ ID NO: 5026 - protein, 7 aa, Artificial Sequence
  Synthetic construct
GFIYIDF

SEQ ID NO: 5027 - protein, 7 aa, Artificial Sequence
  Synthetic construct
GFIYIDY

SEQ ID NO: 5028 - protein, 7 aa, Artificial Sequence
  Synthetic construct
GFIYIVF

SEQ ID NO: 5029 - protein, 7 aa, Artificial Sequence
  Synthetic construct
GFIYIVY

SEQ ID NO: 5030 - protein, 7 aa, Artificial Sequence
  Synthetic construct
GFIYDFF

SEQ ID NO: 5031 - protein, 7 aa, Artificial Sequence
  Synthetic construct
GFIYDFY

SEQ ID NO: 5032 - protein, 7 aa, Artificial Sequence
  Synthetic construct
GFIYDRF

SEQ ID NO: 5033 - protein, 7 aa, Artificial Sequence
  Synthetic construct
GFIYDRY

SEQ ID NO: 5034 - protein, 7 aa, Artificial Sequence
  Synthetic construct
GFIYDCF

SEQ ID NO: 5035 - protein, 7 aa, Artificial Sequence
  Synthetic construct
GFIYDCY

SEQ ID NO: 5036 - protein, 7 aa, Artificial Sequence
  Synthetic construct
GFIYDLF

SEQ ID NO: 5037 - protein, 7 aa, Artificial Sequence
  Synthetic construct
GFIYDLY

SEQ ID NO: 5038 - protein, 7 aa, Artificial Sequence
  Synthetic construct
GFIYDAF

SEQ ID NO: 5039 - protein, 7 aa, Artificial Sequence
  Synthetic construct
GFIYDAY

SEQ ID NO: 5040 - protein, 7 aa, Artificial Sequence
  Synthetic construct
GFIYDQF

SEQ ID NO: 5041 - protein, 7 aa, Artificial Sequence
  Synthetic construct
GFIYDQY

SEQ ID NO: 5042 - protein, 7 aa, Artificial Sequence
  Synthetic construct
GFIYDDF

SEQ ID NO: 5043 - protein, 7 aa, Artificial Sequence
  Synthetic construct
GFIYDDY

SEQ ID NO: 5044 - protein, 7 aa, Artificial Sequence
  Synthetic construct
GFIYDVF

SEQ ID NO: 5045 - protein, 7 aa, Artificial Sequence
  Synthetic construct
GFIYDVY

SEQ ID NO: 5046 - protein, 7 aa, Artificial Sequence
  Synthetic construct
GFIYYFF

SEQ ID NO: 5047 - protein, 7 aa, Artificial Sequence
  Synthetic construct
GFIYYFY

SEQ ID NO: 5048 - protein, 7 aa, Artificial Sequence
  Synthetic construct
GFIYYRF

SEQ ID NO: 5049 - protein, 7 aa, Artificial Sequence
  Synthetic construct
GFIYYRY

SEQ ID NO: 5050 - protein, 7 aa, Artificial Sequence
  Synthetic construct
GFIYYCF

SEQ ID NO: 5051 - protein, 7 aa, Artificial Sequence
  Synthetic construct
GFIYYCY

SEQ ID NO: 5052 - protein, 7 aa, Artificial Sequence
  Synthetic construct
GFIYYLF

SEQ ID NO: 5053 - protein, 7 aa, Artificial Sequence
  Synthetic construct
GFIYYLY

SEQ ID NO: 5054 - protein, 7 aa, Artificial Sequence
  Synthetic construct
GFIYYAF

SEQ ID NO: 5055 - protein, 7 aa, Artificial Sequence
  Synthetic construct
GFIYYAY

SEQ ID NO: 5056 - protein, 7 aa, Artificial Sequence
  Synthetic construct
GFIYYQF

SEQ ID NO: 5057 - protein, 7 aa, Artificial Sequence
  Synthetic construct
GFIYYQY

SEQ ID NO: 5058 - protein, 7 aa, Artificial Sequence
  Synthetic construct
GFIYYDF

SEQ ID NO: 5059 - protein, 7 aa, Artificial Sequence
  Synthetic construct
GFIYYDY

SEQ ID NO: 5060 - protein, 7 aa, Artificial Sequence
  Synthetic construct
GFIYYVF

SEQ ID NO: 5061 - protein, 7 aa, Artificial Sequence
  Synthetic construct
GFIYYVY

SEQ ID NO: 5062 - protein, 7 aa, Artificial Sequence
  Synthetic construct
GFIYFFF

SEQ ID NO: 5063 - protein, 7 aa, Artificial Sequence
  Synthetic construct
GFIYFFY

SEQ ID NO: 5064 - protein, 7 aa, Artificial Sequence
  Synthetic construct
GFIYFRF

SEQ ID NO: 5065 - protein, 7 aa, Artificial Sequence
  Synthetic construct
GFIYFRY

SEQ ID NO: 5066 - protein, 7 aa, Artificial Sequence
  Synthetic construct
GFIYFCF

SEQ ID NO: 5067 - protein, 7 aa, Artificial Sequence
  Synthetic construct
GFIYFCY

SEQ ID NO: 5068 - protein, 7 aa, Artificial Sequence
  Synthetic construct
GFIYFLF

SEQ ID NO: 5069 - protein, 7 aa, Artificial Sequence
  Synthetic construct
GFIYFLY

SEQ ID NO: 5070 - protein, 7 aa, Artificial Sequence
  Synthetic construct
GFIYFAF

SEQ ID NO: 5071 - protein, 7 aa, Artificial Sequence
  Synthetic construct
GFIYFAY

SEQ ID NO: 5072 - protein, 7 aa, Artificial Sequence
  Synthetic construct
GFIYFQF

SEQ ID NO: 5073 - protein, 7 aa, Artificial Sequence
  Synthetic construct
GFIYFQY

SEQ ID NO: 5074 - protein, 7 aa, Artificial Sequence
  Synthetic construct
GFIYFDF

SEQ ID NO: 5075 - protein, 7 aa, Artificial Sequence
  Synthetic construct
GFIYFDY

SEQ ID NO: 5076 - protein, 7 aa, Artificial Sequence
  Synthetic construct
GFIYFVF

SEQ ID NO: 5077 - protein, 7 aa, Artificial Sequence
  Synthetic construct
GFIYFVY

SEQ ID NO: 5078 - protein, 7 aa, Artificial Sequence
  Synthetic construct
GFIYVFF

SEQ ID NO: 5079 - protein, 7 aa, Artificial Sequence
  Synthetic construct
GFIYVFY

SEQ ID NO: 5080 - protein, 7 aa, Artificial Sequence
  Synthetic construct
GFIYVRF

SEQ ID NO: 5081 - protein, 7 aa, Artificial Sequence
  Synthetic construct
GFIYVRY

SEQ ID NO: 5082 - protein, 7 aa, Artificial Sequence
  Synthetic construct
GFIYVCF

SEQ ID NO: 5083 - protein, 7 aa, Artificial Sequence
  Synthetic construct
GFIYVCY

SEQ ID NO: 5084 - protein, 7 aa, Artificial Sequence
  Synthetic construct
GFIYVLF

SEQ ID NO: 5085 - protein, 7 aa, Artificial Sequence
  Synthetic construct
GFIYVLY

SEQ ID NO: 5086 - protein, 7 aa, Artificial Sequence
  Synthetic construct
GFIYVAF

SEQ ID NO: 5087 - protein, 7 aa, Artificial Sequence
  Synthetic construct
GFIYVAY

SEQ ID NO: 5088 - protein, 7 aa, Artificial Sequence
  Synthetic construct
GFIYVQF

SEQ ID NO: 5089 - protein, 7 aa, Artificial Sequence
  Synthetic construct
GFIYVQY

SEQ ID NO: 5090 - protein, 7 aa, Artificial Sequence
  Synthetic construct
GFIYVDF

SEQ ID NO: 5091 - protein, 7 aa, Artificial Sequence
  Synthetic construct
GFIYVDY

SEQ ID NO: 5092 - protein, 7 aa, Artificial Sequence
  Synthetic construct
GFIYVVF

SEQ ID NO: 5093 - protein, 7 aa, Artificial Sequence
  Synthetic construct
GFIYVVY

SEQ ID NO: 5094 - protein, 7 aa, Artificial Sequence
  Synthetic construct
GFIYTFF

SEQ ID NO: 5095 - protein, 7 aa, Artificial Sequence
  Synthetic construct
GFIYTFY

SEQ ID NO: 5096 - protein, 7 aa, Artificial Sequence
  Synthetic construct
GFIYTRF

SEQ ID NO: 5097 - protein, 7 aa, Artificial Sequence
  Synthetic construct
GFIYTRY

SEQ ID NO: 5098 - protein, 7 aa, Artificial Sequence
  Synthetic construct
GFIYTCF

SEQ ID NO: 5099 - protein, 7 aa, Artificial Sequence
  Synthetic construct
GFIYTCY

SEQ ID NO: 5100 - protein, 7 aa, Artificial Sequence
  Synthetic construct
GFIYTLF

SEQ ID NO: 5101 - protein, 7 aa, Artificial Sequence
  Synthetic construct
GFIYTLY

SEQ ID NO: 5102 - protein, 7 aa, Artificial Sequence
  Synthetic construct
GFIYTAF

SEQ ID NO: 5103 - protein, 7 aa, Artificial Sequence
  Synthetic construct
GFIYTAY

SEQ ID NO: 5104 - protein, 7 aa, Artificial Sequence
  Synthetic construct
GFIYTQF

SEQ ID NO: 5105 - protein, 7 aa, Artificial Sequence
  Synthetic construct
GFIYTQY

SEQ ID NO: 5106 - protein, 7 aa, Artificial Sequence
  Synthetic construct
GFIYTDF

SEQ ID NO: 5107 - protein, 7 aa, Artificial Sequence
  Synthetic construct
GFIYTDY

SEQ ID NO: 5108 - protein, 7 aa, Artificial Sequence
  Synthetic construct
GFIYTVF

SEQ ID NO: 5109 - protein, 7 aa, Artificial Sequence
  Synthetic construct
GFIYTVY

SEQ ID NO: 5110 - protein, 7 aa, Artificial Sequence
  Synthetic construct
GFIYGFF

SEQ ID NO: 5111 - protein, 7 aa, Artificial Sequence
  Synthetic construct
GFIYGFY

SEQ ID NO: 5112 - protein, 7 aa, Artificial Sequence
  Synthetic construct
GFIYGRF

SEQ ID NO: 5113 - protein, 7 aa, Artificial Sequence
  Synthetic construct
GFIYGRY

SEQ ID NO: 5114 - protein, 7 aa, Artificial Sequence
  Synthetic construct
GFIYGCF

SEQ ID NO: 5115 - protein, 7 aa, Artificial Sequence
  Synthetic construct
GFIYGCY

SEQ ID NO: 5116 - protein, 7 aa, Artificial Sequence
  Synthetic construct
GFIYGLF

SEQ ID NO: 5117 - protein, 7 aa, Artificial Sequence
  Synthetic construct
GFIYGLY

SEQ ID NO: 5118 - protein, 7 aa, Artificial Sequence
  Synthetic construct
GFIYGAF

SEQ ID NO: 5119 - protein, 7 aa, Artificial Sequence
  Synthetic construct
GFIYGAY

SEQ ID NO: 5120 - protein, 7 aa, Artificial Sequence
  Synthetic construct
GFIYGQF

SEQ ID NO: 5121 - protein, 7 aa, Artificial Sequence
  Synthetic construct
GFIYGQY

SEQ ID NO: 5122 - protein, 7 aa, Artificial Sequence
  Synthetic construct
GFIYGDF

SEQ ID NO: 5123 - protein, 7 aa, Artificial Sequence
  Synthetic construct
GFIYGDY

SEQ ID NO: 5124 - protein, 7 aa, Artificial Sequence
  Synthetic construct
GFIYGVF

SEQ ID NO: 5125 - protein, 7 aa, Artificial Sequence
  Synthetic construct
GFIYGVY

SEQ ID NO: 5126 - protein, 7 aa, Artificial Sequence
  Synthetic construct
GFIYAFF

SEQ ID NO: 5127 - protein, 7 aa, Artificial Sequence
  Synthetic construct
GFIYAFY

SEQ ID NO: 5128 - protein, 7 aa, Artificial Sequence
  Synthetic construct
GFIYARF

SEQ ID NO: 5129 - protein, 7 aa, Artificial Sequence
  Synthetic construct
GFIYARY

SEQ ID NO: 5130 - protein, 7 aa, Artificial Sequence
  Synthetic construct
GFIYACF

SEQ ID NO: 5131 - protein, 7 aa, Artificial Sequence
  Synthetic construct
GFIYACY

SEQ ID NO: 5132 - protein, 7 aa, Artificial Sequence
  Synthetic construct
GFIYALF

SEQ ID NO: 5133 - protein, 7 aa, Artificial Sequence
  Synthetic construct
GFIYALY

SEQ ID NO: 5134 - protein, 7 aa, Artificial Sequence
  Synthetic construct
GFIYAAF

SEQ ID NO: 5135 - protein, 7 aa, Artificial Sequence
  Synthetic construct
GFIYAAY

SEQ ID NO: 5136 - protein, 7 aa, Artificial Sequence
  Synthetic construct
GFIYAQF

SEQ ID NO: 5137 - protein, 7 aa, Artificial Sequence
  Synthetic construct
GFIYAQY

SEQ ID NO: 5138 - protein, 7 aa, Artificial Sequence
  Synthetic construct
GFIYADF

SEQ ID NO: 5139 - protein, 7 aa, Artificial Sequence
  Synthetic construct
GFIYADY

SEQ ID NO: 5140 - protein, 7 aa, Artificial Sequence
  Synthetic construct
GFIYAVF

SEQ ID NO: 5141 - protein, 7 aa, Artificial Sequence
  Synthetic construct
GFIYAVY

SEQ ID NO: 5142 - protein, 7 aa, Artificial Sequence
  Synthetic construct
GFIYQFF

SEQ ID NO: 5143 - protein, 7 aa, Artificial Sequence
  Synthetic construct
GFIYQFY

SEQ ID NO: 5144 - protein, 7 aa, Artificial Sequence
  Synthetic construct
GFIYQRF

SEQ ID NO: 5145 - protein, 7 aa, Artificial Sequence
  Synthetic construct
GFIYQRY

SEQ ID NO: 5146 - protein, 7 aa, Artificial Sequence
  Synthetic construct
GFIYQCF

SEQ ID NO: 5147 - protein, 7 aa, Artificial Sequence
  Synthetic construct
GFIYQCY

SEQ ID NO: 5148 - protein, 7 aa, Artificial Sequence
  Synthetic construct
GFIYQLF

SEQ ID NO: 5149 - protein, 7 aa, Artificial Sequence
  Synthetic construct
GFIYQLY

SEQ ID NO: 5150 - protein, 7 aa, Artificial Sequence
  Synthetic construct
GFIYQAF

SEQ ID NO: 5151 - protein, 7 aa, Artificial Sequence
  Synthetic construct
GFIYQAY

SEQ ID NO: 5152 - protein, 7 aa, Artificial Sequence
  Synthetic construct
GFIYQQF

SEQ ID NO: 5153 - protein, 7 aa, Artificial Sequence
  Synthetic construct
GFIYQQY

SEQ ID NO: 5154 - protein, 7 aa, Artificial Sequence
  Synthetic construct
GFIYQDF

SEQ ID NO: 5155 - protein, 7 aa, Artificial Sequence
  Synthetic construct
GFIYQDY

SEQ ID NO: 5156 - protein, 7 aa, Artificial Sequence
  Synthetic construct
GFIYQVF

SEQ ID NO: 5157 - protein, 7 aa, Artificial Sequence
  Synthetic construct
GFIYQVY

SEQ ID NO: 5158 - protein, 7 aa, Artificial Sequence
  Synthetic construct
GFIPIFF

SEQ ID NO: 5159 - protein, 7 aa, Artificial Sequence
  Synthetic construct
GFIPIFY

SEQ ID NO: 5160 - protein, 7 aa, Artificial Sequence
  Synthetic construct
GFIPIRF

SEQ ID NO: 5161 - protein, 7 aa, Artificial Sequence
  Synthetic construct
GFIPIRY

SEQ ID NO: 5162 - protein, 7 aa, Artificial Sequence
  Synthetic construct
GFIPICF

SEQ ID NO: 5163 - protein, 7 aa, Artificial Sequence
  Synthetic construct
GFIPICY

SEQ ID NO: 5164 - protein, 7 aa, Artificial Sequence
  Synthetic construct
GFIPILF

SEQ ID NO: 5165 - protein, 7 aa, Artificial Sequence
  Synthetic construct
GFIPILY

SEQ ID NO: 5166 - protein, 7 aa, Artificial Sequence
  Synthetic construct
GFIPIAF

SEQ ID NO: 5167 - protein, 7 aa, Artificial Sequence
  Synthetic construct
GFIPIAY

SEQ ID NO: 5168 - protein, 7 aa, Artificial Sequence
  Synthetic construct
GFIPIQF

SEQ ID NO: 5169 - protein, 7 aa, Artificial Sequence
  Synthetic construct
GFIPIQY

SEQ ID NO: 5170 - protein, 7 aa, Artificial Sequence
  Synthetic construct
GFIPIDF

SEQ ID NO: 5171 - protein, 7 aa, Artificial Sequence
  Synthetic construct
GFIPIDY

SEQ ID NO: 5172 - protein, 7 aa, Artificial Sequence
  Synthetic construct
GFIPIVF

SEQ ID NO: 5173 - protein, 7 aa, Artificial Sequence
  Synthetic construct
GFIPIVY

SEQ ID NO: 5174 - protein, 7 aa, Artificial Sequence
  Synthetic construct
GFIPDFF

SEQ ID NO: 5175 - protein, 7 aa, Artificial Sequence
  Synthetic construct
GFIPDFY

SEQ ID NO: 5176 - protein, 7 aa, Artificial Sequence
  Synthetic construct
GFIPDRF

SEQ ID NO: 5177 - protein, 7 aa, Artificial Sequence
  Synthetic construct
GFIPDRY

SEQ ID NO: 5178 - protein, 7 aa, Artificial Sequence
  Synthetic construct
GFIPDCF

SEQ ID NO: 5179 - protein, 7 aa, Artificial Sequence
  Synthetic construct
GFIPDCY

SEQ ID NO: 5180 - protein, 7 aa, Artificial Sequence
  Synthetic construct
GFIPDLF

SEQ ID NO: 5181 - protein, 7 aa, Artificial Sequence
  Synthetic construct
GFIPDLY

SEQ ID NO: 5182 - protein, 7 aa, Artificial Sequence
  Synthetic construct
GFIPDAF

SEQ ID NO: 5183 - protein, 7 aa, Artificial Sequence
  Synthetic construct
GFIPDAY

SEQ ID NO: 5184 - protein, 7 aa, Artificial Sequence
  Synthetic construct
GFIPDQF

SEQ ID NO: 5185 - protein, 7 aa, Artificial Sequence
  Synthetic construct
GFIPDQY

SEQ ID NO: 5186 - protein, 7 aa, Artificial Sequence
  Synthetic construct
GFIPDDF

SEQ ID NO: 5187 - protein, 7 aa, Artificial Sequence
  Synthetic construct
GFIPDDY

SEQ ID NO: 5188 - protein, 7 aa, Artificial Sequence
  Synthetic construct
GFIPDVF

SEQ ID NO: 5189 - protein, 7 aa, Artificial Sequence
  Synthetic construct
GFIPDVY

SEQ ID NO: 5190 - protein, 7 aa, Artificial Sequence
  Synthetic construct
GFIPYFF

SEQ ID NO: 5191 - protein, 7 aa, Artificial Sequence
  Synthetic construct
GFIPYFY

SEQ ID NO: 5192 - protein, 7 aa, Artificial Sequence
  Synthetic construct
GFIPYRF

SEQ ID NO: 5193 - protein, 7 aa, Artificial Sequence
  Synthetic construct
GFIPYRY

SEQ ID NO: 5194 - protein, 7 aa, Artificial Sequence
  Synthetic construct
GFIPYCF

SEQ ID NO: 5195 - protein, 7 aa, Artificial Sequence
  Synthetic construct
GFIPYCY

SEQ ID NO: 5196 - protein, 7 aa, Artificial Sequence
  Synthetic construct
GFIPYLF

SEQ ID NO: 5197 - protein, 7 aa, Artificial Sequence
  Synthetic construct
GFIPYLY

SEQ ID NO: 5198 - protein, 7 aa, Artificial Sequence
  Synthetic construct
GFIPYAF

SEQ ID NO: 5199 - protein, 7 aa, Artificial Sequence
  Synthetic construct
GFIPYAY

SEQ ID NO: 5200 - protein, 7 aa, Artificial Sequence
  Synthetic construct
GFIPYQF

SEQ ID NO: 5201 - protein, 7 aa, Artificial Sequence
  Synthetic construct
GFIPYQY

SEQ ID NO: 5202 - protein, 7 aa, Artificial Sequence
  Synthetic construct
GFIPYDF

SEQ ID NO: 5203 - protein, 7 aa, Artificial Sequence
  Synthetic construct
GFIPYDY

SEQ ID NO: 5204 - protein, 7 aa, Artificial Sequence
  Synthetic construct
GFIPYVF

SEQ ID NO: 5205 - protein, 7 aa, Artificial Sequence
  Synthetic construct
GFIPYVY

SEQ ID NO: 5206 - protein, 7 aa, Artificial Sequence
  Synthetic construct
GFIPFFF

SEQ ID NO: 5207 - protein, 7 aa, Artificial Sequence
  Synthetic construct
GFIPFFY

SEQ ID NO: 5208 - protein, 7 aa, Artificial Sequence
  Synthetic construct
GFIPFRF

SEQ ID NO: 5209 - protein, 7 aa, Artificial Sequence
  Synthetic construct
GFIPFRY

SEQ ID NO: 5210 - protein, 7 aa, Artificial Sequence
  Synthetic construct
GFIPFCF

SEQ ID NO: 5211 - protein, 7 aa, Artificial Sequence
  Synthetic construct
GFIPFCY

SEQ ID NO: 5212 - protein, 7 aa, Artificial Sequence
  Synthetic construct
GFIPFLF

SEQ ID NO: 5213 - protein, 7 aa, Artificial Sequence
  Synthetic construct
GFIPFLY

SEQ ID NO: 5214 - protein, 7 aa, Artificial Sequence
  Synthetic construct
GFIPFAF

SEQ ID NO: 5215 - protein, 7 aa, Artificial Sequence
  Synthetic construct
GFIPFAY

SEQ ID NO: 5216 - protein, 7 aa, Artificial Sequence
  Synthetic construct
GFIPFQF

SEQ ID NO: 5217 - protein, 7 aa, Artificial Sequence
  Synthetic construct
GFIPFQY

SEQ ID NO: 5218 - protein, 7 aa, Artificial Sequence
  Synthetic construct
GFIPFDF

SEQ ID NO: 5219 - protein, 7 aa, Artificial Sequence
  Synthetic construct
GFIPFDY

SEQ ID NO: 5220 - protein, 7 aa, Artificial Sequence
  Synthetic construct
GFIPFVF

SEQ ID NO: 5221 - protein, 7 aa, Artificial Sequence
  Synthetic construct
GFIPFVY

SEQ ID NO: 5222 - protein, 7 aa, Artificial Sequence
  Synthetic construct
GFIPVFF

SEQ ID NO: 5223 - protein, 7 aa, Artificial Sequence
  Synthetic construct
GFIPVFY

SEQ ID NO: 5224 - protein, 7 aa, Artificial Sequence
  Synthetic construct
GFIPVRF

SEQ ID NO: 5225 - protein, 7 aa, Artificial Sequence
  Synthetic construct
GFIPVRY

SEQ ID NO: 5226 - protein, 7 aa, Artificial Sequence
  Synthetic construct
GFIPVCF

SEQ ID NO: 5227 - protein, 7 aa, Artificial Sequence
  Synthetic construct
GFIPVCY

SEQ ID NO: 5228 - protein, 7 aa, Artificial Sequence
  Synthetic construct
GFIPVLF

SEQ ID NO: 5229 - protein, 7 aa, Artificial Sequence
  Synthetic construct
GFIPVLY

SEQ ID NO: 5230 - protein, 7 aa, Artificial Sequence
  Synthetic construct
GFIPVAF

SEQ ID NO: 5231 - protein, 7 aa, Artificial Sequence
  Synthetic construct
GFIPVAY

SEQ ID NO: 5232 - protein, 7 aa, Artificial Sequence
  Synthetic construct
GFIPVQF

SEQ ID NO: 5233 - protein, 7 aa, Artificial Sequence
  Synthetic construct
GFIPVQY

SEQ ID NO: 5234 - protein, 7 aa, Artificial Sequence
  Synthetic construct
GFIPVDF

SEQ ID NO: 5235 - protein, 7 aa, Artificial Sequence
  Synthetic construct
GFIPVDY

SEQ ID NO: 5236 - protein, 7 aa, Artificial Sequence
  Synthetic construct
GFIPVVF

SEQ ID NO: 5237 - protein, 7 aa, Artificial Sequence
  Synthetic construct
GFIPVVY

SEQ ID NO: 5238 - protein, 7 aa, Artificial Sequence
  Synthetic construct
GFIPTFF

SEQ ID NO: 5239 - protein, 7 aa, Artificial Sequence
  Synthetic construct
GFIPTFY

SEQ ID NO: 5240 - protein, 7 aa, Artificial Sequence
  Synthetic construct
GFIPTRF

SEQ ID NO: 5241 - protein, 7 aa, Artificial Sequence
  Synthetic construct
GFIPTRY

SEQ ID NO: 5242 - protein, 7 aa, Artificial Sequence
  Synthetic construct
GFIPTCF

SEQ ID NO: 5243 - protein, 7 aa, Artificial Sequence
  Synthetic construct
GFIPTCY

SEQ ID NO: 5244 - protein, 7 aa, Artificial Sequence
  Synthetic construct
GFIPTLF

SEQ ID NO: 5245 - protein, 7 aa, Artificial Sequence
  Synthetic construct
GFIPTLY

SEQ ID NO: 5246 - protein, 7 aa, Artificial Sequence
  Synthetic construct
GFIPTAF

SEQ ID NO: 5247 - protein, 7 aa, Artificial Sequence
  Synthetic construct
GFIPTAY

SEQ ID NO: 5248 - protein, 7 aa, Artificial Sequence
  Synthetic construct
GFIPTQF

SEQ ID NO: 5249 - protein, 7 aa, Artificial Sequence
  Synthetic construct
GFIPTQY

SEQ ID NO: 5250 - protein, 7 aa, Artificial Sequence
  Synthetic construct
GFIPTDF

SEQ ID NO: 5251 - protein, 7 aa, Artificial Sequence
  Synthetic construct
GFIPTDY

SEQ ID NO: 5252 - protein, 7 aa, Artificial Sequence
  Synthetic construct
GFIPTVF

SEQ ID NO: 5253 - protein, 7 aa, Artificial Sequence
  Synthetic construct
GFIPTVY

SEQ ID NO: 5254 - protein, 7 aa, Artificial Sequence
  Synthetic construct
GFIPGFF

SEQ ID NO: 5255 - protein, 7 aa, Artificial Sequence
  Synthetic construct
GFIPGFY

SEQ ID NO: 5256 - protein, 7 aa, Artificial Sequence
  Synthetic construct
GFIPGRF

SEQ ID NO: 5257 - protein, 7 aa, Artificial Sequence
  Synthetic construct
GFIPGRY

SEQ ID NO: 5258 - protein, 7 aa, Artificial Sequence
  Synthetic construct
GFIPGCF

SEQ ID NO: 5259 - protein, 7 aa, Artificial Sequence
  Synthetic construct
GFIPGCY

SEQ ID NO: 5260 - protein, 7 aa, Artificial Sequence
  Synthetic construct
GFIPGLF

SEQ ID NO: 5261 - protein, 7 aa, Artificial Sequence
  Synthetic construct
GFIPGLY

SEQ ID NO: 5262 - protein, 7 aa, Artificial Sequence
  Synthetic construct
GFIPGAF

SEQ ID NO: 5263 - protein, 7 aa, Artificial Sequence
  Synthetic construct
GFIPGAY

SEQ ID NO: 5264 - protein, 7 aa, Artificial Sequence
  Synthetic construct
GFIPGQF

SEQ ID NO: 5265 - protein, 7 aa, Artificial Sequence
  Synthetic construct
GFIPGQY

SEQ ID NO: 5266 - protein, 7 aa, Artificial Sequence
  Synthetic construct
GFIPGDF

SEQ ID NO: 5267 - protein, 7 aa, Artificial Sequence
  Synthetic construct
GFIPGDY

SEQ ID NO: 5268 - protein, 7 aa, Artificial Sequence
  Synthetic construct
GFIPGVF

SEQ ID NO: 5269 - protein, 7 aa, Artificial Sequence
  Synthetic construct
GFIPGVY

SEQ ID NO: 5270 - protein, 7 aa, Artificial Sequence
  Synthetic construct
GFIPAFF

SEQ ID NO: 5271 - protein, 7 aa, Artificial Sequence
  Synthetic construct
GFIPAFY

SEQ ID NO: 5272 - protein, 7 aa, Artificial Sequence
  Synthetic construct
GFIPARF

SEQ ID NO: 5273 - protein, 7 aa, Artificial Sequence
  Synthetic construct
GFIPARY

SEQ ID NO: 5274 - protein, 7 aa, Artificial Sequence
  Synthetic construct
GFIPACF

SEQ ID NO: 5275 - protein, 7 aa, Artificial Sequence
  Synthetic construct
GFIPACY

SEQ ID NO: 5276 - protein, 7 aa, Artificial Sequence
  Synthetic construct
GFIPALF

SEQ ID NO: 5277 - protein, 7 aa, Artificial Sequence
  Synthetic construct
GFIPALY

SEQ ID NO: 5278 - protein, 7 aa, Artificial Sequence
  Synthetic construct
GFIPAAF

SEQ ID NO: 5279 - protein, 7 aa, Artificial Sequence
  Synthetic construct
GFIPAAY

SEQ ID NO: 5280 - protein, 7 aa, Artificial Sequence
  Synthetic construct
GFIPAQF

SEQ ID NO: 5281 - protein, 7 aa, Artificial Sequence
  Synthetic construct
GFIPAQY

SEQ ID NO: 5282 - protein, 7 aa, Artificial Sequence
  Synthetic construct
GFIPADF

SEQ ID NO: 5283 - protein, 7 aa, Artificial Sequence
  Synthetic construct
GFIPADY

SEQ ID NO: 5284 - protein, 7 aa, Artificial Sequence
  Synthetic construct
GFIPAVF

SEQ ID NO: 5285 - protein, 7 aa, Artificial Sequence
  Synthetic construct
GFIPAVY

SEQ ID NO: 5286 - protein, 7 aa, Artificial Sequence
  Synthetic construct
GFIPQFF

SEQ ID NO: 5287 - protein, 7 aa, Artificial Sequence
  Synthetic construct
GFIPQFY

SEQ ID NO: 5288 - protein, 7 aa, Artificial Sequence
  Synthetic construct
GFIPQRF

SEQ ID NO: 5289 - protein, 7 aa, Artificial Sequence
  Synthetic construct
GFIPQRY

SEQ ID NO: 5290 - protein, 7 aa, Artificial Sequence
  Synthetic construct
GFIPQCF

SEQ ID NO: 5291 - protein, 7 aa, Artificial Sequence
  Synthetic construct
GFIPQCY

SEQ ID NO: 5292 - protein, 7 aa, Artificial Sequence
  Synthetic construct
GFIPQLF

SEQ ID NO: 5293 - protein, 7 aa, Artificial Sequence
  Synthetic construct
GFIPQLY

SEQ ID NO: 5294 - protein, 7 aa, Artificial Sequence
  Synthetic construct
GFIPQAF

SEQ ID NO: 5295 - protein, 7 aa, Artificial Sequence
  Synthetic construct
GFIPQAY

SEQ ID NO: 5296 - protein, 7 aa, Artificial Sequence
  Synthetic construct
GFIPQQF

SEQ ID NO: 5297 - protein, 7 aa, Artificial Sequence
  Synthetic construct
GFIPQQY

SEQ ID NO: 5298 - protein, 7 aa, Artificial Sequence
  Synthetic construct
GFIPQDF

SEQ ID NO: 5299 - protein, 7 aa, Artificial Sequence
  Synthetic construct
GFIPQDY

SEQ ID NO: 5300 - protein, 7 aa, Artificial Sequence
  Synthetic construct
GFIPQVF

SEQ ID NO: 5301 - protein, 7 aa, Artificial Sequence
  Synthetic construct
GFIPQVY

SEQ ID NO: 5302 - protein, 7 aa, Artificial Sequence
  Synthetic construct
GFIHIFF

SEQ ID NO: 5303 - protein, 7 aa, Artificial Sequence
  Synthetic construct
GFIHIFY

SEQ ID NO: 5304 - protein, 7 aa, Artificial Sequence
  Synthetic construct
GFIHIRF

SEQ ID NO: 5305 - protein, 7 aa, Artificial Sequence
  Synthetic construct
GFIHIRY

SEQ ID NO: 5306 - protein, 7 aa, Artificial Sequence
  Synthetic construct
GFIHICF

SEQ ID NO: 5307 - protein, 7 aa, Artificial Sequence
  Synthetic construct
GFIHICY

SEQ ID NO: 5308 - protein, 7 aa, Artificial Sequence
  Synthetic construct
GFIHILF

SEQ ID NO: 5309 - protein, 7 aa, Artificial Sequence
  Synthetic construct
GFIHILY

SEQ ID NO: 5310 - protein, 7 aa, Artificial Sequence
  Synthetic construct
GFIHIAF

SEQ ID NO: 5311 - protein, 7 aa, Artificial Sequence
  Synthetic construct
GFIHIAY

SEQ ID NO: 5312 - protein, 7 aa, Artificial Sequence
  Synthetic construct
GFIHIQF

SEQ ID NO: 5313 - protein, 7 aa, Artificial Sequence
  Synthetic construct
GFIHIQY

SEQ ID NO: 5314 - protein, 7 aa, Artificial Sequence
  Synthetic construct
GFIHIDF

SEQ ID NO: 5315 - protein, 7 aa, Artificial Sequence
  Synthetic construct
GFIHIDY

SEQ ID NO: 5316 - protein, 7 aa, Artificial Sequence
  Synthetic construct
GFIHIVF

SEQ ID NO: 5317 - protein, 7 aa, Artificial Sequence
  Synthetic construct
GFIHIVY

SEQ ID NO: 5318 - protein, 7 aa, Artificial Sequence
  Synthetic construct
GFIHDFF

SEQ ID NO: 5319 - protein, 7 aa, Artificial Sequence
  Synthetic construct
GFIHDFY

SEQ ID NO: 5320 - protein, 7 aa, Artificial Sequence
  Synthetic construct
GFIHDRF

SEQ ID NO: 5321 - protein, 7 aa, Artificial Sequence
  Synthetic construct
GFIHDRY

SEQ ID NO: 5322 - protein, 7 aa, Artificial Sequence
  Synthetic construct
GFIHDCF

SEQ ID NO: 5323 - protein, 7 aa, Artificial Sequence
  Synthetic construct
GFIHDCY

SEQ ID NO: 5324 - protein, 7 aa, Artificial Sequence
  Synthetic construct
GFIHDLF

SEQ ID NO: 5325 - protein, 7 aa, Artificial Sequence
  Synthetic construct
GFIHDLY

SEQ ID NO: 5326 - protein, 7 aa, Artificial Sequence
  Synthetic construct
GFIHDAF

SEQ ID NO: 5327 - protein, 7 aa, Artificial Sequence
  Synthetic construct
GFIHDAY

SEQ ID NO: 5328 - protein, 7 aa, Artificial Sequence
  Synthetic construct
GFIHDQF

SEQ ID NO: 5329 - protein, 7 aa, Artificial Sequence
  Synthetic construct
GFIHDQY

SEQ ID NO: 5330 - protein, 7 aa, Artificial Sequence
  Synthetic construct
GFIHDDF

SEQ ID NO: 5331 - protein, 7 aa, Artificial Sequence
  Synthetic construct
GFIHDDY

SEQ ID NO: 5332 - protein, 7 aa, Artificial Sequence
  Synthetic construct
GFIHDVF

SEQ ID NO: 5333 - protein, 7 aa, Artificial Sequence
  Synthetic construct
GFIHDVY

SEQ ID NO: 5334 - protein, 7 aa, Artificial Sequence
  Synthetic construct
GFIHYFF

SEQ ID NO: 5335 - protein, 7 aa, Artificial Sequence
  Synthetic construct
GFIHYFY

SEQ ID NO: 5336 - protein, 7 aa, Artificial Sequence
  Synthetic construct
GFIHYRF

SEQ ID NO: 5337 - protein, 7 aa, Artificial Sequence
  Synthetic construct
GFIHYRY

SEQ ID NO: 5338 - protein, 7 aa, Artificial Sequence
  Synthetic construct
GFIHYCF

SEQ ID NO: 5339 - protein, 7 aa, Artificial Sequence
  Synthetic construct
GFIHYCY

SEQ ID NO: 5340 - protein, 7 aa, Artificial Sequence
  Synthetic construct
GFIHYLF

SEQ ID NO: 5341 - protein, 7 aa, Artificial Sequence
  Synthetic construct
GFIHYLY

SEQ ID NO: 5342 - protein, 7 aa, Artificial Sequence
  Synthetic construct
GFIHYAF

SEQ ID NO: 5343 - protein, 7 aa, Artificial Sequence
  Synthetic construct
GFIHYAY

SEQ ID NO: 5344 - protein, 7 aa, Artificial Sequence
  Synthetic construct
GFIHYQF

SEQ ID NO: 5345 - protein, 7 aa, Artificial Sequence
  Synthetic construct
GFIHYQY

SEQ ID NO: 5346 - protein, 7 aa, Artificial Sequence
  Synthetic construct
GFIHYDF

SEQ ID NO: 5347 - protein, 7 aa, Artificial Sequence
  Synthetic construct
GFIHYDY

SEQ ID NO: 5348 - protein, 7 aa, Artificial Sequence
  Synthetic construct
GFIHYVF

SEQ ID NO: 5349 - protein, 7 aa, Artificial Sequence
  Synthetic construct
GFIHYVY

SEQ ID NO: 5350 - protein, 7 aa, Artificial Sequence
  Synthetic construct
GFIHFFF

SEQ ID NO: 5351 - protein, 7 aa, Artificial Sequence
  Synthetic construct
GFIHFFY

SEQ ID NO: 5352 - protein, 7 aa, Artificial Sequence
  Synthetic construct
GFIHFRF

SEQ ID NO: 5353 - protein, 7 aa, Artificial Sequence
  Synthetic construct
GFIHFRY

SEQ ID NO: 5354 - protein, 7 aa, Artificial Sequence
  Synthetic construct
GFIHFCF

SEQ ID NO: 5355 - protein, 7 aa, Artificial Sequence
  Synthetic construct
GFIHFCY

SEQ ID NO: 5356 - protein, 7 aa, Artificial Sequence
  Synthetic construct
GFIHFLF

SEQ ID NO: 5357 - protein, 7 aa, Artificial Sequence
  Synthetic construct
GFIHFLY

SEQ ID NO: 5358 - protein, 7 aa, Artificial Sequence
  Synthetic construct
GFIHFAF

SEQ ID NO: 5359 - protein, 7 aa, Artificial Sequence
  Synthetic construct
GFIHFAY

SEQ ID NO: 5360 - protein, 7 aa, Artificial Sequence
  Synthetic construct
GFIHFQF

SEQ ID NO: 5361 - protein, 7 aa, Artificial Sequence
  Synthetic construct
GFIHFQY

SEQ ID NO: 5362 - protein, 7 aa, Artificial Sequence
  Synthetic construct
GFIHFDF

SEQ ID NO: 5363 - protein, 7 aa, Artificial Sequence
  Synthetic construct
GFIHFDY

SEQ ID NO: 5364 - protein, 7 aa, Artificial Sequence
  Synthetic construct
GFIHFVF

SEQ ID NO: 5365 - protein, 7 aa, Artificial Sequence
  Synthetic construct
GFIHFVY

SEQ ID NO: 5366 - protein, 7 aa, Artificial Sequence
  Synthetic construct
GFIHVFF

SEQ ID NO: 5367 - protein, 7 aa, Artificial Sequence
  Synthetic construct
GFIHVFY

SEQ ID NO: 5368 - protein, 7 aa, Artificial Sequence
  Synthetic construct
GFIHVRF

SEQ ID NO: 5369 - protein, 7 aa, Artificial Sequence
  Synthetic construct
GFIHVRY

SEQ ID NO: 5370 - protein, 7 aa, Artificial Sequence
  Synthetic construct
GFIHVCF

SEQ ID NO: 5371 - protein, 7 aa, Artificial Sequence
  Synthetic construct
GFIHVCY

SEQ ID NO: 5372 - protein, 7 aa, Artificial Sequence
  Synthetic construct
GFIHVLF

SEQ ID NO: 5373 - protein, 7 aa, Artificial Sequence
  Synthetic construct
GFIHVLY

SEQ ID NO: 5374 - protein, 7 aa, Artificial Sequence
  Synthetic construct
GFIHVAF

SEQ ID NO: 5375 - protein, 7 aa, Artificial Sequence
  Synthetic construct
GFIHVAY

SEQ ID NO: 5376 - protein, 7 aa, Artificial Sequence
  Synthetic construct
GFIHVQF

SEQ ID NO: 5377 - protein, 7 aa, Artificial Sequence
  Synthetic construct
GFIHVQY

SEQ ID NO: 5378 - protein, 7 aa, Artificial Sequence
  Synthetic construct
GFIHVDF

SEQ ID NO: 5379 - protein, 7 aa, Artificial Sequence
  Synthetic construct
GFIHVDY

SEQ ID NO: 5380 - protein, 7 aa, Artificial Sequence
  Synthetic construct
GFIHVVF

SEQ ID NO: 5381 - protein, 7 aa, Artificial Sequence
  Synthetic construct
GFIHVVY

SEQ ID NO: 5382 - protein, 7 aa, Artificial Sequence
  Synthetic construct
GFIHTFF

SEQ ID NO: 5383 - protein, 7 aa, Artificial Sequence
  Synthetic construct
GFIHTFY

SEQ ID NO: 5384 - protein, 7 aa, Artificial Sequence
  Synthetic construct
GFIHTRF

SEQ ID NO: 5385 - protein, 7 aa, Artificial Sequence
  Synthetic construct
GFIHTRY

SEQ ID NO: 5386 - protein, 7 aa, Artificial Sequence
  Synthetic construct
GFIHTCF

SEQ ID NO: 5387 - protein, 7 aa, Artificial Sequence
  Synthetic construct
GFIHTCY

SEQ ID NO: 5388 - protein, 7 aa, Artificial Sequence
  Synthetic construct
GFIHTLF

SEQ ID NO: 5389 - protein, 7 aa, Artificial Sequence
  Synthetic construct
GFIHTLY

SEQ ID NO: 5390 - protein, 7 aa, Artificial Sequence
  Synthetic construct
GFIHTAF

SEQ ID NO: 5391 - protein, 7 aa, Artificial Sequence
  Synthetic construct
GFIHTAY

SEQ ID NO: 5392 - protein, 7 aa, Artificial Sequence
  Synthetic construct
GFIHTQF

SEQ ID NO: 5393 - protein, 7 aa, Artificial Sequence
  Synthetic construct
GFIHTQY

SEQ ID NO: 5394 - protein, 7 aa, Artificial Sequence
  Synthetic construct
GFIHTDF

SEQ ID NO: 5395 - protein, 7 aa, Artificial Sequence
  Synthetic construct
GFIHTDY

SEQ ID NO: 5396 - protein, 7 aa, Artificial Sequence
  Synthetic construct
GFIHTVF

SEQ ID NO: 5397 - protein, 7 aa, Artificial Sequence
  Synthetic construct
GFIHTVY

SEQ ID NO: 5398 - protein, 7 aa, Artificial Sequence
  Synthetic construct
GFIHGFF

SEQ ID NO: 5399 - protein, 7 aa, Artificial Sequence
  Synthetic construct
GFIHGFY

SEQ ID NO: 5400 - protein, 7 aa, Artificial Sequence
  Synthetic construct
GFIHGRF

SEQ ID NO: 5401 - protein, 7 aa, Artificial Sequence
  Synthetic construct
GFIHGRY

SEQ ID NO: 5402 - protein, 7 aa, Artificial Sequence
  Synthetic construct
GFIHGCF

SEQ ID NO: 5403 - protein, 7 aa, Artificial Sequence
  Synthetic construct
GFIHGCY

SEQ ID NO: 5404 - protein, 7 aa, Artificial Sequence
  Synthetic construct
GFIHGLF

SEQ ID NO: 5405 - protein, 7 aa, Artificial Sequence
  Synthetic construct
GFIHGLY

SEQ ID NO: 5406 - protein, 7 aa, Artificial Sequence
  Synthetic construct
GFIHGAF

SEQ ID NO: 5407 - protein, 7 aa, Artificial Sequence
  Synthetic construct
GFIHGAY

SEQ ID NO: 5408 - protein, 7 aa, Artificial Sequence
  Synthetic construct
GFIHGQF

SEQ ID NO: 5409 - protein, 7 aa, Artificial Sequence
  Synthetic construct
GFIHGQY

SEQ ID NO: 5410 - protein, 7 aa, Artificial Sequence
  Synthetic construct
GFIHGDF

SEQ ID NO: 5411 - protein, 7 aa, Artificial Sequence
  Synthetic construct
GFIHGDY

SEQ ID NO: 5412 - protein, 7 aa, Artificial Sequence
  Synthetic construct
GFIHGVF

SEQ ID NO: 5413 - protein, 7 aa, Artificial Sequence
  Synthetic construct
GFIHGVY

SEQ ID NO: 5414 - protein, 7 aa, Artificial Sequence
  Synthetic construct
GFIHAFF

SEQ ID NO: 5415 - protein, 7 aa, Artificial Sequence
  Synthetic construct
GFIHAFY

SEQ ID NO: 5416 - protein, 7 aa, Artificial Sequence
  Synthetic construct
GFIHARF

SEQ ID NO: 5417 - protein, 7 aa, Artificial Sequence
  Synthetic construct
GFIHARY

SEQ ID NO: 5418 - protein, 7 aa, Artificial Sequence
  Synthetic construct
GFIHACF

SEQ ID NO: 5419 - protein, 7 aa, Artificial Sequence
  Synthetic construct
GFIHACY

SEQ ID NO: 5420 - protein, 7 aa, Artificial Sequence
  Synthetic construct
GFIHALF

SEQ ID NO: 5421 - protein, 7 aa, Artificial Sequence
  Synthetic construct
GFIHALY

SEQ ID NO: 5422 - protein, 7 aa, Artificial Sequence
  Synthetic construct
GFIHAAF

SEQ ID NO: 5423 - protein, 7 aa, Artificial Sequence
  Synthetic construct
GFIHAAY

SEQ ID NO: 5424 - protein, 7 aa, Artificial Sequence
  Synthetic construct
GFIHAQF

SEQ ID NO: 5425 - protein, 7 aa, Artificial Sequence
  Synthetic construct
GFIHAQY

SEQ ID NO: 5426 - protein, 7 aa, Artificial Sequence
  Synthetic construct
GFIHADF

SEQ ID NO: 5427 - protein, 7 aa, Artificial Sequence
  Synthetic construct
GFIHADY

SEQ ID NO: 5428 - protein, 7 aa, Artificial Sequence
  Synthetic construct
GFIHAVF

SEQ ID NO: 5429 - protein, 7 aa, Artificial Sequence
  Synthetic construct
GFIHAVY

SEQ ID NO: 5430 - protein, 7 aa, Artificial Sequence
  Synthetic construct
GFIHQFF

SEQ ID NO: 5431 - protein, 7 aa, Artificial Sequence
  Synthetic construct
GFIHQFY

SEQ ID NO: 5432 - protein, 7 aa, Artificial Sequence
  Synthetic construct
GFIHQRF

SEQ ID NO: 5433 - protein, 7 aa, Artificial Sequence
  Synthetic construct
GFIHQRY

SEQ ID NO: 5434 - protein, 7 aa, Artificial Sequence
  Synthetic construct
GFIHQCF

SEQ ID NO: 5435 - protein, 7 aa, Artificial Sequence
  Synthetic construct
GFIHQCY

SEQ ID NO: 5436 - protein, 7 aa, Artificial Sequence
  Synthetic construct
GFIHQLF

SEQ ID NO: 5437 - protein, 7 aa, Artificial Sequence
  Synthetic construct
GFIHQLY

SEQ ID NO: 5438 - protein, 7 aa, Artificial Sequence
  Synthetic construct
GFIHQAF

SEQ ID NO: 5439 - protein, 7 aa, Artificial Sequence
  Synthetic construct
GFIHQAY

SEQ ID NO: 5440 - protein, 7 aa, Artificial Sequence
  Synthetic construct
GFIHQQF

SEQ ID NO: 5441 - protein, 7 aa, Artificial Sequence
  Synthetic construct
GFIHQQY

SEQ ID NO: 5442 - protein, 7 aa, Artificial Sequence
  Synthetic construct
GFIHQDF

SEQ ID NO: 5443 - protein, 7 aa, Artificial Sequence
  Synthetic construct
GFIHQDY

SEQ ID NO: 5444 - protein, 7 aa, Artificial Sequence
  Synthetic construct
GFIHQVF

SEQ ID NO: 5445 - protein, 7 aa, Artificial Sequence
  Synthetic construct
GFIHQVY

SEQ ID NO: 5446 - protein, 7 aa, Artificial Sequence
  Synthetic construct
GFILIFF

SEQ ID NO: 5447 - protein, 7 aa, Artificial Sequence
  Synthetic construct
GFILIFY

SEQ ID NO: 5448 - protein, 7 aa, Artificial Sequence
  Synthetic construct
GFILIRF

SEQ ID NO: 5449 - protein, 7 aa, Artificial Sequence
  Synthetic construct
GFILIRY

SEQ ID NO: 5450 - protein, 7 aa, Artificial Sequence
  Synthetic construct
GFILICF

SEQ ID NO: 5451 - protein, 7 aa, Artificial Sequence
  Synthetic construct
GFILICY

SEQ ID NO: 5452 - protein, 7 aa, Artificial Sequence
  Synthetic construct
GFILILF

SEQ ID NO: 5453 - protein, 7 aa, Artificial Sequence
  Synthetic construct
GFILILY

SEQ ID NO: 5454 - protein, 7 aa, Artificial Sequence
  Synthetic construct
GFILIAF

SEQ ID NO: 5455 - protein, 7 aa, Artificial Sequence
  Synthetic construct
GFILIAY

SEQ ID NO: 5456 - protein, 7 aa, Artificial Sequence
  Synthetic construct
GFILIQF

SEQ ID NO: 5457 - protein, 7 aa, Artificial Sequence
  Synthetic construct
GFILIQY

SEQ ID NO: 5458 - protein, 7 aa, Artificial Sequence
  Synthetic construct
GFILIDF

SEQ ID NO: 5459 - protein, 7 aa, Artificial Sequence
  Synthetic construct
GFILIDY

SEQ ID NO: 5460 - protein, 7 aa, Artificial Sequence
  Synthetic construct
GFILIVF

SEQ ID NO: 5461 - protein, 7 aa, Artificial Sequence
  Synthetic construct
GFILIVY

SEQ ID NO: 5462 - protein, 7 aa, Artificial Sequence
  Synthetic construct
GFILDFF

SEQ ID NO: 5463 - protein, 7 aa, Artificial Sequence
  Synthetic construct
GFILDFY

SEQ ID NO: 5464 - protein, 7 aa, Artificial Sequence
  Synthetic construct
GFILDRF

SEQ ID NO: 5465 - protein, 7 aa, Artificial Sequence
  Synthetic construct
GFILDRY

SEQ ID NO: 5466 - protein, 7 aa, Artificial Sequence
  Synthetic construct
GFILDCF

SEQ ID NO: 5467 - protein, 7 aa, Artificial Sequence
  Synthetic construct
GFILDCY

SEQ ID NO: 5468 - protein, 7 aa, Artificial Sequence
  Synthetic construct
GFILDLF

SEQ ID NO: 5469 - protein, 7 aa, Artificial Sequence
  Synthetic construct
GFILDLY

SEQ ID NO: 5470 - protein, 7 aa, Artificial Sequence
  Synthetic construct
GFILDAF

SEQ ID NO: 5471 - protein, 7 aa, Artificial Sequence
  Synthetic construct
GFILDAY

SEQ ID NO: 5472 - protein, 7 aa, Artificial Sequence
  Synthetic construct
GFILDQF

SEQ ID NO: 5473 - protein, 7 aa, Artificial Sequence
  Synthetic construct
GFILDQY

SEQ ID NO: 5474 - protein, 7 aa, Artificial Sequence
  Synthetic construct
GFILDDF

SEQ ID NO: 5475 - protein, 7 aa, Artificial Sequence
  Synthetic construct
GFILDDY

SEQ ID NO: 5476 - protein, 7 aa, Artificial Sequence
  Synthetic construct
GFILDVF

SEQ ID NO: 5477 - protein, 7 aa, Artificial Sequence
  Synthetic construct
GFILDVY

SEQ ID NO: 5478 - protein, 7 aa, Artificial Sequence
  Synthetic construct
GFILYFF

SEQ ID NO: 5479 - protein, 7 aa, Artificial Sequence
  Synthetic construct
GFILYFY

SEQ ID NO: 5480 - protein, 7 aa, Artificial Sequence
  Synthetic construct
GFILYRF

SEQ ID NO: 5481 - protein, 7 aa, Artificial Sequence
  Synthetic construct
GFILYRY

SEQ ID NO: 5482 - protein, 7 aa, Artificial Sequence
  Synthetic construct
GFILYCF

SEQ ID NO: 5483 - protein, 7 aa, Artificial Sequence
  Synthetic construct
GFILYCY

SEQ ID NO: 5484 - protein, 7 aa, Artificial Sequence
  Synthetic construct
GFILYLF

SEQ ID NO: 5485 - protein, 7 aa, Artificial Sequence
  Synthetic construct
GFILYLY

SEQ ID NO: 5486 - protein, 7 aa, Artificial Sequence
  Synthetic construct
GFILYAF

SEQ ID NO: 5487 - protein, 7 aa, Artificial Sequence
  Synthetic construct
GFILYAY

SEQ ID NO: 5488 - protein, 7 aa, Artificial Sequence
  Synthetic construct
GFILYQF

SEQ ID NO: 5489 - protein, 7 aa, Artificial Sequence
  Synthetic construct
GFILYQY

SEQ ID NO: 5490 - protein, 7 aa, Artificial Sequence
  Synthetic construct
GFILYDF

SEQ ID NO: 5491 - protein, 7 aa, Artificial Sequence
  Synthetic construct
GFILYDY

SEQ ID NO: 5492 - protein, 7 aa, Artificial Sequence
  Synthetic construct
GFILYVF

SEQ ID NO: 5493 - protein, 7 aa, Artificial Sequence
  Synthetic construct
GFILYVY

SEQ ID NO: 5494 - protein, 7 aa, Artificial Sequence
  Synthetic construct
GFILFFF

SEQ ID NO: 5495 - protein, 7 aa, Artificial Sequence
  Synthetic construct
GFILFFY

SEQ ID NO: 5496 - protein, 7 aa, Artificial Sequence
  Synthetic construct
GFILFRF

SEQ ID NO: 5497 - protein, 7 aa, Artificial Sequence
  Synthetic construct
GFILFRY

SEQ ID NO: 5498 - protein, 7 aa, Artificial Sequence
  Synthetic construct
GFILFCF

SEQ ID NO: 5499 - protein, 7 aa, Artificial Sequence
  Synthetic construct
GFILFCY

SEQ ID NO: 5500 - protein, 7 aa, Artificial Sequence
  Synthetic construct
GFILFLF

SEQ ID NO: 5501 - protein, 7 aa, Artificial Sequence
  Synthetic construct
GFILFLY

SEQ ID NO: 5502 - protein, 7 aa, Artificial Sequence
  Synthetic construct
GFILFAF

SEQ ID NO: 5503 - protein, 7 aa, Artificial Sequence
  Synthetic construct
GFILFAY

SEQ ID NO: 5504 - protein, 7 aa, Artificial Sequence
  Synthetic construct
GFILFQF

SEQ ID NO: 5505 - protein, 7 aa, Artificial Sequence
  Synthetic construct
GFILFQY

SEQ ID NO: 5506 - protein, 7 aa, Artificial Sequence
  Synthetic construct
GFILFDF

SEQ ID NO: 5507 - protein, 7 aa, Artificial Sequence
  Synthetic construct
GFILFDY

SEQ ID NO: 5508 - protein, 7 aa, Artificial Sequence
  Synthetic construct
GFILFVF

SEQ ID NO: 5509 - protein, 7 aa, Artificial Sequence
  Synthetic construct
GFILFVY

SEQ ID NO: 5510 - protein, 7 aa, Artificial Sequence
  Synthetic construct
GFILVFF

SEQ ID NO: 5511 - protein, 7 aa, Artificial Sequence
  Synthetic construct
GFILVFY

SEQ ID NO: 5512 - protein, 7 aa, Artificial Sequence
  Synthetic construct
GFILVRF

SEQ ID NO: 5513 - protein, 7 aa, Artificial Sequence
  Synthetic construct
GFILVRY

SEQ ID NO: 5514 - protein, 7 aa, Artificial Sequence
  Synthetic construct
GFILVCF

SEQ ID NO: 5515 - protein, 7 aa, Artificial Sequence
  Synthetic construct
GFILVCY

SEQ ID NO: 5516 - protein, 7 aa, Artificial Sequence
  Synthetic construct
GFILVLF

SEQ ID NO: 5517 - protein, 7 aa, Artificial Sequence
  Synthetic construct
GFILVLY

SEQ ID NO: 5518 - protein, 7 aa, Artificial Sequence
  Synthetic construct
GFILVAF

SEQ ID NO: 5519 - protein, 7 aa, Artificial Sequence
  Synthetic construct
GFILVAY

SEQ ID NO: 5520 - protein, 7 aa, Artificial Sequence
  Synthetic construct
GFILVQF

SEQ ID NO: 5521 - protein, 7 aa, Artificial Sequence
  Synthetic construct
GFILVQY

SEQ ID NO: 5522 - protein, 7 aa, Artificial Sequence
  Synthetic construct
GFILVDF

SEQ ID NO: 5523 - protein, 7 aa, Artificial Sequence
  Synthetic construct
GFILVDY

SEQ ID NO: 5524 - protein, 7 aa, Artificial Sequence
  Synthetic construct
GFILVVF

SEQ ID NO: 5525 - protein, 7 aa, Artificial Sequence
  Synthetic construct
GFILVVY

SEQ ID NO: 5526 - protein, 7 aa, Artificial Sequence
  Synthetic construct
GFILTFF

SEQ ID NO: 5527 - protein, 7 aa, Artificial Sequence
  Synthetic construct
GFILTFY

SEQ ID NO: 5528 - protein, 7 aa, Artificial Sequence
  Synthetic construct
GFILTRF

SEQ ID NO: 5529 - protein, 7 aa, Artificial Sequence
  Synthetic construct
GFILTRY

SEQ ID NO: 5530 - protein, 7 aa, Artificial Sequence
  Synthetic construct
GFILTCF

SEQ ID NO: 5531 - protein, 7 aa, Artificial Sequence
  Synthetic construct
GFILTCY

SEQ ID NO: 5532 - protein, 7 aa, Artificial Sequence
  Synthetic construct
GFILTLF

SEQ ID NO: 5533 - protein, 7 aa, Artificial Sequence
  Synthetic construct
GFILTLY

SEQ ID NO: 5534 - protein, 7 aa, Artificial Sequence
  Synthetic construct
GFILTAF

SEQ ID NO: 5535 - protein, 7 aa, Artificial Sequence
  Synthetic construct
GFILTAY

SEQ ID NO: 5536 - protein, 7 aa, Artificial Sequence
  Synthetic construct
GFILTQF

SEQ ID NO: 5537 - protein, 7 aa, Artificial Sequence
  Synthetic construct
GFILTQY

SEQ ID NO: 5538 - protein, 7 aa, Artificial Sequence
  Synthetic construct
GFILTDF

SEQ ID NO: 5539 - protein, 7 aa, Artificial Sequence
  Synthetic construct
GFILTDY

SEQ ID NO: 5540 - protein, 7 aa, Artificial Sequence
  Synthetic construct
GFILTVF

SEQ ID NO: 5541 - protein, 7 aa, Artificial Sequence
  Synthetic construct
GFILTVY

SEQ ID NO: 5542 - protein, 7 aa, Artificial Sequence
  Synthetic construct
GFILGFF

SEQ ID NO: 5543 - protein, 7 aa, Artificial Sequence
  Synthetic construct
GFILGFY

SEQ ID NO: 5544 - protein, 7 aa, Artificial Sequence
  Synthetic construct
GFILGRF

SEQ ID NO: 5545 - protein, 7 aa, Artificial Sequence
  Synthetic construct
GFILGRY

SEQ ID NO: 5546 - protein, 7 aa, Artificial Sequence
  Synthetic construct
GFILGCF

SEQ ID NO: 5547 - protein, 7 aa, Artificial Sequence
  Synthetic construct
GFILGCY

SEQ ID NO: 5548 - protein, 7 aa, Artificial Sequence
  Synthetic construct
GFILGLF

SEQ ID NO: 5549 - protein, 7 aa, Artificial Sequence
  Synthetic construct
GFILGLY

SEQ ID NO: 5550 - protein, 7 aa, Artificial Sequence
  Synthetic construct
GFILGAF

SEQ ID NO: 5551 - protein, 7 aa, Artificial Sequence
  Synthetic construct
GFILGAY

SEQ ID NO: 5552 - protein, 7 aa, Artificial Sequence
  Synthetic construct
GFILGQF

SEQ ID NO: 5553 - protein, 7 aa, Artificial Sequence
  Synthetic construct
GFILGQY

SEQ ID NO: 5554 - protein, 7 aa, Artificial Sequence
  Synthetic construct
GFILGDF

SEQ ID NO: 5555 - protein, 7 aa, Artificial Sequence
  Synthetic construct
GFILGDY

SEQ ID NO: 5556 - protein, 7 aa, Artificial Sequence
  Synthetic construct
GFILGVF

SEQ ID NO: 5557 - protein, 7 aa, Artificial Sequence
  Synthetic construct
GFILGVY

SEQ ID NO: 5558 - protein, 7 aa, Artificial Sequence
  Synthetic construct
GFILAFF

SEQ ID NO: 5559 - protein, 7 aa, Artificial Sequence
  Synthetic construct
GFILAFY

SEQ ID NO: 5560 - protein, 7 aa, Artificial Sequence
  Synthetic construct
GFILARF

SEQ ID NO: 5561 - protein, 7 aa, Artificial Sequence
  Synthetic construct
GFILARY

SEQ ID NO: 5562 - protein, 7 aa, Artificial Sequence
  Synthetic construct
GFILACF

SEQ ID NO: 5563 - protein, 7 aa, Artificial Sequence
  Synthetic construct
GFILACY

SEQ ID NO: 5564 - protein, 7 aa, Artificial Sequence
  Synthetic construct
GFILALF

SEQ ID NO: 5565 - protein, 7 aa, Artificial Sequence
  Synthetic construct
GFILALY

SEQ ID NO: 5566 - protein, 7 aa, Artificial Sequence
  Synthetic construct
GFILAAF

SEQ ID NO: 5567 - protein, 7 aa, Artificial Sequence
  Synthetic construct
GFILAAY

SEQ ID NO: 5568 - protein, 7 aa, Artificial Sequence
  Synthetic construct
GFILAQF

SEQ ID NO: 5569 - protein, 7 aa, Artificial Sequence
  Synthetic construct
GFILAQY

SEQ ID NO: 5570 - protein, 7 aa, Artificial Sequence
  Synthetic construct
GFILADF

SEQ ID NO: 5571 - protein, 7 aa, Artificial Sequence
  Synthetic construct
GFILADY

SEQ ID NO: 5572 - protein, 7 aa, Artificial Sequence
  Synthetic construct
GFILAVF

SEQ ID NO: 5573 - protein, 7 aa, Artificial Sequence
  Synthetic construct
GFILAVY

SEQ ID NO: 5574 - protein, 7 aa, Artificial Sequence
  Synthetic construct
GFILQFF

SEQ ID NO: 5575 - protein, 7 aa, Artificial Sequence
  Synthetic construct
GFILQFY

SEQ ID NO: 5576 - protein, 7 aa, Artificial Sequence
  Synthetic construct
GFILQRF

SEQ ID NO: 5577 - protein, 7 aa, Artificial Sequence
  Synthetic construct
GFILQRY

SEQ ID NO: 5578 - protein, 7 aa, Artificial Sequence
  Synthetic construct
GFILQCF

SEQ ID NO: 5579 - protein, 7 aa, Artificial Sequence
  Synthetic construct
GFILQCY

SEQ ID NO: 5580 - protein, 7 aa, Artificial Sequence
  Synthetic construct
GFILQLF

SEQ ID NO: 5581 - protein, 7 aa, Artificial Sequence
  Synthetic construct
GFILQLY

SEQ ID NO: 5582 - protein, 7 aa, Artificial Sequence
  Synthetic construct
GFILQAF

SEQ ID NO: 5583 - protein, 7 aa, Artificial Sequence
  Synthetic construct
GFILQAY

SEQ ID NO: 5584 - protein, 7 aa, Artificial Sequence
  Synthetic construct
GFILQQF

SEQ ID NO: 5585 - protein, 7 aa, Artificial Sequence
  Synthetic construct
GFILQQY

SEQ ID NO: 5586 - protein, 7 aa, Artificial Sequence
  Synthetic construct
GFILQDF

SEQ ID NO: 5587 - protein, 7 aa, Artificial Sequence
  Synthetic construct
GFILQDY

SEQ ID NO: 5588 - protein, 7 aa, Artificial Sequence
  Synthetic construct
GFILQVF

SEQ ID NO: 5589 - protein, 7 aa, Artificial Sequence
  Synthetic construct
GFILQVY

SEQ ID NO: 5590 - protein, 7 aa, Artificial Sequence
  Synthetic construct
GFIFIFF

SEQ ID NO: 5591 - protein, 7 aa, Artificial Sequence
  Synthetic construct
GFIFIFY

SEQ ID NO: 5592 - protein, 7 aa, Artificial Sequence
  Synthetic construct
GFIFIRF

SEQ ID NO: 5593 - protein, 7 aa, Artificial Sequence
  Synthetic construct
GFIFIRY

SEQ ID NO: 5594 - protein, 7 aa, Artificial Sequence
  Synthetic construct
GFIFICF

SEQ ID NO: 5595 - protein, 7 aa, Artificial Sequence
  Synthetic construct
GFIFICY

SEQ ID NO: 5596 - protein, 7 aa, Artificial Sequence
  Synthetic construct
GFIFILF

SEQ ID NO: 5597 - protein, 7 aa, Artificial Sequence
  Synthetic construct
GFIFILY

SEQ ID NO: 5598 - protein, 7 aa, Artificial Sequence
  Synthetic construct
GFIFIAF

SEQ ID NO: 5599 - protein, 7 aa, Artificial Sequence
  Synthetic construct
GFIFIAY

SEQ ID NO: 5600 - protein, 7 aa, Artificial Sequence
  Synthetic construct
GFIFIQF

SEQ ID NO: 5601 - protein, 7 aa, Artificial Sequence
  Synthetic construct
GFIFIQY

SEQ ID NO: 5602 - protein, 7 aa, Artificial Sequence
  Synthetic construct
GFIFIDF

SEQ ID NO: 5603 - protein, 7 aa, Artificial Sequence
  Synthetic construct
GFIFIDY

SEQ ID NO: 5604 - protein, 7 aa, Artificial Sequence
  Synthetic construct
GFIFIVF

SEQ ID NO: 5605 - protein, 7 aa, Artificial Sequence
  Synthetic construct
GFIFIVY

SEQ ID NO: 5606 - protein, 7 aa, Artificial Sequence
  Synthetic construct
GFIFDFF

SEQ ID NO: 5607 - protein, 7 aa, Artificial Sequence
  Synthetic construct
GFIFDFY

SEQ ID NO: 5608 - protein, 7 aa, Artificial Sequence
  Synthetic construct
GFIFDRF

SEQ ID NO: 5609 - protein, 7 aa, Artificial Sequence
  Synthetic construct
GFIFDRY

SEQ ID NO: 5610 - protein, 7 aa, Artificial Sequence
  Synthetic construct
GFIFDCF

SEQ ID NO: 5611 - protein, 7 aa, Artificial Sequence
  Synthetic construct
GFIFDCY

SEQ ID NO: 5612 - protein, 7 aa, Artificial Sequence
  Synthetic construct
GFIFDLF

SEQ ID NO: 5613 - protein, 7 aa, Artificial Sequence
  Synthetic construct
GFIFDLY

SEQ ID NO: 5614 - protein, 7 aa, Artificial Sequence
  Synthetic construct
GFIFDAF

SEQ ID NO: 5615 - protein, 7 aa, Artificial Sequence
  Synthetic construct
GFIFDAY

SEQ ID NO: 5616 - protein, 7 aa, Artificial Sequence
  Synthetic construct
GFIFDQF

SEQ ID NO: 5617 - protein, 7 aa, Artificial Sequence
  Synthetic construct
GFIFDQY

SEQ ID NO: 5618 - protein, 7 aa, Artificial Sequence
  Synthetic construct
GFIFDDF

SEQ ID NO: 5619 - protein, 7 aa, Artificial Sequence
  Synthetic construct
GFIFDDY

SEQ ID NO: 5620 - protein, 7 aa, Artificial Sequence
  Synthetic construct
GFIFDVF

SEQ ID NO: 5621 - protein, 7 aa, Artificial Sequence
  Synthetic construct
GFIFDVY

SEQ ID NO: 5622 - protein, 7 aa, Artificial Sequence
  Synthetic construct
GFIFYFF

SEQ ID NO: 5623 - protein, 7 aa, Artificial Sequence
  Synthetic construct
GFIFYFY

SEQ ID NO: 5624 - protein, 7 aa, Artificial Sequence
  Synthetic construct
GFIFYRF

SEQ ID NO: 5625 - protein, 7 aa, Artificial Sequence
  Synthetic construct
GFIFYRY

SEQ ID NO: 5626 - protein, 7 aa, Artificial Sequence
  Synthetic construct
GFIFYCF

SEQ ID NO: 5627 - protein, 7 aa, Artificial Sequence
  Synthetic construct
GFIFYCY

SEQ ID NO: 5628 - protein, 7 aa, Artificial Sequence
  Synthetic construct
GFIFYLF

SEQ ID NO: 5629 - protein, 7 aa, Artificial Sequence
  Synthetic construct
GFIFYLY

SEQ ID NO: 5630 - protein, 7 aa, Artificial Sequence
  Synthetic construct
GFIFYAF

SEQ ID NO: 5631 - protein, 7 aa, Artificial Sequence
  Synthetic construct
GFIFYAY

SEQ ID NO: 5632 - protein, 7 aa, Artificial Sequence
  Synthetic construct
GFIFYQF

SEQ ID NO: 5633 - protein, 7 aa, Artificial Sequence
  Synthetic construct
GFIFYQY

SEQ ID NO: 5634 - protein, 7 aa, Artificial Sequence
  Synthetic construct
GFIFYDF

SEQ ID NO: 5635 - protein, 7 aa, Artificial Sequence
  Synthetic construct
GFIFYDY

SEQ ID NO: 5636 - protein, 7 aa, Artificial Sequence
  Synthetic construct
GFIFYVF

SEQ ID NO: 5637 - protein, 7 aa, Artificial Sequence
  Synthetic construct
GFIFYVY

SEQ ID NO: 5638 - protein, 7 aa, Artificial Sequence
  Synthetic construct
GFIFFFF

SEQ ID NO: 5639 - protein, 7 aa, Artificial Sequence
  Synthetic construct
GFIFFFY

SEQ ID NO: 5640 - protein, 7 aa, Artificial Sequence
  Synthetic construct
GFIFFRF

SEQ ID NO: 5641 - protein, 7 aa, Artificial Sequence
  Synthetic construct
GFIFFRY

SEQ ID NO: 5642 - protein, 7 aa, Artificial Sequence
  Synthetic construct
GFIFFCF

SEQ ID NO: 5643 - protein, 7 aa, Artificial Sequence
  Synthetic construct
GFIFFCY

SEQ ID NO: 5644 - protein, 7 aa, Artificial Sequence
  Synthetic construct
GFIFFLF

SEQ ID NO: 5645 - protein, 7 aa, Artificial Sequence
  Synthetic construct
GFIFFLY

SEQ ID NO: 5646 - protein, 7 aa, Artificial Sequence
  Synthetic construct
GFIFFAF

SEQ ID NO: 5647 - protein, 7 aa, Artificial Sequence
  Synthetic construct
GFIFFAY

SEQ ID NO: 5648 - protein, 7 aa, Artificial Sequence
  Synthetic construct
GFIFFQF

SEQ ID NO: 5649 - protein, 7 aa, Artificial Sequence
  Synthetic construct
GFIFFQY

SEQ ID NO: 5650 - protein, 7 aa, Artificial Sequence
  Synthetic construct
GFIFFDF

SEQ ID NO: 5651 - protein, 7 aa, Artificial Sequence
  Synthetic construct
GFIFFDY

SEQ ID NO: 5652 - protein, 7 aa, Artificial Sequence
  Synthetic construct
GFIFFVF

SEQ ID NO: 5653 - protein, 7 aa, Artificial Sequence
  Synthetic construct
GFIFFVY

SEQ ID NO: 5654 - protein, 7 aa, Artificial Sequence
  Synthetic construct
GFIFVFF

SEQ ID NO: 5655 - protein, 7 aa, Artificial Sequence
  Synthetic construct
GFIFVFY

SEQ ID NO: 5656 - protein, 7 aa, Artificial Sequence
  Synthetic construct
GFIFVRF

SEQ ID NO: 5657 - protein, 7 aa, Artificial Sequence
  Synthetic construct
GFIFVRY

SEQ ID NO: 5658 - protein, 7 aa, Artificial Sequence
  Synthetic construct
GFIFVCF

SEQ ID NO: 5659 - protein, 7 aa, Artificial Sequence
  Synthetic construct
GFIFVCY

SEQ ID NO: 5660 - protein, 7 aa, Artificial Sequence
  Synthetic construct
GFIFVLF

SEQ ID NO: 5661 - protein, 7 aa, Artificial Sequence
  Synthetic construct
GFIFVLY

SEQ ID NO: 5662 - protein, 7 aa, Artificial Sequence
  Synthetic construct
GFIFVAF

SEQ ID NO: 5663 - protein, 7 aa, Artificial Sequence
  Synthetic construct
GFIFVAY

SEQ ID NO: 5664 - protein, 7 aa, Artificial Sequence
  Synthetic construct
GFIFVQF

SEQ ID NO: 5665 - protein, 7 aa, Artificial Sequence
  Synthetic construct
GFIFVQY

SEQ ID NO: 5666 - protein, 7 aa, Artificial Sequence
  Synthetic construct
GFIFVDF

SEQ ID NO: 5667 - protein, 7 aa, Artificial Sequence
  Synthetic construct
GFIFVDY

SEQ ID NO: 5668 - protein, 7 aa, Artificial Sequence
  Synthetic construct
GFIFVVF

SEQ ID NO: 5669 - protein, 7 aa, Artificial Sequence
  Synthetic construct
GFIFVVY

SEQ ID NO: 5670 - protein, 7 aa, Artificial Sequence
  Synthetic construct
GFIFTFF

SEQ ID NO: 5671 - protein, 7 aa, Artificial Sequence
  Synthetic construct
GFIFTFY

SEQ ID NO: 5672 - protein, 7 aa, Artificial Sequence
  Synthetic construct
GFIFTRF

SEQ ID NO: 5673 - protein, 7 aa, Artificial Sequence
  Synthetic construct
GFIFTRY

SEQ ID NO: 5674 - protein, 7 aa, Artificial Sequence
  Synthetic construct
GFIFTCF

SEQ ID NO: 5675 - protein, 7 aa, Artificial Sequence
  Synthetic construct
GFIFTCY

SEQ ID NO: 5676 - protein, 7 aa, Artificial Sequence
  Synthetic construct
GFIFTLF

SEQ ID NO: 5677 - protein, 7 aa, Artificial Sequence
  Synthetic construct
GFIFTLY

SEQ ID NO: 5678 - protein, 7 aa, Artificial Sequence
  Synthetic construct
GFIFTAF

SEQ ID NO: 5679 - protein, 7 aa, Artificial Sequence
  Synthetic construct
GFIFTAY

SEQ ID NO: 5680 - protein, 7 aa, Artificial Sequence
  Synthetic construct
GFIFTQF

SEQ ID NO: 5681 - protein, 7 aa, Artificial Sequence
  Synthetic construct
GFIFTQY

SEQ ID NO: 5682 - protein, 7 aa, Artificial Sequence
  Synthetic construct
GFIFTDF

SEQ ID NO: 5683 - protein, 7 aa, Artificial Sequence
  Synthetic construct
GFIFTDY

SEQ ID NO: 5684 - protein, 7 aa, Artificial Sequence
  Synthetic construct
GFIFTVF

SEQ ID NO: 5685 - protein, 7 aa, Artificial Sequence
  Synthetic construct
GFIFTVY

SEQ ID NO: 5686 - protein, 7 aa, Artificial Sequence
  Synthetic construct
GFIFGFF

SEQ ID NO: 5687 - protein, 7 aa, Artificial Sequence
  Synthetic construct
GFIFGFY

SEQ ID NO: 5688 - protein, 7 aa, Artificial Sequence
  Synthetic construct
GFIFGRF

SEQ ID NO: 5689 - protein, 7 aa, Artificial Sequence
  Synthetic construct
GFIFGRY

SEQ ID NO: 5690 - protein, 7 aa, Artificial Sequence
  Synthetic construct
GFIFGCF

SEQ ID NO: 5691 - protein, 7 aa, Artificial Sequence
  Synthetic construct
GFIFGCY

SEQ ID NO: 5692 - protein, 7 aa, Artificial Sequence
  Synthetic construct
GFIFGLF

SEQ ID NO: 5693 - protein, 7 aa, Artificial Sequence
  Synthetic construct
GFIFGLY

SEQ ID NO: 5694 - protein, 7 aa, Artificial Sequence
  Synthetic construct
GFIFGAF

SEQ ID NO: 5695 - protein, 7 aa, Artificial Sequence
  Synthetic construct
GFIFGAY

SEQ ID NO: 5696 - protein, 7 aa, Artificial Sequence
  Synthetic construct
GFIFGQF

SEQ ID NO: 5697 - protein, 7 aa, Artificial Sequence
  Synthetic construct
GFIFGQY

SEQ ID NO: 5698 - protein, 7 aa, Artificial Sequence
  Synthetic construct
GFIFGDF

SEQ ID NO: 5699 - protein, 7 aa, Artificial Sequence
  Synthetic construct
GFIFGDY

SEQ ID NO: 5700 - protein, 7 aa, Artificial Sequence
  Synthetic construct
GFIFGVF

SEQ ID NO: 5701 - protein, 7 aa, Artificial Sequence
  Synthetic construct
GFIFGVY

SEQ ID NO: 5702 - protein, 7 aa, Artificial Sequence
  Synthetic construct
GFIFAFF

SEQ ID NO: 5703 - protein, 7 aa, Artificial Sequence
  Synthetic construct
GFIFAFY

SEQ ID NO: 5704 - protein, 7 aa, Artificial Sequence
  Synthetic construct
GFIFARF

SEQ ID NO: 5705 - protein, 7 aa, Artificial Sequence
  Synthetic construct
GFIFARY

SEQ ID NO: 5706 - protein, 7 aa, Artificial Sequence
  Synthetic construct
GFIFACF

SEQ ID NO: 5707 - protein, 7 aa, Artificial Sequence
  Synthetic construct
GFIFACY

SEQ ID NO: 5708 - protein, 7 aa, Artificial Sequence
  Synthetic construct
GFIFALF

SEQ ID NO: 5709 - protein, 7 aa, Artificial Sequence
  Synthetic construct
GFIFALY

SEQ ID NO: 5710 - protein, 7 aa, Artificial Sequence
  Synthetic construct
GFIFAAF

SEQ ID NO: 5711 - protein, 7 aa, Artificial Sequence
  Synthetic construct
GFIFAAY

SEQ ID NO: 5712 - protein, 7 aa, Artificial Sequence
  Synthetic construct
GFIFAQF

SEQ ID NO: 5713 - protein, 7 aa, Artificial Sequence
  Synthetic construct
GFIFAQY

SEQ ID NO: 5714 - protein, 7 aa, Artificial Sequence
  Synthetic construct
GFIFADF

SEQ ID NO: 5715 - protein, 7 aa, Artificial Sequence
  Synthetic construct
GFIFADY

SEQ ID NO: 5716 - protein, 7 aa, Artificial Sequence
  Synthetic construct
GFIFAVF

SEQ ID NO: 5717 - protein, 7 aa, Artificial Sequence
  Synthetic construct
GFIFAVY

SEQ ID NO: 5718 - protein, 7 aa, Artificial Sequence
  Synthetic construct
GFIFQFF

SEQ ID NO: 5719 - protein, 7 aa, Artificial Sequence
  Synthetic construct
GFIFQFY

SEQ ID NO: 5720 - protein, 7 aa, Artificial Sequence
  Synthetic construct
GFIFQRF

SEQ ID NO: 5721 - protein, 7 aa, Artificial Sequence
  Synthetic construct
GFIFQRY

SEQ ID NO: 5722 - protein, 7 aa, Artificial Sequence
  Synthetic construct
GFIFQCF

SEQ ID NO: 5723 - protein, 7 aa, Artificial Sequence
  Synthetic construct
GFIFQCY

SEQ ID NO: 5724 - protein, 7 aa, Artificial Sequence
  Synthetic construct
GFIFQLF

SEQ ID NO: 5725 - protein, 7 aa, Artificial Sequence
  Synthetic construct
GFIFQLY

SEQ ID NO: 5726 - protein, 7 aa, Artificial Sequence
  Synthetic construct
GFIFQAF

SEQ ID NO: 5727 - protein, 7 aa, Artificial Sequence
  Synthetic construct
GFIFQAY

SEQ ID NO: 5728 - protein, 7 aa, Artificial Sequence
  Synthetic construct
GFIFQQF

SEQ ID NO: 5729 - protein, 7 aa, Artificial Sequence
  Synthetic construct
GFIFQQY

SEQ ID NO: 5730 - protein, 7 aa, Artificial Sequence
  Synthetic construct
GFIFQDF

SEQ ID NO: 5731 - protein, 7 aa, Artificial Sequence
  Synthetic construct
GFIFQDY

SEQ ID NO: 5732 - protein, 7 aa, Artificial Sequence
  Synthetic construct
GFIFQVF

SEQ ID NO: 5733 - protein, 7 aa, Artificial Sequence
  Synthetic construct
GFIFQVY

SEQ ID NO: 5734 - protein, 7 aa, Artificial Sequence
  Synthetic construct
GFGYIFF

SEQ ID NO: 5735 - protein, 7 aa, Artificial Sequence
  Synthetic construct
GFGYIFY

SEQ ID NO: 5736 - protein, 7 aa, Artificial Sequence
  Synthetic construct
GFGYIRF

SEQ ID NO: 5737 - protein, 7 aa, Artificial Sequence
  Synthetic construct
GFGYIRY

SEQ ID NO: 5738 - protein, 7 aa, Artificial Sequence
  Synthetic construct
GFGYICF

SEQ ID NO: 5739 - protein, 7 aa, Artificial Sequence
  Synthetic construct
GFGYICY

SEQ ID NO: 5740 - protein, 7 aa, Artificial Sequence
  Synthetic construct
GFGYILF

SEQ ID NO: 5741 - protein, 7 aa, Artificial Sequence
  Synthetic construct
GFGYILY

SEQ ID NO: 5742 - protein, 7 aa, Artificial Sequence
  Synthetic construct
GFGYIAF

SEQ ID NO: 5743 - protein, 7 aa, Artificial Sequence
  Synthetic construct
GFGYIAY

SEQ ID NO: 5744 - protein, 7 aa, Artificial Sequence
  Synthetic construct
GFGYIQF

SEQ ID NO: 5745 - protein, 7 aa, Artificial Sequence
  Synthetic construct
GFGYIQY

SEQ ID NO: 5746 - protein, 7 aa, Artificial Sequence
  Synthetic construct
GFGYIDF

SEQ ID NO: 5747 - protein, 7 aa, Artificial Sequence
  Synthetic construct
GFGYIDY

SEQ ID NO: 5748 - protein, 7 aa, Artificial Sequence
  Synthetic construct
GFGYIVF

SEQ ID NO: 5749 - protein, 7 aa, Artificial Sequence
  Synthetic construct
GFGYIVY

SEQ ID NO: 5750 - protein, 7 aa, Artificial Sequence
  Synthetic construct
GFGYDFF

SEQ ID NO: 5751 - protein, 7 aa, Artificial Sequence
  Synthetic construct
GFGYDFY

SEQ ID NO: 5752 - protein, 7 aa, Artificial Sequence
  Synthetic construct
GFGYDRF

SEQ ID NO: 5753 - protein, 7 aa, Artificial Sequence
  Synthetic construct
GFGYDRY

SEQ ID NO: 5754 - protein, 7 aa, Artificial Sequence
  Synthetic construct
GFGYDCF

SEQ ID NO: 5755 - protein, 7 aa, Artificial Sequence
  Synthetic construct
GFGYDCY

SEQ ID NO: 5756 - protein, 7 aa, Artificial Sequence
  Synthetic construct
GFGYDLF

SEQ ID NO: 5757 - protein, 7 aa, Artificial Sequence
  Synthetic construct
GFGYDLY

SEQ ID NO: 5758 - protein, 7 aa, Artificial Sequence
  Synthetic construct
GFGYDAF

SEQ ID NO: 5759 - protein, 7 aa, Artificial Sequence
  Synthetic construct
GFGYDAY

SEQ ID NO: 5760 - protein, 7 aa, Artificial Sequence
  Synthetic construct
GFGYDQF

SEQ ID NO: 5761 - protein, 7 aa, Artificial Sequence
  Synthetic construct
GFGYDQY

SEQ ID NO: 5762 - protein, 7 aa, Artificial Sequence
  Synthetic construct
GFGYDDF

SEQ ID NO: 5763 - protein, 7 aa, Artificial Sequence
  Synthetic construct
GFGYDDY

SEQ ID NO: 5764 - protein, 7 aa, Artificial Sequence
  Synthetic construct
GFGYDVF

SEQ ID NO: 5765 - protein, 7 aa, Artificial Sequence
  Synthetic construct
GFGYDVY

SEQ ID NO: 5766 - protein, 7 aa, Artificial Sequence
  Synthetic construct
GFGYYFF

SEQ ID NO: 5767 - protein, 7 aa, Artificial Sequence
  Synthetic construct
GFGYYFY

SEQ ID NO: 5768 - protein, 7 aa, Artificial Sequence
  Synthetic construct
GFGYYRF

SEQ ID NO: 5769 - protein, 7 aa, Artificial Sequence
  Synthetic construct
GFGYYRY

SEQ ID NO: 5770 - protein, 7 aa, Artificial Sequence
  Synthetic construct
GFGYYCF

SEQ ID NO: 5771 - protein, 7 aa, Artificial Sequence
  Synthetic construct
GFGYYCY

SEQ ID NO: 5772 - protein, 7 aa, Artificial Sequence
  Synthetic construct
GFGYYLF

SEQ ID NO: 5773 - protein, 7 aa, Artificial Sequence
  Synthetic construct
GFGYYLY

SEQ ID NO: 5774 - protein, 7 aa, Artificial Sequence
  Synthetic construct
GFGYYAF

SEQ ID NO: 5775 - protein, 7 aa, Artificial Sequence
  Synthetic construct
GFGYYAY

SEQ ID NO: 5776 - protein, 7 aa, Artificial Sequence
  Synthetic construct
GFGYYQF

SEQ ID NO: 5777 - protein, 7 aa, Artificial Sequence
  Synthetic construct
GFGYYQY

SEQ ID NO: 5778 - protein, 7 aa, Artificial Sequence
  Synthetic construct
GFGYYDF

SEQ ID NO: 5779 - protein, 7 aa, Artificial Sequence
  Synthetic construct
GFGYYDY

SEQ ID NO: 5780 - protein, 7 aa, Artificial Sequence
  Synthetic construct
GFGYYVF

SEQ ID NO: 5781 - protein, 7 aa, Artificial Sequence
  Synthetic construct
GFGYYVY

SEQ ID NO: 5782 - protein, 7 aa, Artificial Sequence
  Synthetic construct
GFGYFFF

SEQ ID NO: 5783 - protein, 7 aa, Artificial Sequence
  Synthetic construct
GFGYFFY

SEQ ID NO: 5784 - protein, 7 aa, Artificial Sequence
  Synthetic construct
GFGYFRF

SEQ ID NO: 5785 - protein, 7 aa, Artificial Sequence
  Synthetic construct
GFGYFRY

SEQ ID NO: 5786 - protein, 7 aa, Artificial Sequence
  Synthetic construct
GFGYFCF

SEQ ID NO: 5787 - protein, 7 aa, Artificial Sequence
  Synthetic construct
GFGYFCY

SEQ ID NO: 5788 - protein, 7 aa, Artificial Sequence
  Synthetic construct
GFGYFLF

SEQ ID NO: 5789 - protein, 7 aa, Artificial Sequence
  Synthetic construct
GFGYFLY

SEQ ID NO: 5790 - protein, 7 aa, Artificial Sequence
  Synthetic construct
GFGYFAF

SEQ ID NO: 5791 - protein, 7 aa, Artificial Sequence
  Synthetic construct
GFGYFAY

SEQ ID NO: 5792 - protein, 7 aa, Artificial Sequence
  Synthetic construct
GFGYFQF

SEQ ID NO: 5793 - protein, 7 aa, Artificial Sequence
  Synthetic construct
GFGYFQY

SEQ ID NO: 5794 - protein, 7 aa, Artificial Sequence
  Synthetic construct
GFGYFDF

SEQ ID NO: 5795 - protein, 7 aa, Artificial Sequence
  Synthetic construct
GFGYFDY

SEQ ID NO: 5796 - protein, 7 aa, Artificial Sequence
  Synthetic construct
GFGYFVF

SEQ ID NO: 5797 - protein, 7 aa, Artificial Sequence
  Synthetic construct
GFGYFVY

SEQ ID NO: 5798 - protein, 7 aa, Artificial Sequence
  Synthetic construct
GFGYVFF

SEQ ID NO: 5799 - protein, 7 aa, Artificial Sequence
  Synthetic construct
GFGYVFY

SEQ ID NO: 5800 - protein, 7 aa, Artificial Sequence
  Synthetic construct
GFGYVRF

SEQ ID NO: 5801 - protein, 7 aa, Artificial Sequence
  Synthetic construct
GFGYVRY

SEQ ID NO: 5802 - protein, 7 aa, Artificial Sequence
  Synthetic construct
GFGYVCF

SEQ ID NO: 5803 - protein, 7 aa, Artificial Sequence
  Synthetic construct
GFGYVCY

SEQ ID NO: 5804 - protein, 7 aa, Artificial Sequence
  Synthetic construct
GFGYVLF

SEQ ID NO: 5805 - protein, 7 aa, Artificial Sequence
  Synthetic construct
GFGYVLY

SEQ ID NO: 5806 - protein, 7 aa, Artificial Sequence
  Synthetic construct
GFGYVAF

SEQ ID NO: 5807 - protein, 7 aa, Artificial Sequence
  Synthetic construct
GFGYVAY

SEQ ID NO: 5808 - protein, 7 aa, Artificial Sequence
  Synthetic construct
GFGYVQF

SEQ ID NO: 5809 - protein, 7 aa, Artificial Sequence
  Synthetic construct
GFGYVQY

SEQ ID NO: 5810 - protein, 7 aa, Artificial Sequence
  Synthetic construct
GFGYVDF

SEQ ID NO: 5811 - protein, 7 aa, Artificial Sequence
  Synthetic construct
GFGYVDY

SEQ ID NO: 5812 - protein, 7 aa, Artificial Sequence
  Synthetic construct
GFGYVVF

SEQ ID NO: 5813 - protein, 7 aa, Artificial Sequence
  Synthetic construct
GFGYVVY

SEQ ID NO: 5814 - protein, 7 aa, Artificial Sequence
  Synthetic construct
GFGYTFF

SEQ ID NO: 5815 - protein, 7 aa, Artificial Sequence
  Synthetic construct
GFGYTFY

SEQ ID NO: 5816 - protein, 7 aa, Artificial Sequence
  Synthetic construct
GFGYTRF

SEQ ID NO: 5817 - protein, 7 aa, Artificial Sequence
  Synthetic construct
GFGYTRY

SEQ ID NO: 5818 - protein, 7 aa, Artificial Sequence
  Synthetic construct
GFGYTCF

SEQ ID NO: 5819 - protein, 7 aa, Artificial Sequence
  Synthetic construct
GFGYTCY

SEQ ID NO: 5820 - protein, 7 aa, Artificial Sequence
  Synthetic construct
GFGYTLF

SEQ ID NO: 5821 - protein, 7 aa, Artificial Sequence
  Synthetic construct
GFGYTLY

SEQ ID NO: 5822 - protein, 7 aa, Artificial Sequence
  Synthetic construct
GFGYTAF

SEQ ID NO: 5823 - protein, 7 aa, Artificial Sequence
  Synthetic construct
GFGYTAY

SEQ ID NO: 5824 - protein, 7 aa, Artificial Sequence
  Synthetic construct
GFGYTQF

SEQ ID NO: 5825 - protein, 7 aa, Artificial Sequence
  Synthetic construct
GFGYTQY

SEQ ID NO: 5826 - protein, 7 aa, Artificial Sequence
  Synthetic construct
GFGYTDF

SEQ ID NO: 5827 - protein, 7 aa, Artificial Sequence
  Synthetic construct
GFGYTDY

SEQ ID NO: 5828 - protein, 7 aa, Artificial Sequence
  Synthetic construct
GFGYTVF

SEQ ID NO: 5829 - protein, 7 aa, Artificial Sequence
  Synthetic construct
GFGYTVY

SEQ ID NO: 5830 - protein, 7 aa, Artificial Sequence
  Synthetic construct
GFGYGFF

SEQ ID NO: 5831 - protein, 7 aa, Artificial Sequence
  Synthetic construct
GFGYGFY

SEQ ID NO: 5832 - protein, 7 aa, Artificial Sequence
  Synthetic construct
GFGYGRF

SEQ ID NO: 5833 - protein, 7 aa, Artificial Sequence
  Synthetic construct
GFGYGRY

SEQ ID NO: 5834 - protein, 7 aa, Artificial Sequence
  Synthetic construct
GFGYGCF

SEQ ID NO: 5835 - protein, 7 aa, Artificial Sequence
  Synthetic construct
GFGYGCY

SEQ ID NO: 5836 - protein, 7 aa, Artificial Sequence
  Synthetic construct
GFGYGLF

SEQ ID NO: 5837 - protein, 7 aa, Artificial Sequence
  Synthetic construct
GFGYGLY

SEQ ID NO: 5838 - protein, 7 aa, Artificial Sequence
  Synthetic construct
GFGYGAF

SEQ ID NO: 5839 - protein, 7 aa, Artificial Sequence
  Synthetic construct
GFGYGAY

SEQ ID NO: 5840 - protein, 7 aa, Artificial Sequence
  Synthetic construct
GFGYGQF

SEQ ID NO: 5841 - protein, 7 aa, Artificial Sequence
  Synthetic construct
GFGYGQY

SEQ ID NO: 5842 - protein, 7 aa, Artificial Sequence
  Synthetic construct
GFGYGDF

SEQ ID NO: 5843 - protein, 7 aa, Artificial Sequence
  Synthetic construct
GFGYGDY

SEQ ID NO: 5844 - protein, 7 aa, Artificial Sequence
  Synthetic construct
GFGYGVF

SEQ ID NO: 5845 - protein, 7 aa, Artificial Sequence
  Synthetic construct
GFGYGVY

SEQ ID NO: 5846 - protein, 7 aa, Artificial Sequence
  Synthetic construct
GFGYAFF

SEQ ID NO: 5847 - protein, 7 aa, Artificial Sequence
  Synthetic construct
GFGYAFY

SEQ ID NO: 5848 - protein, 7 aa, Artificial Sequence
  Synthetic construct
GFGYARF

SEQ ID NO: 5849 - protein, 7 aa, Artificial Sequence
  Synthetic construct
GFGYARY

SEQ ID NO: 5850 - protein, 7 aa, Artificial Sequence
  Synthetic construct
GFGYACF

SEQ ID NO: 5851 - protein, 7 aa, Artificial Sequence
  Synthetic construct
GFGYACY

SEQ ID NO: 5852 - protein, 7 aa, Artificial Sequence
  Synthetic construct
GFGYALF

SEQ ID NO: 5853 - protein, 7 aa, Artificial Sequence
  Synthetic construct
GFGYALY

SEQ ID NO: 5854 - protein, 7 aa, Artificial Sequence
  Synthetic construct
GFGYAAF

SEQ ID NO: 5855 - protein, 7 aa, Artificial Sequence
  Synthetic construct
GFGYAAY

SEQ ID NO: 5856 - protein, 7 aa, Artificial Sequence
  Synthetic construct
GFGYAQF

SEQ ID NO: 5857 - protein, 7 aa, Artificial Sequence
  Synthetic construct
GFGYAQY

SEQ ID NO: 5858 - protein, 7 aa, Artificial Sequence
  Synthetic construct
GFGYADF

SEQ ID NO: 5859 - protein, 7 aa, Artificial Sequence
  Synthetic construct
GFGYADY

SEQ ID NO: 5860 - protein, 7 aa, Artificial Sequence
  Synthetic construct
GFGYAVF

SEQ ID NO: 5861 - protein, 7 aa, Artificial Sequence
  Synthetic construct
GFGYAVY

SEQ ID NO: 5862 - protein, 7 aa, Artificial Sequence
  Synthetic construct
GFGYQFF

SEQ ID NO: 5863 - protein, 7 aa, Artificial Sequence
  Synthetic construct
GFGYQFY

SEQ ID NO: 5864 - protein, 7 aa, Artificial Sequence
  Synthetic construct
GFGYQRF

SEQ ID NO: 5865 - protein, 7 aa, Artificial Sequence
  Synthetic construct
GFGYQRY

SEQ ID NO: 5866 - protein, 7 aa, Artificial Sequence
  Synthetic construct
GFGYQCF

SEQ ID NO: 5867 - protein, 7 aa, Artificial Sequence
  Synthetic construct
GFGYQCY

SEQ ID NO: 5868 - protein, 7 aa, Artificial Sequence
  Synthetic construct
GFGYQLF

SEQ ID NO: 5869 - protein, 7 aa, Artificial Sequence
  Synthetic construct
GFGYQLY

SEQ ID NO: 5870 - protein, 7 aa, Artificial Sequence
  Synthetic construct
GFGYQAF

SEQ ID NO: 5871 - protein, 7 aa, Artificial Sequence
  Synthetic construct
GFGYQAY

SEQ ID NO: 5872 - protein, 7 aa, Artificial Sequence
  Synthetic construct
GFGYQQF

SEQ ID NO: 5873 - protein, 7 aa, Artificial Sequence
  Synthetic construct
GFGYQQY

SEQ ID NO: 5874 - protein, 7 aa, Artificial Sequence
  Synthetic construct
GFGYQDF

SEQ ID NO: 5875 - protein, 7 aa, Artificial Sequence
  Synthetic construct
GFGYQDY

SEQ ID NO: 5876 - protein, 7 aa, Artificial Sequence
  Synthetic construct
GFGYQVF

SEQ ID NO: 5877 - protein, 7 aa, Artificial Sequence
  Synthetic construct
GFGYQVY

SEQ ID NO: 5878 - protein, 7 aa, Artificial Sequence
  Synthetic construct
GFGPIFF

SEQ ID NO: 5879 - protein, 7 aa, Artificial Sequence
  Synthetic construct
GFGPIFY

SEQ ID NO: 5880 - protein, 7 aa, Artificial Sequence
  Synthetic construct
GFGPIRF

SEQ ID NO: 5881 - protein, 7 aa, Artificial Sequence
  Synthetic construct
GFGPIRY

SEQ ID NO: 5882 - protein, 7 aa, Artificial Sequence
  Synthetic construct
GFGPICF

SEQ ID NO: 5883 - protein, 7 aa, Artificial Sequence
  Synthetic construct
GFGPICY

SEQ ID NO: 5884 - protein, 7 aa, Artificial Sequence
  Synthetic construct
GFGPILF

SEQ ID NO: 5885 - protein, 7 aa, Artificial Sequence
  Synthetic construct
GFGPILY

SEQ ID NO: 5886 - protein, 7 aa, Artificial Sequence
  Synthetic construct
GFGPIAF

SEQ ID NO: 5887 - protein, 7 aa, Artificial Sequence
  Synthetic construct
GFGPIAY

SEQ ID NO: 5888 - protein, 7 aa, Artificial Sequence
  Synthetic construct
GFGPIQF

SEQ ID NO: 5889 - protein, 7 aa, Artificial Sequence
  Synthetic construct
GFGPIQY

SEQ ID NO: 5890 - protein, 7 aa, Artificial Sequence
  Synthetic construct
GFGPIDF

SEQ ID NO: 5891 - protein, 7 aa, Artificial Sequence
  Synthetic construct
GFGPIDY

SEQ ID NO: 5892 - protein, 7 aa, Artificial Sequence
  Synthetic construct
GFGPIVF

SEQ ID NO: 5893 - protein, 7 aa, Artificial Sequence
  Synthetic construct
GFGPIVY

SEQ ID NO: 5894 - protein, 7 aa, Artificial Sequence
  Synthetic construct
GFGPDFF

SEQ ID NO: 5895 - protein, 7 aa, Artificial Sequence
  Synthetic construct
GFGPDFY

SEQ ID NO: 5896 - protein, 7 aa, Artificial Sequence
  Synthetic construct
GFGPDRF

SEQ ID NO: 5897 - protein, 7 aa, Artificial Sequence
  Synthetic construct
GFGPDRY

SEQ ID NO: 5898 - protein, 7 aa, Artificial Sequence
  Synthetic construct
GFGPDCF

SEQ ID NO: 5899 - protein, 7 aa, Artificial Sequence
  Synthetic construct
GFGPDCY

SEQ ID NO: 5900 - protein, 7 aa, Artificial Sequence
  Synthetic construct
GFGPDLF

SEQ ID NO: 5901 - protein, 7 aa, Artificial Sequence
  Synthetic construct
GFGPDLY

SEQ ID NO: 5902 - protein, 7 aa, Artificial Sequence
  Synthetic construct
GFGPDAF

SEQ ID NO: 5903 - protein, 7 aa, Artificial Sequence
  Synthetic construct
GFGPDAY

SEQ ID NO: 5904 - protein, 7 aa, Artificial Sequence
  Synthetic construct
GFGPDQF

SEQ ID NO: 5905 - protein, 7 aa, Artificial Sequence
  Synthetic construct
GFGPDQY

SEQ ID NO: 5906 - protein, 7 aa, Artificial Sequence
  Synthetic construct
GFGPDDF

SEQ ID NO: 5907 - protein, 7 aa, Artificial Sequence
  Synthetic construct
GFGPDDY

SEQ ID NO: 5908 - protein, 7 aa, Artificial Sequence
  Synthetic construct
GFGPDVF

SEQ ID NO: 5909 - protein, 7 aa, Artificial Sequence
  Synthetic construct
GFGPDVY

SEQ ID NO: 5910 - protein, 7 aa, Artificial Sequence
  Synthetic construct
GFGPYFF

SEQ ID NO: 5911 - protein, 7 aa, Artificial Sequence
  Synthetic construct
GFGPYFY

SEQ ID NO: 5912 - protein, 7 aa, Artificial Sequence
  Synthetic construct
GFGPYRF

SEQ ID NO: 5913 - protein, 7 aa, Artificial Sequence
  Synthetic construct
GFGPYRY

SEQ ID NO: 5914 - protein, 7 aa, Artificial Sequence
  Synthetic construct
GFGPYCF

SEQ ID NO: 5915 - protein, 7 aa, Artificial Sequence
  Synthetic construct
GFGPYCY

SEQ ID NO: 5916 - protein, 7 aa, Artificial Sequence
  Synthetic construct
GFGPYLF

SEQ ID NO: 5917 - protein, 7 aa, Artificial Sequence
  Synthetic construct
GFGPYLY

SEQ ID NO: 5918 - protein, 7 aa, Artificial Sequence
  Synthetic construct
GFGPYAF

SEQ ID NO: 5919 - protein, 7 aa, Artificial Sequence
  Synthetic construct
GFGPYAY

SEQ ID NO: 5920 - protein, 7 aa, Artificial Sequence
  Synthetic construct
GFGPYQF

SEQ ID NO: 5921 - protein, 7 aa, Artificial Sequence
  Synthetic construct
GFGPYQY

SEQ ID NO: 5922 - protein, 7 aa, Artificial Sequence
  Synthetic construct
GFGPYDF

SEQ ID NO: 5923 - protein, 7 aa, Artificial Sequence
  Synthetic construct
GFGPYDY

SEQ ID NO: 5924 - protein, 7 aa, Artificial Sequence
  Synthetic construct
GFGPYVF

SEQ ID NO: 5925 - protein, 7 aa, Artificial Sequence
  Synthetic construct
GFGPYVY

SEQ ID NO: 5926 - protein, 7 aa, Artificial Sequence
  Synthetic construct
GFGPFFF

SEQ ID NO: 5927 - protein, 7 aa, Artificial Sequence
  Synthetic construct
GFGPFFY

SEQ ID NO: 5928 - protein, 7 aa, Artificial Sequence
  Synthetic construct
GFGPFRF

SEQ ID NO: 5929 - protein, 7 aa, Artificial Sequence
  Synthetic construct
GFGPFRY

SEQ ID NO: 5930 - protein, 7 aa, Artificial Sequence
  Synthetic construct
GFGPFCF

SEQ ID NO: 5931 - protein, 7 aa, Artificial Sequence
  Synthetic construct
GFGPFCY

SEQ ID NO: 5932 - protein, 7 aa, Artificial Sequence
  Synthetic construct
GFGPFLF

SEQ ID NO: 5933 - protein, 7 aa, Artificial Sequence
  Synthetic construct
GFGPFLY

SEQ ID NO: 5934 - protein, 7 aa, Artificial Sequence
  Synthetic construct
GFGPFAF

SEQ ID NO: 5935 - protein, 7 aa, Artificial Sequence
  Synthetic construct
GFGPFAY

SEQ ID NO: 5936 - protein, 7 aa, Artificial Sequence
  Synthetic construct
GFGPFQF

SEQ ID NO: 5937 - protein, 7 aa, Artificial Sequence
  Synthetic construct
GFGPFQY

SEQ ID NO: 5938 - protein, 7 aa, Artificial Sequence
  Synthetic construct
GFGPFDF

SEQ ID NO: 5939 - protein, 7 aa, Artificial Sequence
  Synthetic construct
GFGPFDY

SEQ ID NO: 5940 - protein, 7 aa, Artificial Sequence
  Synthetic construct
GFGPFVF

SEQ ID NO: 5941 - protein, 7 aa, Artificial Sequence
  Synthetic construct
GFGPFVY

SEQ ID NO: 5942 - protein, 7 aa, Artificial Sequence
  Synthetic construct
GFGPVFF

SEQ ID NO: 5943 - protein, 7 aa, Artificial Sequence
  Synthetic construct
GFGPVFY

SEQ ID NO: 5944 - protein, 7 aa, Artificial Sequence
  Synthetic construct
GFGPVRF

SEQ ID NO: 5945 - protein, 7 aa, Artificial Sequence
  Synthetic construct
GFGPVRY

SEQ ID NO: 5946 - protein, 7 aa, Artificial Sequence
  Synthetic construct
GFGPVCF

SEQ ID NO: 5947 - protein, 7 aa, Artificial Sequence
  Synthetic construct
GFGPVCY

SEQ ID NO: 5948 - protein, 7 aa, Artificial Sequence
  Synthetic construct
GFGPVLF

SEQ ID NO: 5949 - protein, 7 aa, Artificial Sequence
  Synthetic construct
GFGPVLY

SEQ ID NO: 5950 - protein, 7 aa, Artificial Sequence
  Synthetic construct
GFGPVAF

SEQ ID NO: 5951 - protein, 7 aa, Artificial Sequence
  Synthetic construct
GFGPVAY

SEQ ID NO: 5952 - protein, 7 aa, Artificial Sequence
  Synthetic construct
GFGPVQF

SEQ ID NO: 5953 - protein, 7 aa, Artificial Sequence
  Synthetic construct
GFGPVQY

SEQ ID NO: 5954 - protein, 7 aa, Artificial Sequence
  Synthetic construct
GFGPVDF

SEQ ID NO: 5955 - protein, 7 aa, Artificial Sequence
  Synthetic construct
GFGPVDY

SEQ ID NO: 5956 - protein, 7 aa, Artificial Sequence
  Synthetic construct
GFGPVVF

SEQ ID NO: 5957 - protein, 7 aa, Artificial Sequence
  Synthetic construct
GFGPVVY

SEQ ID NO: 5958 - protein, 7 aa, Artificial Sequence
  Synthetic construct
GFGPTFF

SEQ ID NO: 5959 - protein, 7 aa, Artificial Sequence
  Synthetic construct
GFGPTFY

SEQ ID NO: 5960 - protein, 7 aa, Artificial Sequence
  Synthetic construct
GFGPTRF

SEQ ID NO: 5961 - protein, 7 aa, Artificial Sequence
  Synthetic construct
GFGPTRY

SEQ ID NO: 5962 - protein, 7 aa, Artificial Sequence
  Synthetic construct
GFGPTCF

SEQ ID NO: 5963 - protein, 7 aa, Artificial Sequence
  Synthetic construct
GFGPTCY

SEQ ID NO: 5964 - protein, 7 aa, Artificial Sequence
  Synthetic construct
GFGPTLF

SEQ ID NO: 5965 - protein, 7 aa, Artificial Sequence
  Synthetic construct
GFGPTLY

SEQ ID NO: 5966 - protein, 7 aa, Artificial Sequence
  Synthetic construct
GFGPTAF

SEQ ID NO: 5967 - protein, 7 aa, Artificial Sequence
  Synthetic construct
GFGPTAY

SEQ ID NO: 5968 - protein, 7 aa, Artificial Sequence
  Synthetic construct
GFGPTQF

SEQ ID NO: 5969 - protein, 7 aa, Artificial Sequence
  Synthetic construct
GFGPTQY

SEQ ID NO: 5970 - protein, 7 aa, Artificial Sequence
  Synthetic construct
GFGPTDF

SEQ ID NO: 5971 - protein, 7 aa, Artificial Sequence
  Synthetic construct
GFGPTDY

SEQ ID NO: 5972 - protein, 7 aa, Artificial Sequence
  Synthetic construct
GFGPTVF

SEQ ID NO: 5973 - protein, 7 aa, Artificial Sequence
  Synthetic construct
GFGPTVY

SEQ ID NO: 5974 - protein, 7 aa, Artificial Sequence
  Synthetic construct
GFGPGFF

SEQ ID NO: 5975 - protein, 7 aa, Artificial Sequence
  Synthetic construct
GFGPGFY

SEQ ID NO: 5976 - protein, 7 aa, Artificial Sequence
  Synthetic construct
GFGPGRF

SEQ ID NO: 5977 - protein, 7 aa, Artificial Sequence
  Synthetic construct
GFGPGRY

SEQ ID NO: 5978 - protein, 7 aa, Artificial Sequence
  Synthetic construct
GFGPGCF

SEQ ID NO: 5979 - protein, 7 aa, Artificial Sequence
  Synthetic construct
GFGPGCY

SEQ ID NO: 5980 - protein, 7 aa, Artificial Sequence
  Synthetic construct
GFGPGLF

SEQ ID NO: 5981 - protein, 7 aa, Artificial Sequence
  Synthetic construct
GFGPGLY

SEQ ID NO: 5982 - protein, 7 aa, Artificial Sequence
  Synthetic construct
GFGPGAF

SEQ ID NO: 5983 - protein, 7 aa, Artificial Sequence
  Synthetic construct
GFGPGAY

SEQ ID NO: 5984 - protein, 7 aa, Artificial Sequence
  Synthetic construct
GFGPGQF

SEQ ID NO: 5985 - protein, 7 aa, Artificial Sequence
  Synthetic construct
GFGPGQY

SEQ ID NO: 5986 - protein, 7 aa, Artificial Sequence
  Synthetic construct
GFGPGDF

SEQ ID NO: 5987 - protein, 7 aa, Artificial Sequence
  Synthetic construct
GFGPGDY

SEQ ID NO: 5988 - protein, 7 aa, Artificial Sequence
  Synthetic construct
GFGPGVF

SEQ ID NO: 5989 - protein, 7 aa, Artificial Sequence
  Synthetic construct
GFGPGVY

SEQ ID NO: 5990 - protein, 7 aa, Artificial Sequence
  Synthetic construct
GFGPAFF

SEQ ID NO: 5991 - protein, 7 aa, Artificial Sequence
  Synthetic construct
GFGPAFY

SEQ ID NO: 5992 - protein, 7 aa, Artificial Sequence
  Synthetic construct
GFGPARF

SEQ ID NO: 5993 - protein, 7 aa, Artificial Sequence
  Synthetic construct
GFGPARY

SEQ ID NO: 5994 - protein, 7 aa, Artificial Sequence
  Synthetic construct
GFGPACF

SEQ ID NO: 5995 - protein, 7 aa, Artificial Sequence
  Synthetic construct
GFGPACY

SEQ ID NO: 5996 - protein, 7 aa, Artificial Sequence
  Synthetic construct
GFGPALF

SEQ ID NO: 5997 - protein, 7 aa, Artificial Sequence
  Synthetic construct
GFGPALY

SEQ ID NO: 5998 - protein, 7 aa, Artificial Sequence
  Synthetic construct
GFGPAAF

SEQ ID NO: 5999 - protein, 7 aa, Artificial Sequence
  Synthetic construct
GFGPAAY

SEQ ID NO: 6000 - protein, 7 aa, Artificial Sequence
  Synthetic construct
GFGPAQF

SEQ ID NO: 6001 - protein, 7 aa, Artificial Sequence
  Synthetic construct
GFGPAQY

SEQ ID NO: 6002 - protein, 7 aa, Artificial Sequence
  Synthetic construct
GFGPADF

SEQ ID NO: 6003 - protein, 7 aa, Artificial Sequence
  Synthetic construct
GFGPADY

SEQ ID NO: 6004 - protein, 7 aa, Artificial Sequence
  Synthetic construct
GFGPAVF

SEQ ID NO: 6005 - protein, 7 aa, Artificial Sequence
  Synthetic construct
GFGPAVY

SEQ ID NO: 6006 - protein, 7 aa, Artificial Sequence
  Synthetic construct
GFGPQFF

SEQ ID NO: 6007 - protein, 7 aa, Artificial Sequence
  Synthetic construct
GFGPQFY

SEQ ID NO: 6008 - protein, 7 aa, Artificial Sequence
  Synthetic construct
GFGPQRF

SEQ ID NO: 6009 - protein, 7 aa, Artificial Sequence
  Synthetic construct
GFGPQRY

SEQ ID NO: 6010 - protein, 7 aa, Artificial Sequence
  Synthetic construct
GFGPQCF

SEQ ID NO: 6011 - protein, 7 aa, Artificial Sequence
  Synthetic construct
GFGPQCY

SEQ ID NO: 6012 - protein, 7 aa, Artificial Sequence
  Synthetic construct
GFGPQLF

SEQ ID NO: 6013 - protein, 7 aa, Artificial Sequence
  Synthetic construct
GFGPQLY

SEQ ID NO: 6014 - protein, 7 aa, Artificial Sequence
  Synthetic construct
GFGPQAF

SEQ ID NO: 6015 - protein, 7 aa, Artificial Sequence
  Synthetic construct
GFGPQAY

SEQ ID NO: 6016 - protein, 7 aa, Artificial Sequence
  Synthetic construct
GFGPQQF

SEQ ID NO: 6017 - protein, 7 aa, Artificial Sequence
  Synthetic construct
GFGPQQY

SEQ ID NO: 6018 - protein, 7 aa, Artificial Sequence
  Synthetic construct
GFGPQDF

SEQ ID NO: 6019 - protein, 7 aa, Artificial Sequence
  Synthetic construct
GFGPQDY

SEQ ID NO: 6020 - protein, 7 aa, Artificial Sequence
  Synthetic construct
GFGPQVF

SEQ ID NO: 6021 - protein, 7 aa, Artificial Sequence
  Synthetic construct
GFGPQVY

SEQ ID NO: 6022 - protein, 7 aa, Artificial Sequence
  Synthetic construct
GFGHIFF

SEQ ID NO: 6023 - protein, 7 aa, Artificial Sequence
  Synthetic construct
GFGHIFY

SEQ ID NO: 6024 - protein, 7 aa, Artificial Sequence
  Synthetic construct
GFGHIRF

SEQ ID NO: 6025 - protein, 7 aa, Artificial Sequence
  Synthetic construct
GFGHIRY

SEQ ID NO: 6026 - protein, 7 aa, Artificial Sequence
  Synthetic construct
GFGHICF

SEQ ID NO: 6027 - protein, 7 aa, Artificial Sequence
  Synthetic construct
GFGHICY

SEQ ID NO: 6028 - protein, 7 aa, Artificial Sequence
  Synthetic construct
GFGHILF

SEQ ID NO: 6029 - protein, 7 aa, Artificial Sequence
  Synthetic construct
GFGHILY

SEQ ID NO: 6030 - protein, 7 aa, Artificial Sequence
  Synthetic construct
GFGHIAF

SEQ ID NO: 6031 - protein, 7 aa, Artificial Sequence
  Synthetic construct
GFGHIAY

SEQ ID NO: 6032 - protein, 7 aa, Artificial Sequence
  Synthetic construct
GFGHIQF

SEQ ID NO: 6033 - protein, 7 aa, Artificial Sequence
  Synthetic construct
GFGHIQY

SEQ ID NO: 6034 - protein, 7 aa, Artificial Sequence
  Synthetic construct
GFGHIDF

SEQ ID NO: 6035 - protein, 7 aa, Artificial Sequence
  Synthetic construct
GFGHIDY

SEQ ID NO: 6036 - protein, 7 aa, Artificial Sequence
  Synthetic construct
GFGHIVF

SEQ ID NO: 6037 - protein, 7 aa, Artificial Sequence
  Synthetic construct
GFGHIVY

SEQ ID NO: 6038 - protein, 7 aa, Artificial Sequence
  Synthetic construct
GFGHDFF

SEQ ID NO: 6039 - protein, 7 aa, Artificial Sequence
  Synthetic construct
GFGHDFY

SEQ ID NO: 6040 - protein, 7 aa, Artificial Sequence
  Synthetic construct
GFGHDRF

SEQ ID NO: 6041 - protein, 7 aa, Artificial Sequence
  Synthetic construct
GFGHDRY

SEQ ID NO: 6042 - protein, 7 aa, Artificial Sequence
  Synthetic construct
GFGHDCF

SEQ ID NO: 6043 - protein, 7 aa, Artificial Sequence
  Synthetic construct
GFGHDCY

SEQ ID NO: 6044 - protein, 7 aa, Artificial Sequence
  Synthetic construct
GFGHDLF

SEQ ID NO: 6045 - protein, 7 aa, Artificial Sequence
  Synthetic construct
GFGHDLY

SEQ ID NO: 6046 - protein, 7 aa, Artificial Sequence
  Synthetic construct
GFGHDAF

SEQ ID NO: 6047 - protein, 7 aa, Artificial Sequence
  Synthetic construct
GFGHDAY

SEQ ID NO: 6048 - protein, 7 aa, Artificial Sequence
  Synthetic construct
GFGHDQF

SEQ ID NO: 6049 - protein, 7 aa, Artificial Sequence
  Synthetic construct
GFGHDQY

SEQ ID NO: 6050 - protein, 7 aa, Artificial Sequence
  Synthetic construct
GFGHDDF

SEQ ID NO: 6051 - protein, 7 aa, Artificial Sequence
  Synthetic construct
GFGHDDY

SEQ ID NO: 6052 - protein, 7 aa, Artificial Sequence
  Synthetic construct
GFGHDVF

SEQ ID NO: 6053 - protein, 7 aa, Artificial Sequence
  Synthetic construct
GFGHDVY

SEQ ID NO: 6054 - protein, 7 aa, Artificial Sequence
  Synthetic construct
GFGHYFF

SEQ ID NO: 6055 - protein, 7 aa, Artificial Sequence
  Synthetic construct
GFGHYFY

SEQ ID NO: 6056 - protein, 7 aa, Artificial Sequence
  Synthetic construct
GFGHYRF

SEQ ID NO: 6057 - protein, 7 aa, Artificial Sequence
  Synthetic construct
GFGHYRY

SEQ ID NO: 6058 - protein, 7 aa, Artificial Sequence
  Synthetic construct
GFGHYCF

SEQ ID NO: 6059 - protein, 7 aa, Artificial Sequence
  Synthetic construct
GFGHYCY

SEQ ID NO: 6060 - protein, 7 aa, Artificial Sequence
  Synthetic construct
GFGHYLF

SEQ ID NO: 6061 - protein, 7 aa, Artificial Sequence
  Synthetic construct
GFGHYLY

SEQ ID NO: 6062 - protein, 7 aa, Artificial Sequence
  Synthetic construct
GFGHYAF

SEQ ID NO: 6063 - protein, 7 aa, Artificial Sequence
  Synthetic construct
GFGHYAY

SEQ ID NO: 6064 - protein, 7 aa, Artificial Sequence
  Synthetic construct
GFGHYQF

SEQ ID NO: 6065 - protein, 7 aa, Artificial Sequence
  Synthetic construct
GFGHYQY

SEQ ID NO: 6066 - protein, 7 aa, Artificial Sequence
  Synthetic construct
GFGHYDF

SEQ ID NO: 6067 - protein, 7 aa, Artificial Sequence
  Synthetic construct
GFGHYDY

SEQ ID NO: 6068 - protein, 7 aa, Artificial Sequence
  Synthetic construct
GFGHYVF

SEQ ID NO: 6069 - protein, 7 aa, Artificial Sequence
  Synthetic construct
GFGHYVY

SEQ ID NO: 6070 - protein, 7 aa, Artificial Sequence
  Synthetic construct
GFGHFFF

SEQ ID NO: 6071 - protein, 7 aa, Artificial Sequence
  Synthetic construct
GFGHFFY

SEQ ID NO: 6072 - protein, 7 aa, Artificial Sequence
  Synthetic construct
GFGHFRF

SEQ ID NO: 6073 - protein, 7 aa, Artificial Sequence
  Synthetic construct
GFGHFRY

SEQ ID NO: 6074 - protein, 7 aa, Artificial Sequence
  Synthetic construct
GFGHFCF

SEQ ID NO: 6075 - protein, 7 aa, Artificial Sequence
  Synthetic construct
GFGHFCY

SEQ ID NO: 6076 - protein, 7 aa, Artificial Sequence
  Synthetic construct
GFGHFLF

SEQ ID NO: 6077 - protein, 7 aa, Artificial Sequence
  Synthetic construct
GFGHFLY

SEQ ID NO: 6078 - protein, 7 aa, Artificial Sequence
  Synthetic construct
GFGHFAF

SEQ ID NO: 6079 - protein, 7 aa, Artificial Sequence
  Synthetic construct
GFGHFAY

SEQ ID NO: 6080 - protein, 7 aa, Artificial Sequence
  Synthetic construct
GFGHFQF

SEQ ID NO: 6081 - protein, 7 aa, Artificial Sequence
  Synthetic construct
GFGHFQY

SEQ ID NO: 6082 - protein, 7 aa, Artificial Sequence
  Synthetic construct
GFGHFDF

SEQ ID NO: 6083 - protein, 7 aa, Artificial Sequence
  Synthetic construct
GFGHFDY

SEQ ID NO: 6084 - protein, 7 aa, Artificial Sequence
  Synthetic construct
GFGHFVF

SEQ ID NO: 6085 - protein, 7 aa, Artificial Sequence
  Synthetic construct
GFGHFVY

SEQ ID NO: 6086 - protein, 7 aa, Artificial Sequence
  Synthetic construct
GFGHVFF

SEQ ID NO: 6087 - protein, 7 aa, Artificial Sequence
  Synthetic construct
GFGHVFY

SEQ ID NO: 6088 - protein, 7 aa, Artificial Sequence
  Synthetic construct
GFGHVRF

SEQ ID NO: 6089 - protein, 7 aa, Artificial Sequence
  Synthetic construct
GFGHVRY

SEQ ID NO: 6090 - protein, 7 aa, Artificial Sequence
  Synthetic construct
GFGHVCF

SEQ ID NO: 6091 - protein, 7 aa, Artificial Sequence
  Synthetic construct
GFGHVCY

SEQ ID NO: 6092 - protein, 7 aa, Artificial Sequence
  Synthetic construct
GFGHVLF

SEQ ID NO: 6093 - protein, 7 aa, Artificial Sequence
  Synthetic construct
GFGHVLY

SEQ ID NO: 6094 - protein, 7 aa, Artificial Sequence
  Synthetic construct
GFGHVAF

SEQ ID NO: 6095 - protein, 7 aa, Artificial Sequence
  Synthetic construct
GFGHVAY

SEQ ID NO: 6096 - protein, 7 aa, Artificial Sequence
  Synthetic construct
GFGHVQF

SEQ ID NO: 6097 - protein, 7 aa, Artificial Sequence
  Synthetic construct
GFGHVQY

SEQ ID NO: 6098 - protein, 7 aa, Artificial Sequence
  Synthetic construct
GFGHVDF

SEQ ID NO: 6099 - protein, 7 aa, Artificial Sequence
  Synthetic construct
GFGHVDY

SEQ ID NO: 6100 - protein, 7 aa, Artificial Sequence
  Synthetic construct
GFGHVVF

SEQ ID NO: 6101 - protein, 7 aa, Artificial Sequence
  Synthetic construct
GFGHVVY

SEQ ID NO: 6102 - protein, 7 aa, Artificial Sequence
  Synthetic construct
GFGHTFF

SEQ ID NO: 6103 - protein, 7 aa, Artificial Sequence
  Synthetic construct
GFGHTFY

SEQ ID NO: 6104 - protein, 7 aa, Artificial Sequence
  Synthetic construct
GFGHTRF

SEQ ID NO: 6105 - protein, 7 aa, Artificial Sequence
  Synthetic construct
GFGHTRY

SEQ ID NO: 6106 - protein, 7 aa, Artificial Sequence
  Synthetic construct
GFGHTCF

SEQ ID NO: 6107 - protein, 7 aa, Artificial Sequence
  Synthetic construct
GFGHTCY

SEQ ID NO: 6108 - protein, 7 aa, Artificial Sequence
  Synthetic construct
GFGHTLF

SEQ ID NO: 6109 - protein, 7 aa, Artificial Sequence
  Synthetic construct
GFGHTLY

SEQ ID NO: 6110 - protein, 7 aa, Artificial Sequence
  Synthetic construct
GFGHTAF

SEQ ID NO: 6111 - protein, 7 aa, Artificial Sequence
  Synthetic construct
GFGHTAY

SEQ ID NO: 6112 - protein, 7 aa, Artificial Sequence
  Synthetic construct
GFGHTQF

SEQ ID NO: 6113 - protein, 7 aa, Artificial Sequence
  Synthetic construct
GFGHTQY

SEQ ID NO: 6114 - protein, 7 aa, Artificial Sequence
  Synthetic construct
GFGHTDF

SEQ ID NO: 6115 - protein, 7 aa, Artificial Sequence
  Synthetic construct
GFGHTDY

SEQ ID NO: 6116 - protein, 7 aa, Artificial Sequence
  Synthetic construct
GFGHTVF

SEQ ID NO: 6117 - protein, 7 aa, Artificial Sequence
  Synthetic construct
GFGHTVY

SEQ ID NO: 6118 - protein, 7 aa, Artificial Sequence
  Synthetic construct
GFGHGFF

SEQ ID NO: 6119 - protein, 7 aa, Artificial Sequence
  Synthetic construct
GFGHGFY

SEQ ID NO: 6120 - protein, 7 aa, Artificial Sequence
  Synthetic construct
GFGHGRF

SEQ ID NO: 6121 - protein, 7 aa, Artificial Sequence
  Synthetic construct
GFGHGRY

SEQ ID NO: 6122 - protein, 7 aa, Artificial Sequence
  Synthetic construct
GFGHGCF

SEQ ID NO: 6123 - protein, 7 aa, Artificial Sequence
  Synthetic construct
GFGHGCY

SEQ ID NO: 6124 - protein, 7 aa, Artificial Sequence
  Synthetic construct
GFGHGLF

SEQ ID NO: 6125 - protein, 7 aa, Artificial Sequence
  Synthetic construct
GFGHGLY

SEQ ID NO: 6126 - protein, 7 aa, Artificial Sequence
  Synthetic construct
GFGHGAF

SEQ ID NO: 6127 - protein, 7 aa, Artificial Sequence
  Synthetic construct
GFGHGAY

SEQ ID NO: 6128 - protein, 7 aa, Artificial Sequence
  Synthetic construct
GFGHGQF

SEQ ID NO: 6129 - protein, 7 aa, Artificial Sequence
  Synthetic construct
GFGHGQY

SEQ ID NO: 6130 - protein, 7 aa, Artificial Sequence
  Synthetic construct
GFGHGDF

SEQ ID NO: 6131 - protein, 7 aa, Artificial Sequence
  Synthetic construct
GFGHGDY

SEQ ID NO: 6132 - protein, 7 aa, Artificial Sequence
  Synthetic construct
GFGHGVF

SEQ ID NO: 6133 - protein, 7 aa, Artificial Sequence
  Synthetic construct
GFGHGVY

SEQ ID NO: 6134 - protein, 7 aa, Artificial Sequence
  Synthetic construct
GFGHAFF

SEQ ID NO: 6135 - protein, 7 aa, Artificial Sequence
  Synthetic construct
GFGHAFY

SEQ ID NO: 6136 - protein, 7 aa, Artificial Sequence
  Synthetic construct
GFGHARF

SEQ ID NO: 6137 - protein, 7 aa, Artificial Sequence
  Synthetic construct
GFGHARY

SEQ ID NO: 6138 - protein, 7 aa, Artificial Sequence
  Synthetic construct
GFGHACF

SEQ ID NO: 6139 - protein, 7 aa, Artificial Sequence
  Synthetic construct
GFGHACY

SEQ ID NO: 6140 - protein, 7 aa, Artificial Sequence
  Synthetic construct
GFGHALF

SEQ ID NO: 6141 - protein, 7 aa, Artificial Sequence
  Synthetic construct
GFGHALY

SEQ ID NO: 6142 - protein, 7 aa, Artificial Sequence
  Synthetic construct
GFGHAAF

SEQ ID NO: 6143 - protein, 7 aa, Artificial Sequence
  Synthetic construct
GFGHAAY

SEQ ID NO: 6144 - protein, 7 aa, Artificial Sequence
  Synthetic construct
GFGHAQF

SEQ ID NO: 6145 - protein, 7 aa, Artificial Sequence
  Synthetic construct
GFGHAQY

SEQ ID NO: 6146 - protein, 7 aa, Artificial Sequence
  Synthetic construct
GFGHADF

SEQ ID NO: 6147 - protein, 7 aa, Artificial Sequence
  Synthetic construct
GFGHADY

SEQ ID NO: 6148 - protein, 7 aa, Artificial Sequence
  Synthetic construct
GFGHAVF

SEQ ID NO: 6149 - protein, 7 aa, Artificial Sequence
  Synthetic construct
GFGHAVY

SEQ ID NO: 6150 - protein, 7 aa, Artificial Sequence
  Synthetic construct
GFGHQFF

SEQ ID NO: 6151 - protein, 7 aa, Artificial Sequence
  Synthetic construct
GFGHQFY

SEQ ID NO: 6152 - protein, 7 aa, Artificial Sequence
  Synthetic construct
GFGHQRF

SEQ ID NO: 6153 - protein, 7 aa, Artificial Sequence
  Synthetic construct
GFGHQRY

SEQ ID NO: 6154 - protein, 7 aa, Artificial Sequence
  Synthetic construct
GFGHQCF

SEQ ID NO: 6155 - protein, 7 aa, Artificial Sequence
  Synthetic construct
GFGHQCY

SEQ ID NO: 6156 - protein, 7 aa, Artificial Sequence
  Synthetic construct
GFGHQLF

SEQ ID NO: 6157 - protein, 7 aa, Artificial Sequence
  Synthetic construct
GFGHQLY

SEQ ID NO: 6158 - protein, 7 aa, Artificial Sequence
  Synthetic construct
GFGHQAF

SEQ ID NO: 6159 - protein, 7 aa, Artificial Sequence
  Synthetic construct
GFGHQAY

SEQ ID NO: 6160 - protein, 7 aa, Artificial Sequence
  Synthetic construct
GFGHQQF

SEQ ID NO: 6161 - protein, 7 aa, Artificial Sequence
  Synthetic construct
GFGHQQY

SEQ ID NO: 6162 - protein, 7 aa, Artificial Sequence
  Synthetic construct
GFGHQDF

SEQ ID NO: 6163 - protein, 7 aa, Artificial Sequence
  Synthetic construct
GFGHQDY

SEQ ID NO: 6164 - protein, 7 aa, Artificial Sequence
  Synthetic construct
GFGHQVF

SEQ ID NO: 6165 - protein, 7 aa, Artificial Sequence
  Synthetic construct
GFGHQVY

SEQ ID NO: 6166 - protein, 7 aa, Artificial Sequence
  Synthetic construct
GFGLIFF

SEQ ID NO: 6167 - protein, 7 aa, Artificial Sequence
  Synthetic construct
GFGLIFY

SEQ ID NO: 6168 - protein, 7 aa, Artificial Sequence
  Synthetic construct
GFGLIRF

SEQ ID NO: 6169 - protein, 7 aa, Artificial Sequence
  Synthetic construct
GFGLIRY

SEQ ID NO: 6170 - protein, 7 aa, Artificial Sequence
  Synthetic construct
GFGLICF

SEQ ID NO: 6171 - protein, 7 aa, Artificial Sequence
  Synthetic construct
GFGLICY

SEQ ID NO: 6172 - protein, 7 aa, Artificial Sequence
  Synthetic construct
GFGLILF

SEQ ID NO: 6173 - protein, 7 aa, Artificial Sequence
  Synthetic construct
GFGLILY

SEQ ID NO: 6174 - protein, 7 aa, Artificial Sequence
  Synthetic construct
GFGLIAF

SEQ ID NO: 6175 - protein, 7 aa, Artificial Sequence
  Synthetic construct
GFGLIAY

SEQ ID NO: 6176 - protein, 7 aa, Artificial Sequence
  Synthetic construct
GFGLIQF

SEQ ID NO: 6177 - protein, 7 aa, Artificial Sequence
  Synthetic construct
GFGLIQY

SEQ ID NO: 6178 - protein, 7 aa, Artificial Sequence
  Synthetic construct
GFGLIDF

SEQ ID NO: 6179 - protein, 7 aa, Artificial Sequence
  Synthetic construct
GFGLIDY

SEQ ID NO: 6180 - protein, 7 aa, Artificial Sequence
  Synthetic construct
GFGLIVF

SEQ ID NO: 6181 - protein, 7 aa, Artificial Sequence
  Synthetic construct
GFGLIVY

SEQ ID NO: 6182 - protein, 7 aa, Artificial Sequence
  Synthetic construct
GFGLDFF

SEQ ID NO: 6183 - protein, 7 aa, Artificial Sequence
  Synthetic construct
GFGLDFY

SEQ ID NO: 6184 - protein, 7 aa, Artificial Sequence
  Synthetic construct
GFGLDRF

SEQ ID NO: 6185 - protein, 7 aa, Artificial Sequence
  Synthetic construct
GFGLDRY

SEQ ID NO: 6186 - protein, 7 aa, Artificial Sequence
  Synthetic construct
GFGLDCF

SEQ ID NO: 6187 - protein, 7 aa, Artificial Sequence
  Synthetic construct
GFGLDCY

SEQ ID NO: 6188 - protein, 7 aa, Artificial Sequence
  Synthetic construct
GFGLDLF

SEQ ID NO: 6189 - protein, 7 aa, Artificial Sequence
  Synthetic construct
GFGLDLY

SEQ ID NO: 6190 - protein, 7 aa, Artificial Sequence
  Synthetic construct
GFGLDAF

SEQ ID NO: 6191 - protein, 7 aa, Artificial Sequence
  Synthetic construct
GFGLDAY

SEQ ID NO: 6192 - protein, 7 aa, Artificial Sequence
  Synthetic construct
GFGLDQF

SEQ ID NO: 6193 - protein, 7 aa, Artificial Sequence
  Synthetic construct
GFGLDQY

SEQ ID NO: 6194 - protein, 7 aa, Artificial Sequence
  Synthetic construct
GFGLDDF

SEQ ID NO: 6195 - protein, 7 aa, Artificial Sequence
  Synthetic construct
GFGLDDY

SEQ ID NO: 6196 - protein, 7 aa, Artificial Sequence
  Synthetic construct
GFGLDVF

SEQ ID NO: 6197 - protein, 7 aa, Artificial Sequence
  Synthetic construct
GFGLDVY

SEQ ID NO: 6198 - protein, 7 aa, Artificial Sequence
  Synthetic construct
GFGLYFF

SEQ ID NO: 6199 - protein, 7 aa, Artificial Sequence
  Synthetic construct
GFGLYFY

SEQ ID NO: 6200 - protein, 7 aa, Artificial Sequence
  Synthetic construct
GFGLYRF

SEQ ID NO: 6201 - protein, 7 aa, Artificial Sequence
  Synthetic construct
GFGLYRY

SEQ ID NO: 6202 - protein, 7 aa, Artificial Sequence
  Synthetic construct
GFGLYCF

SEQ ID NO: 6203 - protein, 7 aa, Artificial Sequence
  Synthetic construct
GFGLYCY

SEQ ID NO: 6204 - protein, 7 aa, Artificial Sequence
  Synthetic construct
GFGLYLF

SEQ ID NO: 6205 - protein, 7 aa, Artificial Sequence
  Synthetic construct
GFGLYLY

SEQ ID NO: 6206 - protein, 7 aa, Artificial Sequence
  Synthetic construct
GFGLYAF

SEQ ID NO: 6207 - protein, 7 aa, Artificial Sequence
  Synthetic construct
GFGLYAY

SEQ ID NO: 6208 - protein, 7 aa, Artificial Sequence
  Synthetic construct
GFGLYQF

SEQ ID NO: 6209 - protein, 7 aa, Artificial Sequence
  Synthetic construct
GFGLYQY

SEQ ID NO: 6210 - protein, 7 aa, Artificial Sequence
  Synthetic construct
GFGLYDF

SEQ ID NO: 6211 - protein, 7 aa, Artificial Sequence
  Synthetic construct
GFGLYDY

SEQ ID NO: 6212 - protein, 7 aa, Artificial Sequence
  Synthetic construct
GFGLYVF

SEQ ID NO: 6213 - protein, 7 aa, Artificial Sequence
  Synthetic construct
GFGLYVY

SEQ ID NO: 6214 - protein, 7 aa, Artificial Sequence
  Synthetic construct
GFGLFFF

SEQ ID NO: 6215 - protein, 7 aa, Artificial Sequence
  Synthetic construct
GFGLFFY

SEQ ID NO: 6216 - protein, 7 aa, Artificial Sequence
  Synthetic construct
GFGLFRF

SEQ ID NO: 6217 - protein, 7 aa, Artificial Sequence
  Synthetic construct
GFGLFRY

SEQ ID NO: 6218 - protein, 7 aa, Artificial Sequence
  Synthetic construct
GFGLFCF

SEQ ID NO: 6219 - protein, 7 aa, Artificial Sequence
  Synthetic construct
GFGLFCY

SEQ ID NO: 6220 - protein, 7 aa, Artificial Sequence
  Synthetic construct
GFGLFLF

SEQ ID NO: 6221 - protein, 7 aa, Artificial Sequence
  Synthetic construct
GFGLFLY

SEQ ID NO: 6222 - protein, 7 aa, Artificial Sequence
  Synthetic construct
GFGLFAF

SEQ ID NO: 6223 - protein, 7 aa, Artificial Sequence
  Synthetic construct
GFGLFAY

SEQ ID NO: 6224 - protein, 7 aa, Artificial Sequence
  Synthetic construct
GFGLFQF

SEQ ID NO: 6225 - protein, 7 aa, Artificial Sequence
  Synthetic construct
GFGLFQY

SEQ ID NO: 6226 - protein, 7 aa, Artificial Sequence
  Synthetic construct
GFGLFDF

SEQ ID NO: 6227 - protein, 7 aa, Artificial Sequence
  Synthetic construct
GFGLFDY

SEQ ID NO: 6228 - protein, 7 aa, Artificial Sequence
  Synthetic construct
GFGLFVF

SEQ ID NO: 6229 - protein, 7 aa, Artificial Sequence
  Synthetic construct
GFGLFVY

SEQ ID NO: 6230 - protein, 7 aa, Artificial Sequence
  Synthetic construct
GFGLVFF

SEQ ID NO: 6231 - protein, 7 aa, Artificial Sequence
  Synthetic construct
GFGLVFY

SEQ ID NO: 6232 - protein, 7 aa, Artificial Sequence
  Synthetic construct
GFGLVRF

SEQ ID NO: 6233 - protein, 7 aa, Artificial Sequence
  Synthetic construct
GFGLVRY

SEQ ID NO: 6234 - protein, 7 aa, Artificial Sequence
  Synthetic construct
GFGLVCF

SEQ ID NO: 6235 - protein, 7 aa, Artificial Sequence
  Synthetic construct
GFGLVCY

SEQ ID NO: 6236 - protein, 7 aa, Artificial Sequence
  Synthetic construct
GFGLVLF

SEQ ID NO: 6237 - protein, 7 aa, Artificial Sequence
  Synthetic construct
GFGLVLY

SEQ ID NO: 6238 - protein, 7 aa, Artificial Sequence
  Synthetic construct
GFGLVAF

SEQ ID NO: 6239 - protein, 7 aa, Artificial Sequence
  Synthetic construct
GFGLVAY

SEQ ID NO: 6240 - protein, 7 aa, Artificial Sequence
  Synthetic construct
GFGLVQF

SEQ ID NO: 6241 - protein, 7 aa, Artificial Sequence
  Synthetic construct
GFGLVQY

SEQ ID NO: 6242 - protein, 7 aa, Artificial Sequence
  Synthetic construct
GFGLVDF

SEQ ID NO: 6243 - protein, 7 aa, Artificial Sequence
  Synthetic construct
GFGLVDY

SEQ ID NO: 6244 - protein, 7 aa, Artificial Sequence
  Synthetic construct
GFGLVVF

SEQ ID NO: 6245 - protein, 7 aa, Artificial Sequence
  Synthetic construct
GFGLVVY

SEQ ID NO: 6246 - protein, 7 aa, Artificial Sequence
  Synthetic construct
GFGLTFF

SEQ ID NO: 6247 - protein, 7 aa, Artificial Sequence
  Synthetic construct
GFGLTFY

SEQ ID NO: 6248 - protein, 7 aa, Artificial Sequence
  Synthetic construct
GFGLTRF

SEQ ID NO: 6249 - protein, 7 aa, Artificial Sequence
  Synthetic construct
GFGLTRY

SEQ ID NO: 6250 - protein, 7 aa, Artificial Sequence
  Synthetic construct
GFGLTCF

SEQ ID NO: 6251 - protein, 7 aa, Artificial Sequence
  Synthetic construct
GFGLTCY

SEQ ID NO: 6252 - protein, 7 aa, Artificial Sequence
  Synthetic construct
GFGLTLF

SEQ ID NO: 6253 - protein, 7 aa, Artificial Sequence
  Synthetic construct
GFGLTLY

SEQ ID NO: 6254 - protein, 7 aa, Artificial Sequence
  Synthetic construct
GFGLTAF

SEQ ID NO: 6255 - protein, 7 aa, Artificial Sequence
  Synthetic construct
GFGLTAY

SEQ ID NO: 6256 - protein, 7 aa, Artificial Sequence
  Synthetic construct
GFGLTQF

SEQ ID NO: 6257 - protein, 7 aa, Artificial Sequence
  Synthetic construct
GFGLTQY

SEQ ID NO: 6258 - protein, 7 aa, Artificial Sequence
  Synthetic construct
GFGLTDF

SEQ ID NO: 6259 - protein, 7 aa, Artificial Sequence
  Synthetic construct
GFGLTDY

SEQ ID NO: 6260 - protein, 7 aa, Artificial Sequence
  Synthetic construct
GFGLTVF

SEQ ID NO: 6261 - protein, 7 aa, Artificial Sequence
  Synthetic construct
GFGLTVY

SEQ ID NO: 6262 - protein, 7 aa, Artificial Sequence
  Synthetic construct
GFGLGFF

SEQ ID NO: 6263 - protein, 7 aa, Artificial Sequence
  Synthetic construct
GFGLGFY

SEQ ID NO: 6264 - protein, 7 aa, Artificial Sequence
  Synthetic construct
GFGLGRF

SEQ ID NO: 6265 - protein, 7 aa, Artificial Sequence
  Synthetic construct
GFGLGRY

SEQ ID NO: 6266 - protein, 7 aa, Artificial Sequence
  Synthetic construct
GFGLGCF

SEQ ID NO: 6267 - protein, 7 aa, Artificial Sequence
  Synthetic construct
GFGLGCY

SEQ ID NO: 6268 - protein, 7 aa, Artificial Sequence
  Synthetic construct
GFGLGLF

SEQ ID NO: 6269 - protein, 7 aa, Artificial Sequence
  Synthetic construct
GFGLGLY

SEQ ID NO: 6270 - protein, 7 aa, Artificial Sequence
  Synthetic construct
GFGLGAF

SEQ ID NO: 6271 - protein, 7 aa, Artificial Sequence
  Synthetic construct
GFGLGAY

SEQ ID NO: 6272 - protein, 7 aa, Artificial Sequence
  Synthetic construct
GFGLGQF

SEQ ID NO: 6273 - protein, 7 aa, Artificial Sequence
  Synthetic construct
GFGLGQY

SEQ ID NO: 6274 - protein, 7 aa, Artificial Sequence
  Synthetic construct
GFGLGDF

SEQ ID NO: 6275 - protein, 7 aa, Artificial Sequence
  Synthetic construct
GFGLGDY

SEQ ID NO: 6276 - protein, 7 aa, Artificial Sequence
  Synthetic construct
GFGLGVF

SEQ ID NO: 6277 - protein, 7 aa, Artificial Sequence
  Synthetic construct
GFGLGVY

SEQ ID NO: 6278 - protein, 7 aa, Artificial Sequence
  Synthetic construct
GFGLAFF

SEQ ID NO: 6279 - protein, 7 aa, Artificial Sequence
  Synthetic construct
GFGLAFY

SEQ ID NO: 6280 - protein, 7 aa, Artificial Sequence
  Synthetic construct
GFGLARF

SEQ ID NO: 6281 - protein, 7 aa, Artificial Sequence
  Synthetic construct
GFGLARY

SEQ ID NO: 6282 - protein, 7 aa, Artificial Sequence
  Synthetic construct
GFGLACF

SEQ ID NO: 6283 - protein, 7 aa, Artificial Sequence
  Synthetic construct
GFGLACY

SEQ ID NO: 6284 - protein, 7 aa, Artificial Sequence
  Synthetic construct
GFGLALF

SEQ ID NO: 6285 - protein, 7 aa, Artificial Sequence
  Synthetic construct
GFGLALY

SEQ ID NO: 6286 - protein, 7 aa, Artificial Sequence
  Synthetic construct
GFGLAAF

SEQ ID NO: 6287 - protein, 7 aa, Artificial Sequence
  Synthetic construct
GFGLAAY

SEQ ID NO: 6288 - protein, 7 aa, Artificial Sequence
  Synthetic construct
GFGLAQF

SEQ ID NO: 6289 - protein, 7 aa, Artificial Sequence
  Synthetic construct
GFGLAQY

SEQ ID NO: 6290 - protein, 7 aa, Artificial Sequence
  Synthetic construct
GFGLADF

SEQ ID NO: 6291 - protein, 7 aa, Artificial Sequence
  Synthetic construct
GFGLADY

SEQ ID NO: 6292 - protein, 7 aa, Artificial Sequence
  Synthetic construct
GFGLAVF

SEQ ID NO: 6293 - protein, 7 aa, Artificial Sequence
  Synthetic construct
GFGLAVY

SEQ ID NO: 6294 - protein, 7 aa, Artificial Sequence
  Synthetic construct
GFGLQFF

SEQ ID NO: 6295 - protein, 7 aa, Artificial Sequence
  Synthetic construct
GFGLQFY

SEQ ID NO: 6296 - protein, 7 aa, Artificial Sequence
  Synthetic construct
GFGLQRF

SEQ ID NO: 6297 - protein, 7 aa, Artificial Sequence
  Synthetic construct
GFGLQRY

SEQ ID NO: 6298 - protein, 7 aa, Artificial Sequence
  Synthetic construct
GFGLQCF

SEQ ID NO: 6299 - protein, 7 aa, Artificial Sequence
  Synthetic construct
GFGLQCY

SEQ ID NO: 6300 - protein, 7 aa, Artificial Sequence
  Synthetic construct
GFGLQLF

SEQ ID NO: 6301 - protein, 7 aa, Artificial Sequence
  Synthetic construct
GFGLQLY

SEQ ID NO: 6302 - protein, 7 aa, Artificial Sequence
  Synthetic construct
GFGLQAF

SEQ ID NO: 6303 - protein, 7 aa, Artificial Sequence
  Synthetic construct
GFGLQAY

SEQ ID NO: 6304 - protein, 7 aa, Artificial Sequence
  Synthetic construct
GFGLQQF

SEQ ID NO: 6305 - protein, 7 aa, Artificial Sequence
  Synthetic construct
GFGLQQY

SEQ ID NO: 6306 - protein, 7 aa, Artificial Sequence
  Synthetic construct
GFGLQDF

SEQ ID NO: 6307 - protein, 7 aa, Artificial Sequence
  Synthetic construct
GFGLQDY

SEQ ID NO: 6308 - protein, 7 aa, Artificial Sequence
  Synthetic construct
GFGLQVF

SEQ ID NO: 6309 - protein, 7 aa, Artificial Sequence
  Synthetic construct
GFGLQVY

SEQ ID NO: 6310 - protein, 7 aa, Artificial Sequence
  Synthetic construct
GFGFIFF

SEQ ID NO: 6311 - protein, 7 aa, Artificial Sequence
  Synthetic construct
GFGFIFY

SEQ ID NO: 6312 - protein, 7 aa, Artificial Sequence
  Synthetic construct
GFGFIRF

SEQ ID NO: 6313 - protein, 7 aa, Artificial Sequence
  Synthetic construct
GFGFIRY

SEQ ID NO: 6314 - protein, 7 aa, Artificial Sequence
  Synthetic construct
GFGFICF

SEQ ID NO: 6315 - protein, 7 aa, Artificial Sequence
  Synthetic construct
GFGFICY

SEQ ID NO: 6316 - protein, 7 aa, Artificial Sequence
  Synthetic construct
GFGFILF

SEQ ID NO: 6317 - protein, 7 aa, Artificial Sequence
  Synthetic construct
GFGFILY

SEQ ID NO: 6318 - protein, 7 aa, Artificial Sequence
  Synthetic construct
GFGFIAF

SEQ ID NO: 6319 - protein, 7 aa, Artificial Sequence
  Synthetic construct
GFGFIAY

SEQ ID NO: 6320 - protein, 7 aa, Artificial Sequence
  Synthetic construct
GFGFIQF

SEQ ID NO: 6321 - protein, 7 aa, Artificial Sequence
  Synthetic construct
GFGFIQY

SEQ ID NO: 6322 - protein, 7 aa, Artificial Sequence
  Synthetic construct
GFGFIDF

SEQ ID NO: 6323 - protein, 7 aa, Artificial Sequence
  Synthetic construct
GFGFIDY

SEQ ID NO: 6324 - protein, 7 aa, Artificial Sequence
  Synthetic construct
GFGFIVF

SEQ ID NO: 6325 - protein, 7 aa, Artificial Sequence
  Synthetic construct
GFGFIVY

SEQ ID NO: 6326 - protein, 7 aa, Artificial Sequence
  Synthetic construct
GFGFDFF

SEQ ID NO: 6327 - protein, 7 aa, Artificial Sequence
  Synthetic construct
GFGFDFY

SEQ ID NO: 6328 - protein, 7 aa, Artificial Sequence
  Synthetic construct
GFGFDRF

SEQ ID NO: 6329 - protein, 7 aa, Artificial Sequence
  Synthetic construct
GFGFDRY

SEQ ID NO: 6330 - protein, 7 aa, Artificial Sequence
  Synthetic construct
GFGFDCF

SEQ ID NO: 6331 - protein, 7 aa, Artificial Sequence
  Synthetic construct
GFGFDCY

SEQ ID NO: 6332 - protein, 7 aa, Artificial Sequence
  Synthetic construct
GFGFDLF

SEQ ID NO: 6333 - protein, 7 aa, Artificial Sequence
  Synthetic construct
GFGFDLY

SEQ ID NO: 6334 - protein, 7 aa, Artificial Sequence
  Synthetic construct
GFGFDAF

SEQ ID NO: 6335 - protein, 7 aa, Artificial Sequence
  Synthetic construct
GFGFDAY

SEQ ID NO: 6336 - protein, 7 aa, Artificial Sequence
  Synthetic construct
GFGFDQF

SEQ ID NO: 6337 - protein, 7 aa, Artificial Sequence
  Synthetic construct
GFGFDQY

SEQ ID NO: 6338 - protein, 7 aa, Artificial Sequence
  Synthetic construct
GFGFDDF

SEQ ID NO: 6339 - protein, 7 aa, Artificial Sequence
  Synthetic construct
GFGFDDY

SEQ ID NO: 6340 - protein, 7 aa, Artificial Sequence
  Synthetic construct
GFGFDVF

SEQ ID NO: 6341 - protein, 7 aa, Artificial Sequence
  Synthetic construct
GFGFDVY

SEQ ID NO: 6342 - protein, 7 aa, Artificial Sequence
  Synthetic construct
GFGFYFF

SEQ ID NO: 6343 - protein, 7 aa, Artificial Sequence
  Synthetic construct
GFGFYFY

SEQ ID NO: 6344 - protein, 7 aa, Artificial Sequence
  Synthetic construct
GFGFYRF

SEQ ID NO: 6345 - protein, 7 aa, Artificial Sequence
  Synthetic construct
GFGFYRY

SEQ ID NO: 6346 - protein, 7 aa, Artificial Sequence
  Synthetic construct
GFGFYCF

SEQ ID NO: 6347 - protein, 7 aa, Artificial Sequence
  Synthetic construct
GFGFYCY

SEQ ID NO: 6348 - protein, 7 aa, Artificial Sequence
  Synthetic construct
GFGFYLF

SEQ ID NO: 6349 - protein, 7 aa, Artificial Sequence
  Synthetic construct
GFGFYLY

SEQ ID NO: 6350 - protein, 7 aa, Artificial Sequence
  Synthetic construct
GFGFYAF

SEQ ID NO: 6351 - protein, 7 aa, Artificial Sequence
  Synthetic construct
GFGFYAY

SEQ ID NO: 6352 - protein, 7 aa, Artificial Sequence
  Synthetic construct
GFGFYQF

SEQ ID NO: 6353 - protein, 7 aa, Artificial Sequence
  Synthetic construct
GFGFYQY

SEQ ID NO: 6354 - protein, 7 aa, Artificial Sequence
  Synthetic construct
GFGFYDF

SEQ ID NO: 6355 - protein, 7 aa, Artificial Sequence
  Synthetic construct
GFGFYDY

SEQ ID NO: 6356 - protein, 7 aa, Artificial Sequence
  Synthetic construct
GFGFYVF

SEQ ID NO: 6357 - protein, 7 aa, Artificial Sequence
  Synthetic construct
GFGFYVY

SEQ ID NO: 6358 - protein, 7 aa, Artificial Sequence
  Synthetic construct
GFGFFFF

SEQ ID NO: 6359 - protein, 7 aa, Artificial Sequence
  Synthetic construct
GFGFFFY

SEQ ID NO: 6360 - protein, 7 aa, Artificial Sequence
  Synthetic construct
GFGFFRF

SEQ ID NO: 6361 - protein, 7 aa, Artificial Sequence
  Synthetic construct
GFGFFRY

SEQ ID NO: 6362 - protein, 7 aa, Artificial Sequence
  Synthetic construct
GFGFFCF

SEQ ID NO: 6363 - protein, 7 aa, Artificial Sequence
  Synthetic construct
GFGFFCY

SEQ ID NO: 6364 - protein, 7 aa, Artificial Sequence
  Synthetic construct
GFGFFLF

SEQ ID NO: 6365 - protein, 7 aa, Artificial Sequence
  Synthetic construct
GFGFFLY

SEQ ID NO: 6366 - protein, 7 aa, Artificial Sequence
  Synthetic construct
GFGFFAF

SEQ ID NO: 6367 - protein, 7 aa, Artificial Sequence
  Synthetic construct
GFGFFAY

SEQ ID NO: 6368 - protein, 7 aa, Artificial Sequence
  Synthetic construct
GFGFFQF

SEQ ID NO: 6369 - protein, 7 aa, Artificial Sequence
  Synthetic construct
GFGFFQY

SEQ ID NO: 6370 - protein, 7 aa, Artificial Sequence
  Synthetic construct
GFGFFDF

SEQ ID NO: 6371 - protein, 7 aa, Artificial Sequence
  Synthetic construct
GFGFFDY

SEQ ID NO: 6372 - protein, 7 aa, Artificial Sequence
  Synthetic construct
GFGFFVF

SEQ ID NO: 6373 - protein, 7 aa, Artificial Sequence
  Synthetic construct
GFGFFVY

SEQ ID NO: 6374 - protein, 7 aa, Artificial Sequence
  Synthetic construct
GFGFVFF

SEQ ID NO: 6375 - protein, 7 aa, Artificial Sequence
  Synthetic construct
GFGFVFY

SEQ ID NO: 6376 - protein, 7 aa, Artificial Sequence
  Synthetic construct
GFGFVRF

SEQ ID NO: 6377 - protein, 7 aa, Artificial Sequence
  Synthetic construct
GFGFVRY

SEQ ID NO: 6378 - protein, 7 aa, Artificial Sequence
  Synthetic construct
GFGFVCF

SEQ ID NO: 6379 - protein, 7 aa, Artificial Sequence
  Synthetic construct
GFGFVCY

SEQ ID NO: 6380 - protein, 7 aa, Artificial Sequence
  Synthetic construct
GFGFVLF

SEQ ID NO: 6381 - protein, 7 aa, Artificial Sequence
  Synthetic construct
GFGFVLY

SEQ ID NO: 6382 - protein, 7 aa, Artificial Sequence
  Synthetic construct
GFGFVAF

SEQ ID NO: 6383 - protein, 7 aa, Artificial Sequence
  Synthetic construct
GFGFVAY

SEQ ID NO: 6384 - protein, 7 aa, Artificial Sequence
  Synthetic construct
GFGFVQF

SEQ ID NO: 6385 - protein, 7 aa, Artificial Sequence
  Synthetic construct
GFGFVQY

SEQ ID NO: 6386 - protein, 7 aa, Artificial Sequence
  Synthetic construct
GFGFVDF

SEQ ID NO: 6387 - protein, 7 aa, Artificial Sequence
  Synthetic construct
GFGFVDY

SEQ ID NO: 6388 - protein, 7 aa, Artificial Sequence
  Synthetic construct
GFGFVVF

SEQ ID NO: 6389 - protein, 7 aa, Artificial Sequence
  Synthetic construct
GFGFVVY

SEQ ID NO: 6390 - protein, 7 aa, Artificial Sequence
  Synthetic construct
GFGFTFF

SEQ ID NO: 6391 - protein, 7 aa, Artificial Sequence
  Synthetic construct
GFGFTFY

SEQ ID NO: 6392 - protein, 7 aa, Artificial Sequence
  Synthetic construct
GFGFTRF

SEQ ID NO: 6393 - protein, 7 aa, Artificial Sequence
  Synthetic construct
GFGFTRY

SEQ ID NO: 6394 - protein, 7 aa, Artificial Sequence
  Synthetic construct
GFGFTCF

SEQ ID NO: 6395 - protein, 7 aa, Artificial Sequence
  Synthetic construct
GFGFTCY

SEQ ID NO: 6396 - protein, 7 aa, Artificial Sequence
  Synthetic construct
GFGFTLF

SEQ ID NO: 6397 - protein, 7 aa, Artificial Sequence
  Synthetic construct
GFGFTLY

SEQ ID NO: 6398 - protein, 7 aa, Artificial Sequence
  Synthetic construct
GFGFTAF

SEQ ID NO: 6399 - protein, 7 aa, Artificial Sequence
  Synthetic construct
GFGFTAY

SEQ ID NO: 6400 - protein, 7 aa, Artificial Sequence
  Synthetic construct
GFGFTQF

SEQ ID NO: 6401 - protein, 7 aa, Artificial Sequence
  Synthetic construct
GFGFTQY

SEQ ID NO: 6402 - protein, 7 aa, Artificial Sequence
  Synthetic construct
GFGFTDF

SEQ ID NO: 6403 - protein, 7 aa, Artificial Sequence
  Synthetic construct
GFGFTDY

SEQ ID NO: 6404 - protein, 7 aa, Artificial Sequence
  Synthetic construct
GFGFTVF

SEQ ID NO: 6405 - protein, 7 aa, Artificial Sequence
  Synthetic construct
GFGFTVY

SEQ ID NO: 6406 - protein, 7 aa, Artificial Sequence
  Synthetic construct
GFGFGFF

SEQ ID NO: 6407 - protein, 7 aa, Artificial Sequence
  Synthetic construct
GFGFGFY

SEQ ID NO: 6408 - protein, 7 aa, Artificial Sequence
  Synthetic construct
GFGFGRF

SEQ ID NO: 6409 - protein, 7 aa, Artificial Sequence
  Synthetic construct
GFGFGRY

SEQ ID NO: 6410 - protein, 7 aa, Artificial Sequence
  Synthetic construct
GFGFGCF

SEQ ID NO: 6411 - protein, 7 aa, Artificial Sequence
  Synthetic construct
GFGFGCY

SEQ ID NO: 6412 - protein, 7 aa, Artificial Sequence
  Synthetic construct
GFGFGLF

SEQ ID NO: 6413 - protein, 7 aa, Artificial Sequence
  Synthetic construct
GFGFGLY

SEQ ID NO: 6414 - protein, 7 aa, Artificial Sequence
  Synthetic construct
GFGFGAF

SEQ ID NO: 6415 - protein, 7 aa, Artificial Sequence
  Synthetic construct
GFGFGAY

SEQ ID NO: 6416 - protein, 7 aa, Artificial Sequence
  Synthetic construct
GFGFGQF

SEQ ID NO: 6417 - protein, 7 aa, Artificial Sequence
  Synthetic construct
GFGFGQY

SEQ ID NO: 6418 - protein, 7 aa, Artificial Sequence
  Synthetic construct
GFGFGDF

SEQ ID NO: 6419 - protein, 7 aa, Artificial Sequence
  Synthetic construct
GFGFGDY

SEQ ID NO: 6420 - protein, 7 aa, Artificial Sequence
  Synthetic construct
GFGFGVF

SEQ ID NO: 6421 - protein, 7 aa, Artificial Sequence
  Synthetic construct
GFGFGVY

SEQ ID NO: 6422 - protein, 7 aa, Artificial Sequence
  Synthetic construct
GFGFAFF

SEQ ID NO: 6423 - protein, 7 aa, Artificial Sequence
  Synthetic construct
GFGFAFY

SEQ ID NO: 6424 - protein, 7 aa, Artificial Sequence
  Synthetic construct
GFGFARF

SEQ ID NO: 6425 - protein, 7 aa, Artificial Sequence
  Synthetic construct
GFGFARY

SEQ ID NO: 6426 - protein, 7 aa, Artificial Sequence
  Synthetic construct
GFGFACF

SEQ ID NO: 6427 - protein, 7 aa, Artificial Sequence
  Synthetic construct
GFGFACY

SEQ ID NO: 6428 - protein, 7 aa, Artificial Sequence
  Synthetic construct
GFGFALF

SEQ ID NO: 6429 - protein, 7 aa, Artificial Sequence
  Synthetic construct
GFGFALY

SEQ ID NO: 6430 - protein, 7 aa, Artificial Sequence
  Synthetic construct
GFGFAAF

SEQ ID NO: 6431 - protein, 7 aa, Artificial Sequence
  Synthetic construct
GFGFAAY

SEQ ID NO: 6432 - protein, 7 aa, Artificial Sequence
  Synthetic construct
GFGFAQF

SEQ ID NO: 6433 - protein, 7 aa, Artificial Sequence
  Synthetic construct
GFGFAQY

SEQ ID NO: 6434 - protein, 7 aa, Artificial Sequence
  Synthetic construct
GFGFADF

SEQ ID NO: 6435 - protein, 7 aa, Artificial Sequence
  Synthetic construct
GFGFADY

SEQ ID NO: 6436 - protein, 7 aa, Artificial Sequence
  Synthetic construct
GFGFAVF

SEQ ID NO: 6437 - protein, 7 aa, Artificial Sequence
  Synthetic construct
GFGFAVY

SEQ ID NO: 6438 - protein, 7 aa, Artificial Sequence
  Synthetic construct
GFGFQFF

SEQ ID NO: 6439 - protein, 7 aa, Artificial Sequence
  Synthetic construct
GFGFQFY

SEQ ID NO: 6440 - protein, 7 aa, Artificial Sequence
  Synthetic construct
GFGFQRF

SEQ ID NO: 6441 - protein, 7 aa, Artificial Sequence
  Synthetic construct
GFGFQRY

SEQ ID NO: 6442 - protein, 7 aa, Artificial Sequence
  Synthetic construct
GFGFQCF

SEQ ID NO: 6443 - protein, 7 aa, Artificial Sequence
  Synthetic construct
GFGFQCY

SEQ ID NO: 6444 - protein, 7 aa, Artificial Sequence
  Synthetic construct
GFGFQLF

SEQ ID NO: 6445 - protein, 7 aa, Artificial Sequence
  Synthetic construct
GFGFQLY

SEQ ID NO: 6446 - protein, 7 aa, Artificial Sequence
  Synthetic construct
GFGFQAF

SEQ ID NO: 6447 - protein, 7 aa, Artificial Sequence
  Synthetic construct
GFGFQAY

SEQ ID NO: 6448 - protein, 7 aa, Artificial Sequence
  Synthetic construct
GFGFQQF

SEQ ID NO: 6449 - protein, 7 aa, Artificial Sequence
  Synthetic construct
GFGFQQY

SEQ ID NO: 6450 - protein, 7 aa, Artificial Sequence
  Synthetic construct
GFGFQDF

SEQ ID NO: 6451 - protein, 7 aa, Artificial Sequence
  Synthetic construct
GFGFQDY

SEQ ID NO: 6452 - protein, 7 aa, Artificial Sequence
  Synthetic construct
GFGFQVF

SEQ ID NO: 6453 - protein, 7 aa, Artificial Sequence
  Synthetic construct
GFGFQVY

SEQ ID NO: 6454 - protein, 7 aa, Artificial Sequence
  Synthetic construct
GRIYIFF

SEQ ID NO: 6455 - protein, 7 aa, Artificial Sequence
  Synthetic construct
GRIYIFY

SEQ ID NO: 6456 - protein, 7 aa, Artificial Sequence
  Synthetic construct
GRIYIRF

SEQ ID NO: 6457 - protein, 7 aa, Artificial Sequence
  Synthetic construct
GRIYIRY

SEQ ID NO: 6458 - protein, 7 aa, Artificial Sequence
  Synthetic construct
GRIYICF

SEQ ID NO: 6459 - protein, 7 aa, Artificial Sequence
  Synthetic construct
GRIYICY

SEQ ID NO: 6460 - protein, 7 aa, Artificial Sequence
  Synthetic construct
GRIYILF

SEQ ID NO: 6461 - protein, 7 aa, Artificial Sequence
  Synthetic construct
GRIYILY

SEQ ID NO: 6462 - protein, 7 aa, Artificial Sequence
  Synthetic construct
GRIYIAF

SEQ ID NO: 6463 - protein, 7 aa, Artificial Sequence
  Synthetic construct
GRIYIAY

SEQ ID NO: 6464 - protein, 7 aa, Artificial Sequence
  Synthetic construct
GRIYIQF

SEQ ID NO: 6465 - protein, 7 aa, Artificial Sequence
  Synthetic construct
GRIYIQY

SEQ ID NO: 6466 - protein, 7 aa, Artificial Sequence
  Synthetic construct
GRIYIDF

SEQ ID NO: 6467 - protein, 7 aa, Artificial Sequence
  Synthetic construct
GRIYIDY

SEQ ID NO: 6468 - protein, 7 aa, Artificial Sequence
  Synthetic construct
GRIYIVF

SEQ ID NO: 6469 - protein, 7 aa, Artificial Sequence
  Synthetic construct
GRIYIVY

SEQ ID NO: 6470 - protein, 7 aa, Artificial Sequence
  Synthetic construct
GRIYDFF

SEQ ID NO: 6471 - protein, 7 aa, Artificial Sequence
  Synthetic construct
GRIYDFY

SEQ ID NO: 6472 - protein, 7 aa, Artificial Sequence
  Synthetic construct
GRIYDRF

SEQ ID NO: 6473 - protein, 7 aa, Artificial Sequence
  Synthetic construct
GRIYDRY

SEQ ID NO: 6474 - protein, 7 aa, Artificial Sequence
  Synthetic construct
GRIYDCF

SEQ ID NO: 6475 - protein, 7 aa, Artificial Sequence
  Synthetic construct
GRIYDCY

SEQ ID NO: 6476 - protein, 7 aa, Artificial Sequence
  Synthetic construct
GRIYDLF

SEQ ID NO: 6477 - protein, 7 aa, Artificial Sequence
  Synthetic construct
GRIYDLY

SEQ ID NO: 6478 - protein, 7 aa, Artificial Sequence
  Synthetic construct
GRIYDAF

SEQ ID NO: 6479 - protein, 7 aa, Artificial Sequence
  Synthetic construct
GRIYDAY

SEQ ID NO: 6480 - protein, 7 aa, Artificial Sequence
  Synthetic construct
GRIYDQF

SEQ ID NO: 6481 - protein, 7 aa, Artificial Sequence
  Synthetic construct
GRIYDQY

SEQ ID NO: 6482 - protein, 7 aa, Artificial Sequence
  Synthetic construct
GRIYDDF

SEQ ID NO: 6483 - protein, 7 aa, Artificial Sequence
  Synthetic construct
GRIYDDY

SEQ ID NO: 6484 - protein, 7 aa, Artificial Sequence
  Synthetic construct
GRIYDVF

SEQ ID NO: 6485 - protein, 7 aa, Artificial Sequence
  Synthetic construct
GRIYDVY

SEQ ID NO: 6486 - protein, 7 aa, Artificial Sequence
  Synthetic construct
GRIYYFF

SEQ ID NO: 6487 - protein, 7 aa, Artificial Sequence
  Synthetic construct
GRIYYFY

SEQ ID NO: 6488 - protein, 7 aa, Artificial Sequence
  Synthetic construct
GRIYYRF

SEQ ID NO: 6489 - protein, 7 aa, Artificial Sequence
  Synthetic construct
GRIYYRY

SEQ ID NO: 6490 - protein, 7 aa, Artificial Sequence
  Synthetic construct
GRIYYCF

SEQ ID NO: 6491 - protein, 7 aa, Artificial Sequence
  Synthetic construct
GRIYYCY

SEQ ID NO: 6492 - protein, 7 aa, Artificial Sequence
  Synthetic construct
GRIYYLF

SEQ ID NO: 6493 - protein, 7 aa, Artificial Sequence
  Synthetic construct
GRIYYLY

SEQ ID NO: 6494 - protein, 7 aa, Artificial Sequence
  Synthetic construct
GRIYYAF

SEQ ID NO: 6495 - protein, 7 aa, Artificial Sequence
  Synthetic construct
GRIYYAY

SEQ ID NO: 6496 - protein, 7 aa, Artificial Sequence
  Synthetic construct
GRIYYQF

SEQ ID NO: 6497 - protein, 7 aa, Artificial Sequence
  Synthetic construct
GRIYYQY

SEQ ID NO: 6498 - protein, 7 aa, Artificial Sequence
  Synthetic construct
GRIYYDF

SEQ ID NO: 6499 - protein, 7 aa, Artificial Sequence
  Synthetic construct
GRIYYDY

SEQ ID NO: 6500 - protein, 7 aa, Artificial Sequence
  Synthetic construct
GRIYYVF

SEQ ID NO: 6501 - protein, 7 aa, Artificial Sequence
  Synthetic construct
GRIYYVY

SEQ ID NO: 6502 - protein, 7 aa, Artificial Sequence
  Synthetic construct
GRIYFFF

SEQ ID NO: 6503 - protein, 7 aa, Artificial Sequence
  Synthetic construct
GRIYFFY

SEQ ID NO: 6504 - protein, 7 aa, Artificial Sequence
  Synthetic construct
GRIYFRF

SEQ ID NO: 6505 - protein, 7 aa, Artificial Sequence
  Synthetic construct
GRIYFRY

SEQ ID NO: 6506 - protein, 7 aa, Artificial Sequence
  Synthetic construct
GRIYFCF

SEQ ID NO: 6507 - protein, 7 aa, Artificial Sequence
  Synthetic construct
GRIYFCY

SEQ ID NO: 6508 - protein, 7 aa, Artificial Sequence
  Synthetic construct
GRIYFLF

SEQ ID NO: 6509 - protein, 7 aa, Artificial Sequence
  Synthetic construct
GRIYFLY

SEQ ID NO: 6510 - protein, 7 aa, Artificial Sequence
  Synthetic construct
GRIYFAF

SEQ ID NO: 6511 - protein, 7 aa, Artificial Sequence
  Synthetic construct
GRIYFAY

SEQ ID NO: 6512 - protein, 7 aa, Artificial Sequence
  Synthetic construct
GRIYFQF

SEQ ID NO: 6513 - protein, 7 aa, Artificial Sequence
  Synthetic construct
GRIYFQY

SEQ ID NO: 6514 - protein, 7 aa, Artificial Sequence
  Synthetic construct
GRIYFDF

SEQ ID NO: 6515 - protein, 7 aa, Artificial Sequence
  Synthetic construct
GRIYFDY

SEQ ID NO: 6516 - protein, 7 aa, Artificial Sequence
  Synthetic construct
GRIYFVF

SEQ ID NO: 6517 - protein, 7 aa, Artificial Sequence
  Synthetic construct
GRIYFVY

SEQ ID NO: 6518 - protein, 7 aa, Artificial Sequence
  Synthetic construct
GRIYVFF

SEQ ID NO: 6519 - protein, 7 aa, Artificial Sequence
  Synthetic construct
GRIYVFY

SEQ ID NO: 6520 - protein, 7 aa, Artificial Sequence
  Synthetic construct
GRIYVRF

SEQ ID NO: 6521 - protein, 7 aa, Artificial Sequence
  Synthetic construct
GRIYVRY

SEQ ID NO: 6522 - protein, 7 aa, Artificial Sequence
  Synthetic construct
GRIYVCF

SEQ ID NO: 6523 - protein, 7 aa, Artificial Sequence
  Synthetic construct
GRIYVCY

SEQ ID NO: 6524 - protein, 7 aa, Artificial Sequence
  Synthetic construct
GRIYVLF

SEQ ID NO: 6525 - protein, 7 aa, Artificial Sequence
  Synthetic construct
GRIYVLY

SEQ ID NO: 6526 - protein, 7 aa, Artificial Sequence
  Synthetic construct
GRIYVAF

SEQ ID NO: 6527 - protein, 7 aa, Artificial Sequence
  Synthetic construct
GRIYVAY

SEQ ID NO: 6528 - protein, 7 aa, Artificial Sequence
  Synthetic construct
GRIYVQF

SEQ ID NO: 6529 - protein, 7 aa, Artificial Sequence
  Synthetic construct
GRIYVQY

SEQ ID NO: 6530 - protein, 7 aa, Artificial Sequence
  Synthetic construct
GRIYVDF

SEQ ID NO: 6531 - protein, 7 aa, Artificial Sequence
  Synthetic construct
GRIYVDY

SEQ ID NO: 6532 - protein, 7 aa, Artificial Sequence
  Synthetic construct
GRIYVVF

SEQ ID NO: 6533 - protein, 7 aa, Artificial Sequence
  Synthetic construct
GRIYVVY

SEQ ID NO: 6534 - protein, 7 aa, Artificial Sequence
  Synthetic construct
GRIYTFF

SEQ ID NO: 6535 - protein, 7 aa, Artificial Sequence
  Synthetic construct
GRIYTFY

SEQ ID NO: 6536 - protein, 7 aa, Artificial Sequence
  Synthetic construct
GRIYTRF

SEQ ID NO: 6537 - protein, 7 aa, Artificial Sequence
  Synthetic construct
GRIYTRY

SEQ ID NO: 6538 - protein, 7 aa, Artificial Sequence
  Synthetic construct
GRIYTCF

SEQ ID NO: 6539 - protein, 7 aa, Artificial Sequence
  Synthetic construct
GRIYTCY

SEQ ID NO: 6540 - protein, 7 aa, Artificial Sequence
  Synthetic construct
GRIYTLF

SEQ ID NO: 6541 - protein, 7 aa, Artificial Sequence
  Synthetic construct
GRIYTLY

SEQ ID NO: 6542 - protein, 7 aa, Artificial Sequence
  Synthetic construct
GRIYTAF

SEQ ID NO: 6543 - protein, 7 aa, Artificial Sequence
  Synthetic construct
GRIYTAY

SEQ ID NO: 6544 - protein, 7 aa, Artificial Sequence
  Synthetic construct
GRIYTQF

SEQ ID NO: 6545 - protein, 7 aa, Artificial Sequence
  Synthetic construct
GRIYTQY

SEQ ID NO: 6546 - protein, 7 aa, Artificial Sequence
  Synthetic construct
GRIYTDF

SEQ ID NO: 6547 - protein, 7 aa, Artificial Sequence
  Synthetic construct
GRIYTDY

SEQ ID NO: 6548 - protein, 7 aa, Artificial Sequence
  Synthetic construct
GRIYTVF

SEQ ID NO: 6549 - protein, 7 aa, Artificial Sequence
  Synthetic construct
GRIYTVY

SEQ ID NO: 6550 - protein, 7 aa, Artificial Sequence
  Synthetic construct
GRIYGFF

SEQ ID NO: 6551 - protein, 7 aa, Artificial Sequence
  Synthetic construct
GRIYGFY

SEQ ID NO: 6552 - protein, 7 aa, Artificial Sequence
  Synthetic construct
GRIYGRF

SEQ ID NO: 6553 - protein, 7 aa, Artificial Sequence
  Synthetic construct
GRIYGRY

SEQ ID NO: 6554 - protein, 7 aa, Artificial Sequence
  Synthetic construct
GRIYGCF

SEQ ID NO: 6555 - protein, 7 aa, Artificial Sequence
  Synthetic construct
GRIYGCY

SEQ ID NO: 6556 - protein, 7 aa, Artificial Sequence
  Synthetic construct
GRIYGLF

SEQ ID NO: 6557 - protein, 7 aa, Artificial Sequence
  Synthetic construct
GRIYGLY

SEQ ID NO: 6558 - protein, 7 aa, Artificial Sequence
  Synthetic construct
GRIYGAF

SEQ ID NO: 6559 - protein, 7 aa, Artificial Sequence
  Synthetic construct
GRIYGAY

SEQ ID NO: 6560 - protein, 7 aa, Artificial Sequence
  Synthetic construct
GRIYGQF

SEQ ID NO: 6561 - protein, 7 aa, Artificial Sequence
  Synthetic construct
GRIYGQY

SEQ ID NO: 6562 - protein, 7 aa, Artificial Sequence
  Synthetic construct
GRIYGDF

SEQ ID NO: 6563 - protein, 7 aa, Artificial Sequence
  Synthetic construct
GRIYGDY

SEQ ID NO: 6564 - protein, 7 aa, Artificial Sequence
  Synthetic construct
GRIYGVF

SEQ ID NO: 6565 - protein, 7 aa, Artificial Sequence
  Synthetic construct
GRIYGVY

SEQ ID NO: 6566 - protein, 7 aa, Artificial Sequence
  Synthetic construct
GRIYAFF

SEQ ID NO: 6567 - protein, 7 aa, Artificial Sequence
  Synthetic construct
GRIYAFY

SEQ ID NO: 6568 - protein, 7 aa, Artificial Sequence
  Synthetic construct
GRIYARF

SEQ ID NO: 6569 - protein, 7 aa, Artificial Sequence
  Synthetic construct
GRIYARY

SEQ ID NO: 6570 - protein, 7 aa, Artificial Sequence
  Synthetic construct
GRIYACF

SEQ ID NO: 6571 - protein, 7 aa, Artificial Sequence
  Synthetic construct
GRIYACY

SEQ ID NO: 6572 - protein, 7 aa, Artificial Sequence
  Synthetic construct
GRIYALF

SEQ ID NO: 6573 - protein, 7 aa, Artificial Sequence
  Synthetic construct
GRIYALY

SEQ ID NO: 6574 - protein, 7 aa, Artificial Sequence
  Synthetic construct
GRIYAAF

SEQ ID NO: 6575 - protein, 7 aa, Artificial Sequence
  Synthetic construct
GRIYAAY

SEQ ID NO: 6576 - protein, 7 aa, Artificial Sequence
  Synthetic construct
GRIYAQF

SEQ ID NO: 6577 - protein, 7 aa, Artificial Sequence
  Synthetic construct
GRIYAQY

SEQ ID NO: 6578 - protein, 7 aa, Artificial Sequence
  Synthetic construct
GRIYADF

SEQ ID NO: 6579 - protein, 7 aa, Artificial Sequence
  Synthetic construct
GRIYADY

SEQ ID NO: 6580 - protein, 7 aa, Artificial Sequence
  Synthetic construct
GRIYAVF

SEQ ID NO: 6581 - protein, 7 aa, Artificial Sequence
  Synthetic construct
GRIYAVY

SEQ ID NO: 6582 - protein, 7 aa, Artificial Sequence
  Synthetic construct
GRIYQFF

SEQ ID NO: 6583 - protein, 7 aa, Artificial Sequence
  Synthetic construct
GRIYQFY

SEQ ID NO: 6584 - protein, 7 aa, Artificial Sequence
  Synthetic construct
GRIYQRF

SEQ ID NO: 6585 - protein, 7 aa, Artificial Sequence
  Synthetic construct
GRIYQRY

SEQ ID NO: 6586 - protein, 7 aa, Artificial Sequence
  Synthetic construct
GRIYQCF

SEQ ID NO: 6587 - protein, 7 aa, Artificial Sequence
  Synthetic construct
GRIYQCY

SEQ ID NO: 6588 - protein, 7 aa, Artificial Sequence
  Synthetic construct
GRIYQLF

SEQ ID NO: 6589 - protein, 7 aa, Artificial Sequence
  Synthetic construct
GRIYQLY

SEQ ID NO: 6590 - protein, 7 aa, Artificial Sequence
  Synthetic construct
GRIYQAF

SEQ ID NO: 6591 - protein, 7 aa, Artificial Sequence
  Synthetic construct
GRIYQAY

SEQ ID NO: 6592 - protein, 7 aa, Artificial Sequence
  Synthetic construct
GRIYQQF

SEQ ID NO: 6593 - protein, 7 aa, Artificial Sequence
  Synthetic construct
GRIYQQY

SEQ ID NO: 6594 - protein, 7 aa, Artificial Sequence
  Synthetic construct
GRIYQDF

SEQ ID NO: 6595 - protein, 7 aa, Artificial Sequence
  Synthetic construct
GRIYQDY

SEQ ID NO: 6596 - protein, 7 aa, Artificial Sequence
  Synthetic construct
GRIYQVF

SEQ ID NO: 6597 - protein, 7 aa, Artificial Sequence
  Synthetic construct
GRIYQVY

SEQ ID NO: 6598 - protein, 7 aa, Artificial Sequence
  Synthetic construct
GRIPIFF

SEQ ID NO: 6599 - protein, 7 aa, Artificial Sequence
  Synthetic construct
GRIPIFY

SEQ ID NO: 6600 - protein, 7 aa, Artificial Sequence
  Synthetic construct
GRIPIRF

SEQ ID NO: 6601 - protein, 7 aa, Artificial Sequence
  Synthetic construct
GRIPIRY

SEQ ID NO: 6602 - protein, 7 aa, Artificial Sequence
  Synthetic construct
GRIPICF

SEQ ID NO: 6603 - protein, 7 aa, Artificial Sequence
  Synthetic construct
GRIPICY

SEQ ID NO: 6604 - protein, 7 aa, Artificial Sequence
  Synthetic construct
GRIPILF

SEQ ID NO: 6605 - protein, 7 aa, Artificial Sequence
  Synthetic construct
GRIPILY

SEQ ID NO: 6606 - protein, 7 aa, Artificial Sequence
  Synthetic construct
GRIPIAF

SEQ ID NO: 6607 - protein, 7 aa, Artificial Sequence
  Synthetic construct
GRIPIAY

SEQ ID NO: 6608 - protein, 7 aa, Artificial Sequence
  Synthetic construct
GRIPIQF

SEQ ID NO: 6609 - protein, 7 aa, Artificial Sequence
  Synthetic construct
GRIPIQY

SEQ ID NO: 6610 - protein, 7 aa, Artificial Sequence
  Synthetic construct
GRIPIDF

SEQ ID NO: 6611 - protein, 7 aa, Artificial Sequence
  Synthetic construct
GRIPIDY

SEQ ID NO: 6612 - protein, 7 aa, Artificial Sequence
  Synthetic construct
GRIPIVF

SEQ ID NO: 6613 - protein, 7 aa, Artificial Sequence
  Synthetic construct
GRIPIVY

SEQ ID NO: 6614 - protein, 7 aa, Artificial Sequence
  Synthetic construct
GRIPDFF

SEQ ID NO: 6615 - protein, 7 aa, Artificial Sequence
  Synthetic construct
GRIPDFY

SEQ ID NO: 6616 - protein, 7 aa, Artificial Sequence
  Synthetic construct
GRIPDRF

SEQ ID NO: 6617 - protein, 7 aa, Artificial Sequence
  Synthetic construct
GRIPDRY

SEQ ID NO: 6618 - protein, 7 aa, Artificial Sequence
  Synthetic construct
GRIPDCF

SEQ ID NO: 6619 - protein, 7 aa, Artificial Sequence
  Synthetic construct
GRIPDCY

SEQ ID NO: 6620 - protein, 7 aa, Artificial Sequence
  Synthetic construct
GRIPDLF

SEQ ID NO: 6621 - protein, 7 aa, Artificial Sequence
  Synthetic construct
GRIPDLY

SEQ ID NO: 6622 - protein, 7 aa, Artificial Sequence
  Synthetic construct
GRIPDAF

SEQ ID NO: 6623 - protein, 7 aa, Artificial Sequence
  Synthetic construct
GRIPDAY

SEQ ID NO: 6624 - protein, 7 aa, Artificial Sequence
  Synthetic construct
GRIPDQF

SEQ ID NO: 6625 - protein, 7 aa, Artificial Sequence
  Synthetic construct
GRIPDQY

SEQ ID NO: 6626 - protein, 7 aa, Artificial Sequence
  Synthetic construct
GRIPDDF

SEQ ID NO: 6627 - protein, 7 aa, Artificial Sequence
  Synthetic construct
GRIPDDY

SEQ ID NO: 6628 - protein, 7 aa, Artificial Sequence
  Synthetic construct
GRIPDVF

SEQ ID NO: 6629 - protein, 7 aa, Artificial Sequence
  Synthetic construct
GRIPDVY

SEQ ID NO: 6630 - protein, 7 aa, Artificial Sequence
  Synthetic construct
GRIPYFF

SEQ ID NO: 6631 - protein, 7 aa, Artificial Sequence
  Synthetic construct
GRIPYFY

SEQ ID NO: 6632 - protein, 7 aa, Artificial Sequence
  Synthetic construct
GRIPYRF

SEQ ID NO: 6633 - protein, 7 aa, Artificial Sequence
  Synthetic construct
GRIPYRY

SEQ ID NO: 6634 - protein, 7 aa, Artificial Sequence
  Synthetic construct
GRIPYCF

SEQ ID NO: 6635 - protein, 7 aa, Artificial Sequence
  Synthetic construct
GRIPYCY

SEQ ID NO: 6636 - protein, 7 aa, Artificial Sequence
  Synthetic construct
GRIPYLF

SEQ ID NO: 6637 - protein, 7 aa, Artificial Sequence
  Synthetic construct
GRIPYLY

SEQ ID NO: 6638 - protein, 7 aa, Artificial Sequence
  Synthetic construct
GRIPYAF

SEQ ID NO: 6639 - protein, 7 aa, Artificial Sequence
  Synthetic construct
GRIPYAY

SEQ ID NO: 6640 - protein, 7 aa, Artificial Sequence
  Synthetic construct
GRIPYQF

SEQ ID NO: 6641 - protein, 7 aa, Artificial Sequence
  Synthetic construct
GRIPYQY

SEQ ID NO: 6642 - protein, 7 aa, Artificial Sequence
  Synthetic construct
GRIPYDF

SEQ ID NO: 6643 - protein, 7 aa, Artificial Sequence
  Synthetic construct
GRIPYDY

SEQ ID NO: 6644 - protein, 7 aa, Artificial Sequence
  Synthetic construct
GRIPYVF

SEQ ID NO: 6645 - protein, 7 aa, Artificial Sequence
  Synthetic construct
GRIPYVY

SEQ ID NO: 6646 - protein, 7 aa, Artificial Sequence
  Synthetic construct
GRIPFFF

SEQ ID NO: 6647 - protein, 7 aa, Artificial Sequence
  Synthetic construct
GRIPFFY

SEQ ID NO: 6648 - protein, 7 aa, Artificial Sequence
  Synthetic construct
GRIPFRF

SEQ ID NO: 6649 - protein, 7 aa, Artificial Sequence
  Synthetic construct
GRIPFRY

SEQ ID NO: 6650 - protein, 7 aa, Artificial Sequence
  Synthetic construct
GRIPFCF

SEQ ID NO: 6651 - protein, 7 aa, Artificial Sequence
  Synthetic construct
GRIPFCY

SEQ ID NO: 6652 - protein, 7 aa, Artificial Sequence
  Synthetic construct
GRIPFLF

SEQ ID NO: 6653 - protein, 7 aa, Artificial Sequence
  Synthetic construct
GRIPFLY

SEQ ID NO: 6654 - protein, 7 aa, Artificial Sequence
  Synthetic construct
GRIPFAF

SEQ ID NO: 6655 - protein, 7 aa, Artificial Sequence
  Synthetic construct
GRIPFAY

SEQ ID NO: 6656 - protein, 7 aa, Artificial Sequence
  Synthetic construct
GRIPFQF

SEQ ID NO: 6657 - protein, 7 aa, Artificial Sequence
  Synthetic construct
GRIPFQY

SEQ ID NO: 6658 - protein, 7 aa, Artificial Sequence
  Synthetic construct
GRIPFDF

SEQ ID NO: 6659 - protein, 7 aa, Artificial Sequence
  Synthetic construct
GRIPFDY

SEQ ID NO: 6660 - protein, 7 aa, Artificial Sequence
  Synthetic construct
GRIPFVF

SEQ ID NO: 6661 - protein, 7 aa, Artificial Sequence
  Synthetic construct
GRIPFVY

SEQ ID NO: 6662 - protein, 7 aa, Artificial Sequence
  Synthetic construct
GRIPVFF

SEQ ID NO: 6663 - protein, 7 aa, Artificial Sequence
  Synthetic construct
GRIPVFY

SEQ ID NO: 6664 - protein, 7 aa, Artificial Sequence
  Synthetic construct
GRIPVRF

SEQ ID NO: 6665 - protein, 7 aa, Artificial Sequence
  Synthetic construct
GRIPVRY

SEQ ID NO: 6666 - protein, 7 aa, Artificial Sequence
  Synthetic construct
GRIPVCF

SEQ ID NO: 6667 - protein, 7 aa, Artificial Sequence
  Synthetic construct
GRIPVCY

SEQ ID NO: 6668 - protein, 7 aa, Artificial Sequence
  Synthetic construct
GRIPVLF

SEQ ID NO: 6669 - protein, 7 aa, Artificial Sequence
  Synthetic construct
GRIPVLY

SEQ ID NO: 6670 - protein, 7 aa, Artificial Sequence
  Synthetic construct
GRIPVAF

SEQ ID NO: 6671 - protein, 7 aa, Artificial Sequence
  Synthetic construct
GRIPVAY

SEQ ID NO: 6672 - protein, 7 aa, Artificial Sequence
  Synthetic construct
GRIPVQF

SEQ ID NO: 6673 - protein, 7 aa, Artificial Sequence
  Synthetic construct
GRIPVQY

SEQ ID NO: 6674 - protein, 7 aa, Artificial Sequence
  Synthetic construct
GRIPVDF

SEQ ID NO: 6675 - protein, 7 aa, Artificial Sequence
  Synthetic construct
GRIPVDY

SEQ ID NO: 6676 - protein, 7 aa, Artificial Sequence
  Synthetic construct
GRIPVVF

SEQ ID NO: 6677 - protein, 7 aa, Artificial Sequence
  Synthetic construct
GRIPVVY

SEQ ID NO: 6678 - protein, 7 aa, Artificial Sequence
  Synthetic construct
GRIPTFF

SEQ ID NO: 6679 - protein, 7 aa, Artificial Sequence
  Synthetic construct
GRIPTFY

SEQ ID NO: 6680 - protein, 7 aa, Artificial Sequence
  Synthetic construct
GRIPTRF

SEQ ID NO: 6681 - protein, 7 aa, Artificial Sequence
  Synthetic construct
GRIPTRY

SEQ ID NO: 6682 - protein, 7 aa, Artificial Sequence
  Synthetic construct
GRIPTCF

SEQ ID NO: 6683 - protein, 7 aa, Artificial Sequence
  Synthetic construct
GRIPTCY

SEQ ID NO: 6684 - protein, 7 aa, Artificial Sequence
  Synthetic construct
GRIPTLF

SEQ ID NO: 6685 - protein, 7 aa, Artificial Sequence
  Synthetic construct
GRIPTLY

SEQ ID NO: 6686 - protein, 7 aa, Artificial Sequence
  Synthetic construct
GRIPTAF

SEQ ID NO: 6687 - protein, 7 aa, Artificial Sequence
  Synthetic construct
GRIPTAY

SEQ ID NO: 6688 - protein, 7 aa, Artificial Sequence
  Synthetic construct
GRIPTQF

SEQ ID NO: 6689 - protein, 7 aa, Artificial Sequence
  Synthetic construct
GRIPTQY

SEQ ID NO: 6690 - protein, 7 aa, Artificial Sequence
  Synthetic construct
GRIPTDF

SEQ ID NO: 6691 - protein, 7 aa, Artificial Sequence
  Synthetic construct
GRIPTDY

SEQ ID NO: 6692 - protein, 7 aa, Artificial Sequence
  Synthetic construct
GRIPTVF

SEQ ID NO: 6693 - protein, 7 aa, Artificial Sequence
  Synthetic construct
GRIPTVY

SEQ ID NO: 6694 - protein, 7 aa, Artificial Sequence
  Synthetic construct
GRIPGFF

SEQ ID NO: 6695 - protein, 7 aa, Artificial Sequence
  Synthetic construct
GRIPGFY

SEQ ID NO: 6696 - protein, 7 aa, Artificial Sequence
  Synthetic construct
GRIPGRF

SEQ ID NO: 6697 - protein, 7 aa, Artificial Sequence
  Synthetic construct
GRIPGRY

SEQ ID NO: 6698 - protein, 7 aa, Artificial Sequence
  Synthetic construct
GRIPGCF

SEQ ID NO: 6699 - protein, 7 aa, Artificial Sequence
  Synthetic construct
GRIPGCY

SEQ ID NO: 6700 - protein, 7 aa, Artificial Sequence
  Synthetic construct
GRIPGLF

SEQ ID NO: 6701 - protein, 7 aa, Artificial Sequence
  Synthetic construct
GRIPGLY

SEQ ID NO: 6702 - protein, 7 aa, Artificial Sequence
  Synthetic construct
GRIPGAF

SEQ ID NO: 6703 - protein, 7 aa, Artificial Sequence
  Synthetic construct
GRIPGAY

SEQ ID NO: 6704 - protein, 7 aa, Artificial Sequence
  Synthetic construct
GRIPGQF

SEQ ID NO: 6705 - protein, 7 aa, Artificial Sequence
  Synthetic construct
GRIPGQY

SEQ ID NO: 6706 - protein, 7 aa, Artificial Sequence
  Synthetic construct
GRIPGDF

SEQ ID NO: 6707 - protein, 7 aa, Artificial Sequence
  Synthetic construct
GRIPGDY

SEQ ID NO: 6708 - protein, 7 aa, Artificial Sequence
  Synthetic construct
GRIPGVF

SEQ ID NO: 6709 - protein, 7 aa, Artificial Sequence
  Synthetic construct
GRIPGVY

SEQ ID NO: 6710 - protein, 7 aa, Artificial Sequence
  Synthetic construct
GRIPAFF

SEQ ID NO: 6711 - protein, 7 aa, Artificial Sequence
  Synthetic construct
GRIPAFY

SEQ ID NO: 6712 - protein, 7 aa, Artificial Sequence
  Synthetic construct
GRIPARF

SEQ ID NO: 6713 - protein, 7 aa, Artificial Sequence
  Synthetic construct
GRIPARY

SEQ ID NO: 6714 - protein, 7 aa, Artificial Sequence
  Synthetic construct
GRIPACF

SEQ ID NO: 6715 - protein, 7 aa, Artificial Sequence
  Synthetic construct
GRIPACY

SEQ ID NO: 6716 - protein, 7 aa, Artificial Sequence
  Synthetic construct
GRIPALF

SEQ ID NO: 6717 - protein, 7 aa, Artificial Sequence
  Synthetic construct
GRIPALY

SEQ ID NO: 6718 - protein, 7 aa, Artificial Sequence
  Synthetic construct
GRIPAAF

SEQ ID NO: 6719 - protein, 7 aa, Artificial Sequence
  Synthetic construct
GRIPAAY

SEQ ID NO: 6720 - protein, 7 aa, Artificial Sequence
  Synthetic construct
GRIPAQF

SEQ ID NO: 6721 - protein, 7 aa, Artificial Sequence
  Synthetic construct
GRIPAQY

SEQ ID NO: 6722 - protein, 7 aa, Artificial Sequence
  Synthetic construct
GRIPADF

SEQ ID NO: 6723 - protein, 7 aa, Artificial Sequence
  Synthetic construct
GRIPADY

SEQ ID NO: 6724 - protein, 7 aa, Artificial Sequence
  Synthetic construct
GRIPAVF

SEQ ID NO: 6725 - protein, 7 aa, Artificial Sequence
  Synthetic construct
GRIPAVY

SEQ ID NO: 6726 - protein, 7 aa, Artificial Sequence
  Synthetic construct
GRIPQFF

SEQ ID NO: 6727 - protein, 7 aa, Artificial Sequence
  Synthetic construct
GRIPQFY

SEQ ID NO: 6728 - protein, 7 aa, Artificial Sequence
  Synthetic construct
GRIPQRF

SEQ ID NO: 6729 - protein, 7 aa, Artificial Sequence
  Synthetic construct
GRIPQRY

SEQ ID NO: 6730 - protein, 7 aa, Artificial Sequence
  Synthetic construct
GRIPQCF

SEQ ID NO: 6731 - protein, 7 aa, Artificial Sequence
  Synthetic construct
GRIPQCY

SEQ ID NO: 6732 - protein, 7 aa, Artificial Sequence
  Synthetic construct
GRIPQLF

SEQ ID NO: 6733 - protein, 7 aa, Artificial Sequence
  Synthetic construct
GRIPQLY

SEQ ID NO: 6734 - protein, 7 aa, Artificial Sequence
  Synthetic construct
GRIPQAF

SEQ ID NO: 6735 - protein, 7 aa, Artificial Sequence
  Synthetic construct
GRIPQAY

SEQ ID NO: 6736 - protein, 7 aa, Artificial Sequence
  Synthetic construct
GRIPQQF

SEQ ID NO: 6737 - protein, 7 aa, Artificial Sequence
  Synthetic construct
GRIPQQY

SEQ ID NO: 6738 - protein, 7 aa, Artificial Sequence
  Synthetic construct
GRIPQDF

SEQ ID NO: 6739 - protein, 7 aa, Artificial Sequence
  Synthetic construct
GRIPQDY

SEQ ID NO: 6740 - protein, 7 aa, Artificial Sequence
  Synthetic construct
GRIPQVF

SEQ ID NO: 6741 - protein, 7 aa, Artificial Sequence
  Synthetic construct
GRIPQVY

SEQ ID NO: 6742 - protein, 7 aa, Artificial Sequence
  Synthetic construct
GRIHIFF

SEQ ID NO: 6743 - protein, 7 aa, Artificial Sequence
  Synthetic construct
GRIHIFY

SEQ ID NO: 6744 - protein, 7 aa, Artificial Sequence
  Synthetic construct
GRIHIRF

SEQ ID NO: 6745 - protein, 7 aa, Artificial Sequence
  Synthetic construct
GRIHIRY

SEQ ID NO: 6746 - protein, 7 aa, Artificial Sequence
  Synthetic construct
GRIHICF

SEQ ID NO: 6747 - protein, 7 aa, Artificial Sequence
  Synthetic construct
GRIHICY

SEQ ID NO: 6748 - protein, 7 aa, Artificial Sequence
  Synthetic construct
GRIHILF

SEQ ID NO: 6749 - protein, 7 aa, Artificial Sequence
  Synthetic construct
GRIHILY

SEQ ID NO: 6750 - protein, 7 aa, Artificial Sequence
  Synthetic construct
GRIHIAF

SEQ ID NO: 6751 - protein, 7 aa, Artificial Sequence
  Synthetic construct
GRIHIAY

SEQ ID NO: 6752 - protein, 7 aa, Artificial Sequence
  Synthetic construct
GRIHIQF

SEQ ID NO: 6753 - protein, 7 aa, Artificial Sequence
  Synthetic construct
GRIHIQY

SEQ ID NO: 6754 - protein, 7 aa, Artificial Sequence
  Synthetic construct
GRIHIDF

SEQ ID NO: 6755 - protein, 7 aa, Artificial Sequence
  Synthetic construct
GRIHIDY

SEQ ID NO: 6756 - protein, 7 aa, Artificial Sequence
  Synthetic construct
GRIHIVF

SEQ ID NO: 6757 - protein, 7 aa, Artificial Sequence
  Synthetic construct
GRIHIVY

SEQ ID NO: 6758 - protein, 7 aa, Artificial Sequence
  Synthetic construct
GRIHDFF

SEQ ID NO: 6759 - protein, 7 aa, Artificial Sequence
  Synthetic construct
GRIHDFY

SEQ ID NO: 6760 - protein, 7 aa, Artificial Sequence
  Synthetic construct
GRIHDRF

SEQ ID NO: 6761 - protein, 7 aa, Artificial Sequence
  Synthetic construct
GRIHDRY

SEQ ID NO: 6762 - protein, 7 aa, Artificial Sequence
  Synthetic construct
GRIHDCF

SEQ ID NO: 6763 - protein, 7 aa, Artificial Sequence
  Synthetic construct
GRIHDCY

SEQ ID NO: 6764 - protein, 7 aa, Artificial Sequence
  Synthetic construct
GRIHDLF

SEQ ID NO: 6765 - protein, 7 aa, Artificial Sequence
  Synthetic construct
GRIHDLY

SEQ ID NO: 6766 - protein, 7 aa, Artificial Sequence
  Synthetic construct
GRIHDAF

SEQ ID NO: 6767 - protein, 7 aa, Artificial Sequence
  Synthetic construct
GRIHDAY

SEQ ID NO: 6768 - protein, 7 aa, Artificial Sequence
  Synthetic construct
GRIHDQF

SEQ ID NO: 6769 - protein, 7 aa, Artificial Sequence
  Synthetic construct
GRIHDQY

SEQ ID NO: 6770 - protein, 7 aa, Artificial Sequence
  Synthetic construct
GRIHDDF

SEQ ID NO: 6771 - protein, 7 aa, Artificial Sequence
  Synthetic construct
GRIHDDY

SEQ ID NO: 6772 - protein, 7 aa, Artificial Sequence
  Synthetic construct
GRIHDVF

SEQ ID NO: 6773 - protein, 7 aa, Artificial Sequence
  Synthetic construct
GRIHDVY

SEQ ID NO: 6774 - protein, 7 aa, Artificial Sequence
  Synthetic construct
GRIHYFF

SEQ ID NO: 6775 - protein, 7 aa, Artificial Sequence
  Synthetic construct
GRIHYFY

SEQ ID NO: 6776 - protein, 7 aa, Artificial Sequence
  Synthetic construct
GRIHYRF

SEQ ID NO: 6777 - protein, 7 aa, Artificial Sequence
  Synthetic construct
GRIHYRY

SEQ ID NO: 6778 - protein, 7 aa, Artificial Sequence
  Synthetic construct
GRIHYCF

SEQ ID NO: 6779 - protein, 7 aa, Artificial Sequence
  Synthetic construct
GRIHYCY

SEQ ID NO: 6780 - protein, 7 aa, Artificial Sequence
  Synthetic construct
GRIHYLF

SEQ ID NO: 6781 - protein, 7 aa, Artificial Sequence
  Synthetic construct
GRIHYLY

SEQ ID NO: 6782 - protein, 7 aa, Artificial Sequence
  Synthetic construct
GRIHYAF

SEQ ID NO: 6783 - protein, 7 aa, Artificial Sequence
  Synthetic construct
GRIHYAY

SEQ ID NO: 6784 - protein, 7 aa, Artificial Sequence
  Synthetic construct
GRIHYQF

SEQ ID NO: 6785 - protein, 7 aa, Artificial Sequence
  Synthetic construct
GRIHYQY

SEQ ID NO: 6786 - protein, 7 aa, Artificial Sequence
  Synthetic construct
GRIHYDF

SEQ ID NO: 6787 - protein, 7 aa, Artificial Sequence
  Synthetic construct
GRIHYDY

SEQ ID NO: 6788 - protein, 7 aa, Artificial Sequence
  Synthetic construct
GRIHYVF

SEQ ID NO: 6789 - protein, 7 aa, Artificial Sequence
  Synthetic construct
GRIHYVY

SEQ ID NO: 6790 - protein, 7 aa, Artificial Sequence
  Synthetic construct
GRIHFFF

SEQ ID NO: 6791 - protein, 7 aa, Artificial Sequence
  Synthetic construct
GRIHFFY

SEQ ID NO: 6792 - protein, 7 aa, Artificial Sequence
  Synthetic construct
GRIHFRF

SEQ ID NO: 6793 - protein, 7 aa, Artificial Sequence
  Synthetic construct
GRIHFRY

SEQ ID NO: 6794 - protein, 7 aa, Artificial Sequence
  Synthetic construct
GRIHFCF

SEQ ID NO: 6795 - protein, 7 aa, Artificial Sequence
  Synthetic construct
GRIHFCY

SEQ ID NO: 6796 - protein, 7 aa, Artificial Sequence
  Synthetic construct
GRIHFLF

SEQ ID NO: 6797 - protein, 7 aa, Artificial Sequence
  Synthetic construct
GRIHFLY

SEQ ID NO: 6798 - protein, 7 aa, Artificial Sequence
  Synthetic construct
GRIHFAF

SEQ ID NO: 6799 - protein, 7 aa, Artificial Sequence
  Synthetic construct
GRIHFAY

SEQ ID NO: 6800 - protein, 7 aa, Artificial Sequence
  Synthetic construct
GRIHFQF

SEQ ID NO: 6801 - protein, 7 aa, Artificial Sequence
  Synthetic construct
GRIHFQY

SEQ ID NO: 6802 - protein, 7 aa, Artificial Sequence
  Synthetic construct
GRIHFDF

SEQ ID NO: 6803 - protein, 7 aa, Artificial Sequence
  Synthetic construct
GRIHFDY

SEQ ID NO: 6804 - protein, 7 aa, Artificial Sequence
  Synthetic construct
GRIHFVF

SEQ ID NO: 6805 - protein, 7 aa, Artificial Sequence
  Synthetic construct
GRIHFVY

SEQ ID NO: 6806 - protein, 7 aa, Artificial Sequence
  Synthetic construct
GRIHVFF

SEQ ID NO: 6807 - protein, 7 aa, Artificial Sequence
  Synthetic construct
GRIHVFY

SEQ ID NO: 6808 - protein, 7 aa, Artificial Sequence
  Synthetic construct
GRIHVRF

SEQ ID NO: 6809 - protein, 7 aa, Artificial Sequence
  Synthetic construct
GRIHVRY

SEQ ID NO: 6810 - protein, 7 aa, Artificial Sequence
  Synthetic construct
GRIHVCF

SEQ ID NO: 6811 - protein, 7 aa, Artificial Sequence
  Synthetic construct
GRIHVCY

SEQ ID NO: 6812 - protein, 7 aa, Artificial Sequence
  Synthetic construct
GRIHVLF

SEQ ID NO: 6813 - protein, 7 aa, Artificial Sequence
  Synthetic construct
GRIHVLY

SEQ ID NO: 6814 - protein, 7 aa, Artificial Sequence
  Synthetic construct
GRIHVAF

SEQ ID NO: 6815 - protein, 7 aa, Artificial Sequence
  Synthetic construct
GRIHVAY

SEQ ID NO: 6816 - protein, 7 aa, Artificial Sequence
  Synthetic construct
GRIHVQF

SEQ ID NO: 6817 - protein, 7 aa, Artificial Sequence
  Synthetic construct
GRIHVQY

SEQ ID NO: 6818 - protein, 7 aa, Artificial Sequence
  Synthetic construct
GRIHVDF

SEQ ID NO: 6819 - protein, 7 aa, Artificial Sequence
  Synthetic construct
GRIHVDY

SEQ ID NO: 6820 - protein, 7 aa, Artificial Sequence
  Synthetic construct
GRIHVVF

SEQ ID NO: 6821 - protein, 7 aa, Artificial Sequence
  Synthetic construct
GRIHVVY

SEQ ID NO: 6822 - protein, 7 aa, Artificial Sequence
  Synthetic construct
GRIHTFF

SEQ ID NO: 6823 - protein, 7 aa, Artificial Sequence
  Synthetic construct
GRIHTFY

SEQ ID NO: 6824 - protein, 7 aa, Artificial Sequence
  Synthetic construct
GRIHTRF

SEQ ID NO: 6825 - protein, 7 aa, Artificial Sequence
  Synthetic construct
GRIHTRY

SEQ ID NO: 6826 - protein, 7 aa, Artificial Sequence
  Synthetic construct
GRIHTCF

SEQ ID NO: 6827 - protein, 7 aa, Artificial Sequence
  Synthetic construct
GRIHTCY

SEQ ID NO: 6828 - protein, 7 aa, Artificial Sequence
  Synthetic construct
GRIHTLF

SEQ ID NO: 6829 - protein, 7 aa, Artificial Sequence
  Synthetic construct
GRIHTLY

SEQ ID NO: 6830 - protein, 7 aa, Artificial Sequence
  Synthetic construct
GRIHTAF

SEQ ID NO: 6831 - protein, 7 aa, Artificial Sequence
  Synthetic construct
GRIHTAY

SEQ ID NO: 6832 - protein, 7 aa, Artificial Sequence
  Synthetic construct
GRIHTQF

SEQ ID NO: 6833 - protein, 7 aa, Artificial Sequence
  Synthetic construct
GRIHTQY

SEQ ID NO: 6834 - protein, 7 aa, Artificial Sequence
  Synthetic construct
GRIHTDF

SEQ ID NO: 6835 - protein, 7 aa, Artificial Sequence
  Synthetic construct
GRIHTDY

SEQ ID NO: 6836 - protein, 7 aa, Artificial Sequence
  Synthetic construct
GRIHTVF

SEQ ID NO: 6837 - protein, 7 aa, Artificial Sequence
  Synthetic construct
GRIHTVY

SEQ ID NO: 6838 - protein, 7 aa, Artificial Sequence
  Synthetic construct
GRIHGFF

SEQ ID NO: 6839 - protein, 7 aa, Artificial Sequence
  Synthetic construct
GRIHGFY

SEQ ID NO: 6840 - protein, 7 aa, Artificial Sequence
  Synthetic construct
GRIHGRF

SEQ ID NO: 6841 - protein, 7 aa, Artificial Sequence
  Synthetic construct
GRIHGRY

SEQ ID NO: 6842 - protein, 7 aa, Artificial Sequence
  Synthetic construct
GRIHGCF

SEQ ID NO: 6843 - protein, 7 aa, Artificial Sequence
  Synthetic construct
GRIHGCY

SEQ ID NO: 6844 - protein, 7 aa, Artificial Sequence
  Synthetic construct
GRIHGLF

SEQ ID NO: 6845 - protein, 7 aa, Artificial Sequence
  Synthetic construct
GRIHGLY

SEQ ID NO: 6846 - protein, 7 aa, Artificial Sequence
  Synthetic construct
GRIHGAF

SEQ ID NO: 6847 - protein, 7 aa, Artificial Sequence
  Synthetic construct
GRIHGAY

SEQ ID NO: 6848 - protein, 7 aa, Artificial Sequence
  Synthetic construct
GRIHGQF

SEQ ID NO: 6849 - protein, 7 aa, Artificial Sequence
  Synthetic construct
GRIHGQY

SEQ ID NO: 6850 - protein, 7 aa, Artificial Sequence
  Synthetic construct
GRIHGDF

SEQ ID NO: 6851 - protein, 7 aa, Artificial Sequence
  Synthetic construct
GRIHGDY

SEQ ID NO: 6852 - protein, 7 aa, Artificial Sequence
  Synthetic construct
GRIHGVF

SEQ ID NO: 6853 - protein, 7 aa, Artificial Sequence
  Synthetic construct
GRIHGVY

SEQ ID NO: 6854 - protein, 7 aa, Artificial Sequence
  Synthetic construct
GRIHAFF

SEQ ID NO: 6855 - protein, 7 aa, Artificial Sequence
  Synthetic construct
GRIHAFY

SEQ ID NO: 6856 - protein, 7 aa, Artificial Sequence
  Synthetic construct
GRIHARF

SEQ ID NO: 6857 - protein, 7 aa, Artificial Sequence
  Synthetic construct
GRIHARY

SEQ ID NO: 6858 - protein, 7 aa, Artificial Sequence
  Synthetic construct
GRIHACF

SEQ ID NO: 6859 - protein, 7 aa, Artificial Sequence
  Synthetic construct
GRIHACY

SEQ ID NO: 6860 - protein, 7 aa, Artificial Sequence
  Synthetic construct
GRIHALF

SEQ ID NO: 6861 - protein, 7 aa, Artificial Sequence
  Synthetic construct
GRIHALY

SEQ ID NO: 6862 - protein, 7 aa, Artificial Sequence
  Synthetic construct
GRIHAAF

SEQ ID NO: 6863 - protein, 7 aa, Artificial Sequence
  Synthetic construct
GRIHAAY

SEQ ID NO: 6864 - protein, 7 aa, Artificial Sequence
  Synthetic construct
GRIHAQF

SEQ ID NO: 6865 - protein, 7 aa, Artificial Sequence
  Synthetic construct
GRIHAQY

SEQ ID NO: 6866 - protein, 7 aa, Artificial Sequence
  Synthetic construct
GRIHADF

SEQ ID NO: 6867 - protein, 7 aa, Artificial Sequence
  Synthetic construct
GRIHADY

SEQ ID NO: 6868 - protein, 7 aa, Artificial Sequence
  Synthetic construct
GRIHAVF

SEQ ID NO: 6869 - protein, 7 aa, Artificial Sequence
  Synthetic construct
GRIHAVY

SEQ ID NO: 6870 - protein, 7 aa, Artificial Sequence
  Synthetic construct
GRIHQFF

SEQ ID NO: 6871 - protein, 7 aa, Artificial Sequence
  Synthetic construct
GRIHQFY

SEQ ID NO: 6872 - protein, 7 aa, Artificial Sequence
  Synthetic construct
GRIHQRF

SEQ ID NO: 6873 - protein, 7 aa, Artificial Sequence
  Synthetic construct
GRIHQRY

SEQ ID NO: 6874 - protein, 7 aa, Artificial Sequence
  Synthetic construct
GRIHQCF

SEQ ID NO: 6875 - protein, 7 aa, Artificial Sequence
  Synthetic construct
GRIHQCY

SEQ ID NO: 6876 - protein, 7 aa, Artificial Sequence
  Synthetic construct
GRIHQLF

SEQ ID NO: 6877 - protein, 7 aa, Artificial Sequence
  Synthetic construct
GRIHQLY

SEQ ID NO: 6878 - protein, 7 aa, Artificial Sequence
  Synthetic construct
GRIHQAF

SEQ ID NO: 6879 - protein, 7 aa, Artificial Sequence
  Synthetic construct
GRIHQAY

SEQ ID NO: 6880 - protein, 7 aa, Artificial Sequence
  Synthetic construct
GRIHQQF

SEQ ID NO: 6881 - protein, 7 aa, Artificial Sequence
  Synthetic construct
GRIHQQY

SEQ ID NO: 6882 - protein, 7 aa, Artificial Sequence
  Synthetic construct
GRIHQDF

SEQ ID NO: 6883 - protein, 7 aa, Artificial Sequence
  Synthetic construct
GRIHQDY

SEQ ID NO: 6884 - protein, 7 aa, Artificial Sequence
  Synthetic construct
GRIHQVF

SEQ ID NO: 6885 - protein, 7 aa, Artificial Sequence
  Synthetic construct
GRIHQVY

SEQ ID NO: 6886 - protein, 7 aa, Artificial Sequence
  Synthetic construct
GRILIFF

SEQ ID NO: 6887 - protein, 7 aa, Artificial Sequence
  Synthetic construct
GRILIFY

SEQ ID NO: 6888 - protein, 7 aa, Artificial Sequence
  Synthetic construct
GRILIRF

SEQ ID NO: 6889 - protein, 7 aa, Artificial Sequence
  Synthetic construct
GRILIRY

SEQ ID NO: 6890 - protein, 7 aa, Artificial Sequence
  Synthetic construct
GRILICF

SEQ ID NO: 6891 - protein, 7 aa, Artificial Sequence
  Synthetic construct
GRILICY

SEQ ID NO: 6892 - protein, 7 aa, Artificial Sequence
  Synthetic construct
GRILILF

SEQ ID NO: 6893 - protein, 7 aa, Artificial Sequence
  Synthetic construct
GRILILY

SEQ ID NO: 6894 - protein, 7 aa, Artificial Sequence
  Synthetic construct
GRILIAF

SEQ ID NO: 6895 - protein, 7 aa, Artificial Sequence
  Synthetic construct
GRILIAY

SEQ ID NO: 6896 - protein, 7 aa, Artificial Sequence
  Synthetic construct
GRILIQF

SEQ ID NO: 6897 - protein, 7 aa, Artificial Sequence
  Synthetic construct
GRILIQY

SEQ ID NO: 6898 - protein, 7 aa, Artificial Sequence
  Synthetic construct
GRILIDF

SEQ ID NO: 6899 - protein, 7 aa, Artificial Sequence
  Synthetic construct
GRILIDY

SEQ ID NO: 6900 - protein, 7 aa, Artificial Sequence
  Synthetic construct
GRILIVF

SEQ ID NO: 6901 - protein, 7 aa, Artificial Sequence
  Synthetic construct
GRILIVY

SEQ ID NO: 6902 - protein, 7 aa, Artificial Sequence
  Synthetic construct
GRILDFF

SEQ ID NO: 6903 - protein, 7 aa, Artificial Sequence
  Synthetic construct
GRILDFY

SEQ ID NO: 6904 - protein, 7 aa, Artificial Sequence
  Synthetic construct
GRILDRF

SEQ ID NO: 6905 - protein, 7 aa, Artificial Sequence
  Synthetic construct
GRILDRY

SEQ ID NO: 6906 - protein, 7 aa, Artificial Sequence
  Synthetic construct
GRILDCF

SEQ ID NO: 6907 - protein, 7 aa, Artificial Sequence
  Synthetic construct
GRILDCY

SEQ ID NO: 6908 - protein, 7 aa, Artificial Sequence
  Synthetic construct
GRILDLF

SEQ ID NO: 6909 - protein, 7 aa, Artificial Sequence
  Synthetic construct
GRILDLY

SEQ ID NO: 6910 - protein, 7 aa, Artificial Sequence
  Synthetic construct
GRILDAF

SEQ ID NO: 6911 - protein, 7 aa, Artificial Sequence
  Synthetic construct
GRILDAY

SEQ ID NO: 6912 - protein, 7 aa, Artificial Sequence
  Synthetic construct
GRILDQF

SEQ ID NO: 6913 - protein, 7 aa, Artificial Sequence
  Synthetic construct
GRILDQY

SEQ ID NO: 6914 - protein, 7 aa, Artificial Sequence
  Synthetic construct
GRILDDF

SEQ ID NO: 6915 - protein, 7 aa, Artificial Sequence
  Synthetic construct
GRILDDY

SEQ ID NO: 6916 - protein, 7 aa, Artificial Sequence
  Synthetic construct
GRILDVF

SEQ ID NO: 6917 - protein, 7 aa, Artificial Sequence
  Synthetic construct
GRILDVY

SEQ ID NO: 6918 - protein, 7 aa, Artificial Sequence
  Synthetic construct
GRILYFF

SEQ ID NO: 6919 - protein, 7 aa, Artificial Sequence
  Synthetic construct
GRILYFY

SEQ ID NO: 6920 - protein, 7 aa, Artificial Sequence
  Synthetic construct
GRILYRF

SEQ ID NO: 6921 - protein, 7 aa, Artificial Sequence
  Synthetic construct
GRILYRY

SEQ ID NO: 6922 - protein, 7 aa, Artificial Sequence
  Synthetic construct
GRILYCF

SEQ ID NO: 6923 - protein, 7 aa, Artificial Sequence
  Synthetic construct
GRILYCY

SEQ ID NO: 6924 - protein, 7 aa, Artificial Sequence
  Synthetic construct
GRILYLF

SEQ ID NO: 6925 - protein, 7 aa, Artificial Sequence
  Synthetic construct
GRILYLY

SEQ ID NO: 6926 - protein, 7 aa, Artificial Sequence
  Synthetic construct
GRILYAF

SEQ ID NO: 6927 - protein, 7 aa, Artificial Sequence
  Synthetic construct
GRILYAY

SEQ ID NO: 6928 - protein, 7 aa, Artificial Sequence
  Synthetic construct
GRILYQF

SEQ ID NO: 6929 - protein, 7 aa, Artificial Sequence
  Synthetic construct
GRILYQY

SEQ ID NO: 6930 - protein, 7 aa, Artificial Sequence
  Synthetic construct
GRILYDF

SEQ ID NO: 6931 - protein, 7 aa, Artificial Sequence
  Synthetic construct
GRILYDY

SEQ ID NO: 6932 - protein, 7 aa, Artificial Sequence
  Synthetic construct
GRILYVF

SEQ ID NO: 6933 - protein, 7 aa, Artificial Sequence
  Synthetic construct
GRILYVY

SEQ ID NO: 6934 - protein, 7 aa, Artificial Sequence
  Synthetic construct
GRILFFF

SEQ ID NO: 6935 - protein, 7 aa, Artificial Sequence
  Synthetic construct
GRILFFY

SEQ ID NO: 6936 - protein, 7 aa, Artificial Sequence
  Synthetic construct
GRILFRF

SEQ ID NO: 6937 - protein, 7 aa, Artificial Sequence
  Synthetic construct
GRILFRY

SEQ ID NO: 6938 - protein, 7 aa, Artificial Sequence
  Synthetic construct
GRILFCF

SEQ ID NO: 6939 - protein, 7 aa, Artificial Sequence
  Synthetic construct
GRILFCY

SEQ ID NO: 6940 - protein, 7 aa, Artificial Sequence
  Synthetic construct
GRILFLF

SEQ ID NO: 6941 - protein, 7 aa, Artificial Sequence
  Synthetic construct
GRILFLY

SEQ ID NO: 6942 - protein, 7 aa, Artificial Sequence
  Synthetic construct
GRILFAF

SEQ ID NO: 6943 - protein, 7 aa, Artificial Sequence
  Synthetic construct
GRILFAY

SEQ ID NO: 6944 - protein, 7 aa, Artificial Sequence
  Synthetic construct
GRILFQF

SEQ ID NO: 6945 - protein, 7 aa, Artificial Sequence
  Synthetic construct
GRILFQY

SEQ ID NO: 6946 - protein, 7 aa, Artificial Sequence
  Synthetic construct
GRILFDF

SEQ ID NO: 6947 - protein, 7 aa, Artificial Sequence
  Synthetic construct
GRILFDY

SEQ ID NO: 6948 - protein, 7 aa, Artificial Sequence
  Synthetic construct
GRILFVF

SEQ ID NO: 6949 - protein, 7 aa, Artificial Sequence
  Synthetic construct
GRILFVY

SEQ ID NO: 6950 - protein, 7 aa, Artificial Sequence
  Synthetic construct
GRILVFF

SEQ ID NO: 6951 - protein, 7 aa, Artificial Sequence
  Synthetic construct
GRILVFY

SEQ ID NO: 6952 - protein, 7 aa, Artificial Sequence
  Synthetic construct
GRILVRF

SEQ ID NO: 6953 - protein, 7 aa, Artificial Sequence
  Synthetic construct
GRILVRY

SEQ ID NO: 6954 - protein, 7 aa, Artificial Sequence
  Synthetic construct
GRILVCF

SEQ ID NO: 6955 - protein, 7 aa, Artificial Sequence
  Synthetic construct
GRILVCY

SEQ ID NO: 6956 - protein, 7 aa, Artificial Sequence
  Synthetic construct
GRILVLF

SEQ ID NO: 6957 - protein, 7 aa, Artificial Sequence
  Synthetic construct
GRILVLY

SEQ ID NO: 6958 - protein, 7 aa, Artificial Sequence
  Synthetic construct
GRILVAF

SEQ ID NO: 6959 - protein, 7 aa, Artificial Sequence
  Synthetic construct
GRILVAY

SEQ ID NO: 6960 - protein, 7 aa, Artificial Sequence
  Synthetic construct
GRILVQF

SEQ ID NO: 6961 - protein, 7 aa, Artificial Sequence
  Synthetic construct
GRILVQY

SEQ ID NO: 6962 - protein, 7 aa, Artificial Sequence
  Synthetic construct
GRILVDF

SEQ ID NO: 6963 - protein, 7 aa, Artificial Sequence
  Synthetic construct
GRILVDY

SEQ ID NO: 6964 - protein, 7 aa, Artificial Sequence
  Synthetic construct
GRILVVF

SEQ ID NO: 6965 - protein, 7 aa, Artificial Sequence
  Synthetic construct
GRILVVY

SEQ ID NO: 6966 - protein, 7 aa, Artificial Sequence
  Synthetic construct
GRILTFF

SEQ ID NO: 6967 - protein, 7 aa, Artificial Sequence
  Synthetic construct
GRILTFY

SEQ ID NO: 6968 - protein, 7 aa, Artificial Sequence
  Synthetic construct
GRILTRF

SEQ ID NO: 6969 - protein, 7 aa, Artificial Sequence
  Synthetic construct
GRILTRY

SEQ ID NO: 6970 - protein, 7 aa, Artificial Sequence
  Synthetic construct
GRILTCF

SEQ ID NO: 6971 - protein, 7 aa, Artificial Sequence
  Synthetic construct
GRILTCY

SEQ ID NO: 6972 - protein, 7 aa, Artificial Sequence
  Synthetic construct
GRILTLF

SEQ ID NO: 6973 - protein, 7 aa, Artificial Sequence
  Synthetic construct
GRILTLY

SEQ ID NO: 6974 - protein, 7 aa, Artificial Sequence
  Synthetic construct
GRILTAF

SEQ ID NO: 6975 - protein, 7 aa, Artificial Sequence
  Synthetic construct
GRILTAY

SEQ ID NO: 6976 - protein, 7 aa, Artificial Sequence
  Synthetic construct
GRILTQF

SEQ ID NO: 6977 - protein, 7 aa, Artificial Sequence
  Synthetic construct
GRILTQY

SEQ ID NO: 6978 - protein, 7 aa, Artificial Sequence
  Synthetic construct
GRILTDF

SEQ ID NO: 6979 - protein, 7 aa, Artificial Sequence
  Synthetic construct
GRILTDY

SEQ ID NO: 6980 - protein, 7 aa, Artificial Sequence
  Synthetic construct
GRILTVF

SEQ ID NO: 6981 - protein, 7 aa, Artificial Sequence
  Synthetic construct
GRILTVY

SEQ ID NO: 6982 - protein, 7 aa, Artificial Sequence
  Synthetic construct
GRILGFF

SEQ ID NO: 6983 - protein, 7 aa, Artificial Sequence
  Synthetic construct
GRILGFY

SEQ ID NO: 6984 - protein, 7 aa, Artificial Sequence
  Synthetic construct
GRILGRF

SEQ ID NO: 6985 - protein, 7 aa, Artificial Sequence
  Synthetic construct
GRILGRY

SEQ ID NO: 6986 - protein, 7 aa, Artificial Sequence
  Synthetic construct
GRILGCF

SEQ ID NO: 6987 - protein, 7 aa, Artificial Sequence
  Synthetic construct
GRILGCY

SEQ ID NO: 6988 - protein, 7 aa, Artificial Sequence
  Synthetic construct
GRILGLF

SEQ ID NO: 6989 - protein, 7 aa, Artificial Sequence
  Synthetic construct
GRILGLY

SEQ ID NO: 6990 - protein, 7 aa, Artificial Sequence
  Synthetic construct
GRILGAF

SEQ ID NO: 6991 - protein, 7 aa, Artificial Sequence
  Synthetic construct
GRILGAY

SEQ ID NO: 6992 - protein, 7 aa, Artificial Sequence
  Synthetic construct
GRILGQF

SEQ ID NO: 6993 - protein, 7 aa, Artificial Sequence
  Synthetic construct
GRILGQY

SEQ ID NO: 6994 - protein, 7 aa, Artificial Sequence
  Synthetic construct
GRILGDF

SEQ ID NO: 6995 - protein, 7 aa, Artificial Sequence
  Synthetic construct
GRILGDY

SEQ ID NO: 6996 - protein, 7 aa, Artificial Sequence
  Synthetic construct
GRILGVF

SEQ ID NO: 6997 - protein, 7 aa, Artificial Sequence
  Synthetic construct
GRILGVY

SEQ ID NO: 6998 - protein, 7 aa, Artificial Sequence
  Synthetic construct
GRILAFF

SEQ ID NO: 6999 - protein, 7 aa, Artificial Sequence
  Synthetic construct
GRILAFY

SEQ ID NO: 7000 - protein, 7 aa, Artificial Sequence
  Synthetic construct
GRILARF

SEQ ID NO: 7001 - protein, 7 aa, Artificial Sequence
  Synthetic construct
GRILARY

SEQ ID NO: 7002 - protein, 7 aa, Artificial Sequence
  Synthetic construct
GRILACF

SEQ ID NO: 7003 - protein, 7 aa, Artificial Sequence
  Synthetic construct
GRILACY

SEQ ID NO: 7004 - protein, 7 aa, Artificial Sequence
  Synthetic construct
GRILALF

SEQ ID NO: 7005 - protein, 7 aa, Artificial Sequence
  Synthetic construct
GRILALY

SEQ ID NO: 7006 - protein, 7 aa, Artificial Sequence
  Synthetic construct
GRILAAF

SEQ ID NO: 7007 - protein, 7 aa, Artificial Sequence
  Synthetic construct
GRILAAY

SEQ ID NO: 7008 - protein, 7 aa, Artificial Sequence
  Synthetic construct
GRILAQF

SEQ ID NO: 7009 - protein, 7 aa, Artificial Sequence
  Synthetic construct
GRILAQY

SEQ ID NO: 7010 - protein, 7 aa, Artificial Sequence
  Synthetic construct
GRILADF

SEQ ID NO: 7011 - protein, 7 aa, Artificial Sequence
  Synthetic construct
GRILADY

SEQ ID NO: 7012 - protein, 7 aa, Artificial Sequence
  Synthetic construct
GRILAVF

SEQ ID NO: 7013 - protein, 7 aa, Artificial Sequence
  Synthetic construct
GRILAVY

SEQ ID NO: 7014 - protein, 7 aa, Artificial Sequence
  Synthetic construct
GRILQFF

SEQ ID NO: 7015 - protein, 7 aa, Artificial Sequence
  Synthetic construct
GRILQFY

SEQ ID NO: 7016 - protein, 7 aa, Artificial Sequence
  Synthetic construct
GRILQRF

SEQ ID NO: 7017 - protein, 7 aa, Artificial Sequence
  Synthetic construct
GRILQRY

SEQ ID NO: 7018 - protein, 7 aa, Artificial Sequence
  Synthetic construct
GRILQCF

SEQ ID NO: 7019 - protein, 7 aa, Artificial Sequence
  Synthetic construct
GRILQCY

SEQ ID NO: 7020 - protein, 7 aa, Artificial Sequence
  Synthetic construct
GRILQLF

SEQ ID NO: 7021 - protein, 7 aa, Artificial Sequence
  Synthetic construct
GRILQLY

SEQ ID NO: 7022 - protein, 7 aa, Artificial Sequence
  Synthetic construct
GRILQAF

SEQ ID NO: 7023 - protein, 7 aa, Artificial Sequence
  Synthetic construct
GRILQAY

SEQ ID NO: 7024 - protein, 7 aa, Artificial Sequence
  Synthetic construct
GRILQQF

SEQ ID NO: 7025 - protein, 7 aa, Artificial Sequence
  Synthetic construct
GRILQQY

SEQ ID NO: 7026 - protein, 7 aa, Artificial Sequence
  Synthetic construct
GRILQDF

SEQ ID NO: 7027 - protein, 7 aa, Artificial Sequence
  Synthetic construct
GRILQDY

SEQ ID NO: 7028 - protein, 7 aa, Artificial Sequence
  Synthetic construct
GRILQVF

SEQ ID NO: 7029 - protein, 7 aa, Artificial Sequence
  Synthetic construct
GRILQVY

SEQ ID NO: 7030 - protein, 7 aa, Artificial Sequence
  Synthetic construct
GRIFIFF

SEQ ID NO: 7031 - protein, 7 aa, Artificial Sequence
  Synthetic construct
GRIFIFY

SEQ ID NO: 7032 - protein, 7 aa, Artificial Sequence
  Synthetic construct
GRIFIRF

SEQ ID NO: 7033 - protein, 7 aa, Artificial Sequence
  Synthetic construct
GRIFIRY

SEQ ID NO: 7034 - protein, 7 aa, Artificial Sequence
  Synthetic construct
GRIFICF

SEQ ID NO: 7035 - protein, 7 aa, Artificial Sequence
  Synthetic construct
GRIFICY

SEQ ID NO: 7036 - protein, 7 aa, Artificial Sequence
  Synthetic construct
GRIFILF

SEQ ID NO: 7037 - protein, 7 aa, Artificial Sequence
  Synthetic construct
GRIFILY

SEQ ID NO: 7038 - protein, 7 aa, Artificial Sequence
  Synthetic construct
GRIFIAF

SEQ ID NO: 7039 - protein, 7 aa, Artificial Sequence
  Synthetic construct
GRIFIAY

SEQ ID NO: 7040 - protein, 7 aa, Artificial Sequence
  Synthetic construct
GRIFIQF

SEQ ID NO: 7041 - protein, 7 aa, Artificial Sequence
  Synthetic construct
GRIFIQY

SEQ ID NO: 7042 - protein, 7 aa, Artificial Sequence
  Synthetic construct
GRIFIDF

SEQ ID NO: 7043 - protein, 7 aa, Artificial Sequence
  Synthetic construct
GRIFIDY

SEQ ID NO: 7044 - protein, 7 aa, Artificial Sequence
  Synthetic construct
GRIFIVF

SEQ ID NO: 7045 - protein, 7 aa, Artificial Sequence
  Synthetic construct
GRIFIVY

SEQ ID NO: 7046 - protein, 7 aa, Artificial Sequence
  Synthetic construct
GRIFDFF

SEQ ID NO: 7047 - protein, 7 aa, Artificial Sequence
  Synthetic construct
GRIFDFY

SEQ ID NO: 7048 - protein, 7 aa, Artificial Sequence
  Synthetic construct
GRIFDRF

SEQ ID NO: 7049 - protein, 7 aa, Artificial Sequence
  Synthetic construct
GRIFDRY

SEQ ID NO: 7050 - protein, 7 aa, Artificial Sequence
  Synthetic construct
GRIFDCF

SEQ ID NO: 7051 - protein, 7 aa, Artificial Sequence
  Synthetic construct
GRIFDCY

SEQ ID NO: 7052 - protein, 7 aa, Artificial Sequence
  Synthetic construct
GRIFDLF

SEQ ID NO: 7053 - protein, 7 aa, Artificial Sequence
  Synthetic construct
GRIFDLY

SEQ ID NO: 7054 - protein, 7 aa, Artificial Sequence
  Synthetic construct
GRIFDAF

SEQ ID NO: 7055 - protein, 7 aa, Artificial Sequence
  Synthetic construct
GRIFDAY

SEQ ID NO: 7056 - protein, 7 aa, Artificial Sequence
  Synthetic construct
GRIFDQF

SEQ ID NO: 7057 - protein, 7 aa, Artificial Sequence
  Synthetic construct
GRIFDQY

SEQ ID NO: 7058 - protein, 7 aa, Artificial Sequence
  Synthetic construct
GRIFDDF

SEQ ID NO: 7059 - protein, 7 aa, Artificial Sequence
  Synthetic construct
GRIFDDY

SEQ ID NO: 7060 - protein, 7 aa, Artificial Sequence
  Synthetic construct
GRIFDVF

SEQ ID NO: 7061 - protein, 7 aa, Artificial Sequence
  Synthetic construct
GRIFDVY

SEQ ID NO: 7062 - protein, 7 aa, Artificial Sequence
  Synthetic construct
GRIFYFF

SEQ ID NO: 7063 - protein, 7 aa, Artificial Sequence
  Synthetic construct
GRIFYFY

SEQ ID NO: 7064 - protein, 7 aa, Artificial Sequence
  Synthetic construct
GRIFYRF

SEQ ID NO: 7065 - protein, 7 aa, Artificial Sequence
  Synthetic construct
GRIFYRY

SEQ ID NO: 7066 - protein, 7 aa, Artificial Sequence
  Synthetic construct
GRIFYCF

SEQ ID NO: 7067 - protein, 7 aa, Artificial Sequence
  Synthetic construct
GRIFYCY

SEQ ID NO: 7068 - protein, 7 aa, Artificial Sequence
  Synthetic construct
GRIFYLF

SEQ ID NO: 7069 - protein, 7 aa, Artificial Sequence
  Synthetic construct
GRIFYLY

SEQ ID NO: 7070 - protein, 7 aa, Artificial Sequence
  Synthetic construct
GRIFYAF

SEQ ID NO: 7071 - protein, 7 aa, Artificial Sequence
  Synthetic construct
GRIFYAY

SEQ ID NO: 7072 - protein, 7 aa, Artificial Sequence
  Synthetic construct
GRIFYQF

SEQ ID NO: 7073 - protein, 7 aa, Artificial Sequence
  Synthetic construct
GRIFYQY

SEQ ID NO: 7074 - protein, 7 aa, Artificial Sequence
  Synthetic construct
GRIFYDF

SEQ ID NO: 7075 - protein, 7 aa, Artificial Sequence
  Synthetic construct
GRIFYDY

SEQ ID NO: 7076 - protein, 7 aa, Artificial Sequence
  Synthetic construct
GRIFYVF

SEQ ID NO: 7077 - protein, 7 aa, Artificial Sequence
  Synthetic construct
GRIFYVY

SEQ ID NO: 7078 - protein, 7 aa, Artificial Sequence
  Synthetic construct
GRIFFFF

SEQ ID NO: 7079 - protein, 7 aa, Artificial Sequence
  Synthetic construct
GRIFFFY

SEQ ID NO: 7080 - protein, 7 aa, Artificial Sequence
  Synthetic construct
GRIFFRF

SEQ ID NO: 7081 - protein, 7 aa, Artificial Sequence
  Synthetic construct
GRIFFRY

SEQ ID NO: 7082 - protein, 7 aa, Artificial Sequence
  Synthetic construct
GRIFFCF

SEQ ID NO: 7083 - protein, 7 aa, Artificial Sequence
  Synthetic construct
GRIFFCY

SEQ ID NO: 7084 - protein, 7 aa, Artificial Sequence
  Synthetic construct
GRIFFLF

SEQ ID NO: 7085 - protein, 7 aa, Artificial Sequence
  Synthetic construct
GRIFFLY

SEQ ID NO: 7086 - protein, 7 aa, Artificial Sequence
  Synthetic construct
GRIFFAF

SEQ ID NO: 7087 - protein, 7 aa, Artificial Sequence
  Synthetic construct
GRIFFAY

SEQ ID NO: 7088 - protein, 7 aa, Artificial Sequence
  Synthetic construct
GRIFFQF

SEQ ID NO: 7089 - protein, 7 aa, Artificial Sequence
  Synthetic construct
GRIFFQY

SEQ ID NO: 7090 - protein, 7 aa, Artificial Sequence
  Synthetic construct
GRIFFDF

SEQ ID NO: 7091 - protein, 7 aa, Artificial Sequence
  Synthetic construct
GRIFFDY

SEQ ID NO: 7092 - protein, 7 aa, Artificial Sequence
  Synthetic construct
GRIFFVF

SEQ ID NO: 7093 - protein, 7 aa, Artificial Sequence
  Synthetic construct
GRIFFVY

SEQ ID NO: 7094 - protein, 7 aa, Artificial Sequence
  Synthetic construct
GRIFVFF

SEQ ID NO: 7095 - protein, 7 aa, Artificial Sequence
  Synthetic construct
GRIFVFY

SEQ ID NO: 7096 - protein, 7 aa, Artificial Sequence
  Synthetic construct
GRIFVRF

SEQ ID NO: 7097 - protein, 7 aa, Artificial Sequence
  Synthetic construct
GRIFVRY

SEQ ID NO: 7098 - protein, 7 aa, Artificial Sequence
  Synthetic construct
GRIFVCF

SEQ ID NO: 7099 - protein, 7 aa, Artificial Sequence
  Synthetic construct
GRIFVCY

SEQ ID NO: 7100 - protein, 7 aa, Artificial Sequence
  Synthetic construct
GRIFVLF

SEQ ID NO: 7101 - protein, 7 aa, Artificial Sequence
  Synthetic construct
GRIFVLY

SEQ ID NO: 7102 - protein, 7 aa, Artificial Sequence
  Synthetic construct
GRIFVAF

SEQ ID NO: 7103 - protein, 7 aa, Artificial Sequence
  Synthetic construct
GRIFVAY

SEQ ID NO: 7104 - protein, 7 aa, Artificial Sequence
  Synthetic construct
GRIFVQF

SEQ ID NO: 7105 - protein, 7 aa, Artificial Sequence
  Synthetic construct
GRIFVQY

SEQ ID NO: 7106 - protein, 7 aa, Artificial Sequence
  Synthetic construct
GRIFVDF

SEQ ID NO: 7107 - protein, 7 aa, Artificial Sequence
  Synthetic construct
GRIFVDY

SEQ ID NO: 7108 - protein, 7 aa, Artificial Sequence
  Synthetic construct
GRIFVVF

SEQ ID NO: 7109 - protein, 7 aa, Artificial Sequence
  Synthetic construct
GRIFVVY

SEQ ID NO: 7110 - protein, 7 aa, Artificial Sequence
  Synthetic construct
GRIFTFF

SEQ ID NO: 7111 - protein, 7 aa, Artificial Sequence
  Synthetic construct
GRIFTFY

SEQ ID NO: 7112 - protein, 7 aa, Artificial Sequence
  Synthetic construct
GRIFTRF

SEQ ID NO: 7113 - protein, 7 aa, Artificial Sequence
  Synthetic construct
GRIFTRY

SEQ ID NO: 7114 - protein, 7 aa, Artificial Sequence
  Synthetic construct
GRIFTCF

SEQ ID NO: 7115 - protein, 7 aa, Artificial Sequence
  Synthetic construct
GRIFTCY

SEQ ID NO: 7116 - protein, 7 aa, Artificial Sequence
  Synthetic construct
GRIFTLF

SEQ ID NO: 7117 - protein, 7 aa, Artificial Sequence
  Synthetic construct
GRIFTLY

SEQ ID NO: 7118 - protein, 7 aa, Artificial Sequence
  Synthetic construct
GRIFTAF

SEQ ID NO: 7119 - protein, 7 aa, Artificial Sequence
  Synthetic construct
GRIFTAY

SEQ ID NO: 7120 - protein, 7 aa, Artificial Sequence
  Synthetic construct
GRIFTQF

SEQ ID NO: 7121 - protein, 7 aa, Artificial Sequence
  Synthetic construct
GRIFTQY

SEQ ID NO: 7122 - protein, 7 aa, Artificial Sequence
  Synthetic construct
GRIFTDF

SEQ ID NO: 7123 - protein, 7 aa, Artificial Sequence
  Synthetic construct
GRIFTDY

SEQ ID NO: 7124 - protein, 7 aa, Artificial Sequence
  Synthetic construct
GRIFTVF

SEQ ID NO: 7125 - protein, 7 aa, Artificial Sequence
  Synthetic construct
GRIFTVY

SEQ ID NO: 7126 - protein, 7 aa, Artificial Sequence
  Synthetic construct
GRIFGFF

SEQ ID NO: 7127 - protein, 7 aa, Artificial Sequence
  Synthetic construct
GRIFGFY

SEQ ID NO: 7128 - protein, 7 aa, Artificial Sequence
  Synthetic construct
GRIFGRF

SEQ ID NO: 7129 - protein, 7 aa, Artificial Sequence
  Synthetic construct
GRIFGRY

SEQ ID NO: 7130 - protein, 7 aa, Artificial Sequence
  Synthetic construct
GRIFGCF

SEQ ID NO: 7131 - protein, 7 aa, Artificial Sequence
  Synthetic construct
GRIFGCY

SEQ ID NO: 7132 - protein, 7 aa, Artificial Sequence
  Synthetic construct
GRIFGLF

SEQ ID NO: 7133 - protein, 7 aa, Artificial Sequence
  Synthetic construct
GRIFGLY

SEQ ID NO: 7134 - protein, 7 aa, Artificial Sequence
  Synthetic construct
GRIFGAF

SEQ ID NO: 7135 - protein, 7 aa, Artificial Sequence
  Synthetic construct
GRIFGAY

SEQ ID NO: 7136 - protein, 7 aa, Artificial Sequence
  Synthetic construct
GRIFGQF

SEQ ID NO: 7137 - protein, 7 aa, Artificial Sequence
  Synthetic construct
GRIFGQY

SEQ ID NO: 7138 - protein, 7 aa, Artificial Sequence
  Synthetic construct
GRIFGDF

SEQ ID NO: 7139 - protein, 7 aa, Artificial Sequence
  Synthetic construct
GRIFGDY

SEQ ID NO: 7140 - protein, 7 aa, Artificial Sequence
  Synthetic construct
GRIFGVF

SEQ ID NO: 7141 - protein, 7 aa, Artificial Sequence
  Synthetic construct
GRIFGVY

SEQ ID NO: 7142 - protein, 7 aa, Artificial Sequence
  Synthetic construct
GRIFAFF

SEQ ID NO: 7143 - protein, 7 aa, Artificial Sequence
  Synthetic construct
GRIFAFY

SEQ ID NO: 7144 - protein, 7 aa, Artificial Sequence
  Synthetic construct
GRIFARF

SEQ ID NO: 7145 - protein, 7 aa, Artificial Sequence
  Synthetic construct
GRIFARY

SEQ ID NO: 7146 - protein, 7 aa, Artificial Sequence
  Synthetic construct
GRIFACF

SEQ ID NO: 7147 - protein, 7 aa, Artificial Sequence
  Synthetic construct
GRIFACY

SEQ ID NO: 7148 - protein, 7 aa, Artificial Sequence
  Synthetic construct
GRIFALF

SEQ ID NO: 7149 - protein, 7 aa, Artificial Sequence
  Synthetic construct
GRIFALY

SEQ ID NO: 7150 - protein, 7 aa, Artificial Sequence
  Synthetic construct
GRIFAAF

SEQ ID NO: 7151 - protein, 7 aa, Artificial Sequence
  Synthetic construct
GRIFAAY

SEQ ID NO: 7152 - protein, 7 aa, Artificial Sequence
  Synthetic construct
GRIFAQF

SEQ ID NO: 7153 - protein, 7 aa, Artificial Sequence
  Synthetic construct
GRIFAQY

SEQ ID NO: 7154 - protein, 7 aa, Artificial Sequence
  Synthetic construct
GRIFADF

SEQ ID NO: 7155 - protein, 7 aa, Artificial Sequence
  Synthetic construct
GRIFADY

SEQ ID NO: 7156 - protein, 7 aa, Artificial Sequence
  Synthetic construct
GRIFAVF

SEQ ID NO: 7157 - protein, 7 aa, Artificial Sequence
  Synthetic construct
GRIFAVY

SEQ ID NO: 7158 - protein, 7 aa, Artificial Sequence
  Synthetic construct
GRIFQFF

SEQ ID NO: 7159 - protein, 7 aa, Artificial Sequence
  Synthetic construct
GRIFQFY

SEQ ID NO: 7160 - protein, 7 aa, Artificial Sequence
  Synthetic construct
GRIFQRF

SEQ ID NO: 7161 - protein, 7 aa, Artificial Sequence
  Synthetic construct
GRIFQRY

SEQ ID NO: 7162 - protein, 7 aa, Artificial Sequence
  Synthetic construct
GRIFQCF

SEQ ID NO: 7163 - protein, 7 aa, Artificial Sequence
  Synthetic construct
GRIFQCY

SEQ ID NO: 7164 - protein, 7 aa, Artificial Sequence
  Synthetic construct
GRIFQLF

SEQ ID NO: 7165 - protein, 7 aa, Artificial Sequence
  Synthetic construct
GRIFQLY

SEQ ID NO: 7166 - protein, 7 aa, Artificial Sequence
  Synthetic construct
GRIFQAF

SEQ ID NO: 7167 - protein, 7 aa, Artificial Sequence
  Synthetic construct
GRIFQAY

SEQ ID NO: 7168 - protein, 7 aa, Artificial Sequence
  Synthetic construct
GRIFQQF

SEQ ID NO: 7169 - protein, 7 aa, Artificial Sequence
  Synthetic construct
GRIFQQY

SEQ ID NO: 7170 - protein, 7 aa, Artificial Sequence
  Synthetic construct
GRIFQDF

SEQ ID NO: 7171 - protein, 7 aa, Artificial Sequence
  Synthetic construct
GRIFQDY

SEQ ID NO: 7172 - protein, 7 aa, Artificial Sequence
  Synthetic construct
GRIFQVF

SEQ ID NO: 7173 - protein, 7 aa, Artificial Sequence
  Synthetic construct
GRIFQVY

SEQ ID NO: 7174 - protein, 7 aa, Artificial Sequence
  Synthetic construct
GRGYIFF

SEQ ID NO: 7175 - protein, 7 aa, Artificial Sequence
  Synthetic construct
GRGYIFY

SEQ ID NO: 7176 - protein, 7 aa, Artificial Sequence
  Synthetic construct
GRGYIRF

SEQ ID NO: 7177 - protein, 7 aa, Artificial Sequence
  Synthetic construct
GRGYIRY

SEQ ID NO: 7178 - protein, 7 aa, Artificial Sequence
  Synthetic construct
GRGYICF

SEQ ID NO: 7179 - protein, 7 aa, Artificial Sequence
  Synthetic construct
GRGYICY

SEQ ID NO: 7180 - protein, 7 aa, Artificial Sequence
  Synthetic construct
GRGYILF

SEQ ID NO: 7181 - protein, 7 aa, Artificial Sequence
  Synthetic construct
GRGYILY

SEQ ID NO: 7182 - protein, 7 aa, Artificial Sequence
  Synthetic construct
GRGYIAF

SEQ ID NO: 7183 - protein, 7 aa, Artificial Sequence
  Synthetic construct
GRGYIAY

SEQ ID NO: 7184 - protein, 7 aa, Artificial Sequence
  Synthetic construct
GRGYIQF

SEQ ID NO: 7185 - protein, 7 aa, Artificial Sequence
  Synthetic construct
GRGYIQY

SEQ ID NO: 7186 - protein, 7 aa, Artificial Sequence
  Synthetic construct
GRGYIDF

SEQ ID NO: 7187 - protein, 7 aa, Artificial Sequence
  Synthetic construct
GRGYIDY

SEQ ID NO: 7188 - protein, 7 aa, Artificial Sequence
  Synthetic construct
GRGYIVF

SEQ ID NO: 7189 - protein, 7 aa, Artificial Sequence
  Synthetic construct
GRGYIVY

SEQ ID NO: 7190 - protein, 7 aa, Artificial Sequence
  Synthetic construct
GRGYDFF

SEQ ID NO: 7191 - protein, 7 aa, Artificial Sequence
  Synthetic construct
GRGYDFY

SEQ ID NO: 7192 - protein, 7 aa, Artificial Sequence
  Synthetic construct
GRGYDRF

SEQ ID NO: 7193 - protein, 7 aa, Artificial Sequence
  Synthetic construct
GRGYDRY

SEQ ID NO: 7194 - protein, 7 aa, Artificial Sequence
  Synthetic construct
GRGYDCF

SEQ ID NO: 7195 - protein, 7 aa, Artificial Sequence
  Synthetic construct
GRGYDCY

SEQ ID NO: 7196 - protein, 7 aa, Artificial Sequence
  Synthetic construct
GRGYDLF

SEQ ID NO: 7197 - protein, 7 aa, Artificial Sequence
  Synthetic construct
GRGYDLY

SEQ ID NO: 7198 - protein, 7 aa, Artificial Sequence
  Synthetic construct
GRGYDAF

SEQ ID NO: 7199 - protein, 7 aa, Artificial Sequence
  Synthetic construct
GRGYDAY

SEQ ID NO: 7200 - protein, 7 aa, Artificial Sequence
  Synthetic construct
GRGYDQF

SEQ ID NO: 7201 - protein, 7 aa, Artificial Sequence
  Synthetic construct
GRGYDQY

SEQ ID NO: 7202 - protein, 7 aa, Artificial Sequence
  Synthetic construct
GRGYDDF

SEQ ID NO: 7203 - protein, 7 aa, Artificial Sequence
  Synthetic construct
GRGYDDY

SEQ ID NO: 7204 - protein, 7 aa, Artificial Sequence
  Synthetic construct
GRGYDVF

SEQ ID NO: 7205 - protein, 7 aa, Artificial Sequence
  Synthetic construct
GRGYDVY

SEQ ID NO: 7206 - protein, 7 aa, Artificial Sequence
  Synthetic construct
GRGYYFF

SEQ ID NO: 7207 - protein, 7 aa, Artificial Sequence
  Synthetic construct
GRGYYFY

SEQ ID NO: 7208 - protein, 7 aa, Artificial Sequence
  Synthetic construct
GRGYYRF

SEQ ID NO: 7209 - protein, 7 aa, Artificial Sequence
  Synthetic construct
GRGYYRY

SEQ ID NO: 7210 - protein, 7 aa, Artificial Sequence
  Synthetic construct
GRGYYCF

SEQ ID NO: 7211 - protein, 7 aa, Artificial Sequence
  Synthetic construct
GRGYYCY

SEQ ID NO: 7212 - protein, 7 aa, Artificial Sequence
  Synthetic construct
GRGYYLF

SEQ ID NO: 7213 - protein, 7 aa, Artificial Sequence
  Synthetic construct
GRGYYLY

SEQ ID NO: 7214 - protein, 7 aa, Artificial Sequence
  Synthetic construct
GRGYYAF

SEQ ID NO: 7215 - protein, 7 aa, Artificial Sequence
  Synthetic construct
GRGYYAY

SEQ ID NO: 7216 - protein, 7 aa, Artificial Sequence
  Synthetic construct
GRGYYQF

SEQ ID NO: 7217 - protein, 7 aa, Artificial Sequence
  Synthetic construct
GRGYYQY

SEQ ID NO: 7218 - protein, 7 aa, Artificial Sequence
  Synthetic construct
GRGYYDF

SEQ ID NO: 7219 - protein, 7 aa, Artificial Sequence
  Synthetic construct
GRGYYDY

SEQ ID NO: 7220 - protein, 7 aa, Artificial Sequence
  Synthetic construct
GRGYYVF

SEQ ID NO: 7221 - protein, 7 aa, Artificial Sequence
  Synthetic construct
GRGYYVY

SEQ ID NO: 7222 - protein, 7 aa, Artificial Sequence
  Synthetic construct
GRGYFFF

SEQ ID NO: 7223 - protein, 7 aa, Artificial Sequence
  Synthetic construct
GRGYFFY

SEQ ID NO: 7224 - protein, 7 aa, Artificial Sequence
  Synthetic construct
GRGYFRF

SEQ ID NO: 7225 - protein, 7 aa, Artificial Sequence
  Synthetic construct
GRGYFRY

SEQ ID NO: 7226 - protein, 7 aa, Artificial Sequence
  Synthetic construct
GRGYFCF

SEQ ID NO: 7227 - protein, 7 aa, Artificial Sequence
  Synthetic construct
GRGYFCY

SEQ ID NO: 7228 - protein, 7 aa, Artificial Sequence
  Synthetic construct
GRGYFLF

SEQ ID NO: 7229 - protein, 7 aa, Artificial Sequence
  Synthetic construct
GRGYFLY

SEQ ID NO: 7230 - protein, 7 aa, Artificial Sequence
  Synthetic construct
GRGYFAF

SEQ ID NO: 7231 - protein, 7 aa, Artificial Sequence
  Synthetic construct
GRGYFAY

SEQ ID NO: 7232 - protein, 7 aa, Artificial Sequence
  Synthetic construct
GRGYFQF

SEQ ID NO: 7233 - protein, 7 aa, Artificial Sequence
  Synthetic construct
GRGYFQY

SEQ ID NO: 7234 - protein, 7 aa, Artificial Sequence
  Synthetic construct
GRGYFDF

SEQ ID NO: 7235 - protein, 7 aa, Artificial Sequence
  Synthetic construct
GRGYFDY

SEQ ID NO: 7236 - protein, 7 aa, Artificial Sequence
  Synthetic construct
GRGYFVF

SEQ ID NO: 7237 - protein, 7 aa, Artificial Sequence
  Synthetic construct
GRGYFVY

SEQ ID NO: 7238 - protein, 7 aa, Artificial Sequence
  Synthetic construct
GRGYVFF

SEQ ID NO: 7239 - protein, 7 aa, Artificial Sequence
  Synthetic construct
GRGYVFY

SEQ ID NO: 7240 - protein, 7 aa, Artificial Sequence
  Synthetic construct
GRGYVRF

SEQ ID NO: 7241 - protein, 7 aa, Artificial Sequence
  Synthetic construct
GRGYVRY

SEQ ID NO: 7242 - protein, 7 aa, Artificial Sequence
  Synthetic construct
GRGYVCF

SEQ ID NO: 7243 - protein, 7 aa, Artificial Sequence
  Synthetic construct
GRGYVCY

SEQ ID NO: 7244 - protein, 7 aa, Artificial Sequence
  Synthetic construct
GRGYVLF

SEQ ID NO: 7245 - protein, 7 aa, Artificial Sequence
  Synthetic construct
GRGYVLY

SEQ ID NO: 7246 - protein, 7 aa, Artificial Sequence
  Synthetic construct
GRGYVAF

SEQ ID NO: 7247 - protein, 7 aa, Artificial Sequence
  Synthetic construct
GRGYVAY

SEQ ID NO: 7248 - protein, 7 aa, Artificial Sequence
  Synthetic construct
GRGYVQF

SEQ ID NO: 7249 - protein, 7 aa, Artificial Sequence
  Synthetic construct
GRGYVQY

SEQ ID NO: 7250 - protein, 7 aa, Artificial Sequence
  Synthetic construct
GRGYVDF

SEQ ID NO: 7251 - protein, 7 aa, Artificial Sequence
  Synthetic construct
GRGYVDY

SEQ ID NO: 7252 - protein, 7 aa, Artificial Sequence
  Synthetic construct
GRGYVVF

SEQ ID NO: 7253 - protein, 7 aa, Artificial Sequence
  Synthetic construct
GRGYVVY

SEQ ID NO: 7254 - protein, 7 aa, Artificial Sequence
  Synthetic construct
GRGYTFF

SEQ ID NO: 7255 - protein, 7 aa, Artificial Sequence
  Synthetic construct
GRGYTFY

SEQ ID NO: 7256 - protein, 7 aa, Artificial Sequence
  Synthetic construct
GRGYTRF

SEQ ID NO: 7257 - protein, 7 aa, Artificial Sequence
  Synthetic construct
GRGYTRY

SEQ ID NO: 7258 - protein, 7 aa, Artificial Sequence
  Synthetic construct
GRGYTCF

SEQ ID NO: 7259 - protein, 7 aa, Artificial Sequence
  Synthetic construct
GRGYTCY

SEQ ID NO: 7260 - protein, 7 aa, Artificial Sequence
  Synthetic construct
GRGYTLF

SEQ ID NO: 7261 - protein, 7 aa, Artificial Sequence
  Synthetic construct
GRGYTLY

SEQ ID NO: 7262 - protein, 7 aa, Artificial Sequence
  Synthetic construct
GRGYTAF

SEQ ID NO: 7263 - protein, 7 aa, Artificial Sequence
  Synthetic construct
GRGYTAY

SEQ ID NO: 7264 - protein, 7 aa, Artificial Sequence
  Synthetic construct
GRGYTQF

SEQ ID NO: 7265 - protein, 7 aa, Artificial Sequence
  Synthetic construct
GRGYTQY

SEQ ID NO: 7266 - protein, 7 aa, Artificial Sequence
  Synthetic construct
GRGYTDF

SEQ ID NO: 7267 - protein, 7 aa, Artificial Sequence
  Synthetic construct
GRGYTDY

SEQ ID NO: 7268 - protein, 7 aa, Artificial Sequence
  Synthetic construct
GRGYTVF

SEQ ID NO: 7269 - protein, 7 aa, Artificial Sequence
  Synthetic construct
GRGYTVY

SEQ ID NO: 7270 - protein, 7 aa, Artificial Sequence
  Synthetic construct
GRGYGFF

SEQ ID NO: 7271 - protein, 7 aa, Artificial Sequence
  Synthetic construct
GRGYGFY

SEQ ID NO: 7272 - protein, 7 aa, Artificial Sequence
  Synthetic construct
GRGYGRF

SEQ ID NO: 7273 - protein, 7 aa, Artificial Sequence
  Synthetic construct
GRGYGRY

SEQ ID NO: 7274 - protein, 7 aa, Artificial Sequence
  Synthetic construct
GRGYGCF

SEQ ID NO: 7275 - protein, 7 aa, Artificial Sequence
  Synthetic construct
GRGYGCY

SEQ ID NO: 7276 - protein, 7 aa, Artificial Sequence
  Synthetic construct
GRGYGLF

SEQ ID NO: 7277 - protein, 7 aa, Artificial Sequence
  Synthetic construct
GRGYGLY

SEQ ID NO: 7278 - protein, 7 aa, Artificial Sequence
  Synthetic construct
GRGYGAF

SEQ ID NO: 7279 - protein, 7 aa, Artificial Sequence
  Synthetic construct
GRGYGAY

SEQ ID NO: 7280 - protein, 7 aa, Artificial Sequence
  Synthetic construct
GRGYGQF

SEQ ID NO: 7281 - protein, 7 aa, Artificial Sequence
  Synthetic construct
GRGYGQY

SEQ ID NO: 7282 - protein, 7 aa, Artificial Sequence
  Synthetic construct
GRGYGDF

SEQ ID NO: 7283 - protein, 7 aa, Artificial Sequence
  Synthetic construct
GRGYGDY

SEQ ID NO: 7284 - protein, 7 aa, Artificial Sequence
  Synthetic construct
GRGYGVF

SEQ ID NO: 7285 - protein, 7 aa, Artificial Sequence
  Synthetic construct
GRGYGVY

SEQ ID NO: 7286 - protein, 7 aa, Artificial Sequence
  Synthetic construct
GRGYAFF

SEQ ID NO: 7287 - protein, 7 aa, Artificial Sequence
  Synthetic construct
GRGYAFY

SEQ ID NO: 7288 - protein, 7 aa, Artificial Sequence
  Synthetic construct
GRGYARF

SEQ ID NO: 7289 - protein, 7 aa, Artificial Sequence
  Synthetic construct
GRGYARY

SEQ ID NO: 7290 - protein, 7 aa, Artificial Sequence
  Synthetic construct
GRGYACF

SEQ ID NO: 7291 - protein, 7 aa, Artificial Sequence
  Synthetic construct
GRGYACY

SEQ ID NO: 7292 - protein, 7 aa, Artificial Sequence
  Synthetic construct
GRGYALF

SEQ ID NO: 7293 - protein, 7 aa, Artificial Sequence
  Synthetic construct
GRGYALY

SEQ ID NO: 7294 - protein, 7 aa, Artificial Sequence
  Synthetic construct
GRGYAAF

SEQ ID NO: 7295 - protein, 7 aa, Artificial Sequence
  Synthetic construct
GRGYAAY

SEQ ID NO: 7296 - protein, 7 aa, Artificial Sequence
  Synthetic construct
GRGYAQF

SEQ ID NO: 7297 - protein, 7 aa, Artificial Sequence
  Synthetic construct
GRGYAQY

SEQ ID NO: 7298 - protein, 7 aa, Artificial Sequence
  Synthetic construct
GRGYADF

SEQ ID NO: 7299 - protein, 7 aa, Artificial Sequence
  Synthetic construct
GRGYADY

SEQ ID NO: 7300 - protein, 7 aa, Artificial Sequence
  Synthetic construct
GRGYAVF

SEQ ID NO: 7301 - protein, 7 aa, Artificial Sequence
  Synthetic construct
GRGYAVY

SEQ ID NO: 7302 - protein, 7 aa, Artificial Sequence
  Synthetic construct
GRGYQFF

SEQ ID NO: 7303 - protein, 7 aa, Artificial Sequence
  Synthetic construct
GRGYQFY

SEQ ID NO: 7304 - protein, 7 aa, Artificial Sequence
  Synthetic construct
GRGYQRF

SEQ ID NO: 7305 - protein, 7 aa, Artificial Sequence
  Synthetic construct
GRGYQRY

SEQ ID NO: 7306 - protein, 7 aa, Artificial Sequence
  Synthetic construct
GRGYQCF

SEQ ID NO: 7307 - protein, 7 aa, Artificial Sequence
  Synthetic construct
GRGYQCY

SEQ ID NO: 7308 - protein, 7 aa, Artificial Sequence
  Synthetic construct
GRGYQLF

SEQ ID NO: 7309 - protein, 7 aa, Artificial Sequence
  Synthetic construct
GRGYQLY

SEQ ID NO: 7310 - protein, 7 aa, Artificial Sequence
  Synthetic construct
GRGYQAF

SEQ ID NO: 7311 - protein, 7 aa, Artificial Sequence
  Synthetic construct
GRGYQAY

SEQ ID NO: 7312 - protein, 7 aa, Artificial Sequence
  Synthetic construct
GRGYQQF

SEQ ID NO: 7313 - protein, 7 aa, Artificial Sequence
  Synthetic construct
GRGYQQY

SEQ ID NO: 7314 - protein, 7 aa, Artificial Sequence
  Synthetic construct
GRGYQDF

SEQ ID NO: 7315 - protein, 7 aa, Artificial Sequence
  Synthetic construct
GRGYQDY

SEQ ID NO: 7316 - protein, 7 aa, Artificial Sequence
  Synthetic construct
GRGYQVF

SEQ ID NO: 7317 - protein, 7 aa, Artificial Sequence
  Synthetic construct
GRGYQVY

SEQ ID NO: 7318 - protein, 7 aa, Artificial Sequence
  Synthetic construct
GRGPIFF

SEQ ID NO: 7319 - protein, 7 aa, Artificial Sequence
  Synthetic construct
GRGPIFY

SEQ ID NO: 7320 - protein, 7 aa, Artificial Sequence
  Synthetic construct
GRGPIRF

SEQ ID NO: 7321 - protein, 7 aa, Artificial Sequence
  Synthetic construct
GRGPIRY

SEQ ID NO: 7322 - protein, 7 aa, Artificial Sequence
  Synthetic construct
GRGPICF

SEQ ID NO: 7323 - protein, 7 aa, Artificial Sequence
  Synthetic construct
GRGPICY

SEQ ID NO: 7324 - protein, 7 aa, Artificial Sequence
  Synthetic construct
GRGPILF

SEQ ID NO: 7325 - protein, 7 aa, Artificial Sequence
  Synthetic construct
GRGPILY

SEQ ID NO: 7326 - protein, 7 aa, Artificial Sequence
  Synthetic construct
GRGPIAF

SEQ ID NO: 7327 - protein, 7 aa, Artificial Sequence
  Synthetic construct
GRGPIAY

SEQ ID NO: 7328 - protein, 7 aa, Artificial Sequence
  Synthetic construct
GRGPIQF

SEQ ID NO: 7329 - protein, 7 aa, Artificial Sequence
  Synthetic construct
GRGPIQY

SEQ ID NO: 7330 - protein, 7 aa, Artificial Sequence
  Synthetic construct
GRGPIDF

SEQ ID NO: 7331 - protein, 7 aa, Artificial Sequence
  Synthetic construct
GRGPIDY

SEQ ID NO: 7332 - protein, 7 aa, Artificial Sequence
  Synthetic construct
GRGPIVF

SEQ ID NO: 7333 - protein, 7 aa, Artificial Sequence
  Synthetic construct
GRGPIVY

SEQ ID NO: 7334 - protein, 7 aa, Artificial Sequence
  Synthetic construct
GRGPDFF

SEQ ID NO: 7335 - protein, 7 aa, Artificial Sequence
  Synthetic construct
GRGPDFY

SEQ ID NO: 7336 - protein, 7 aa, Artificial Sequence
  Synthetic construct
GRGPDRF

SEQ ID NO: 7337 - protein, 7 aa, Artificial Sequence
  Synthetic construct
GRGPDRY

SEQ ID NO: 7338 - protein, 7 aa, Artificial Sequence
  Synthetic construct
GRGPDCF

SEQ ID NO: 7339 - protein, 7 aa, Artificial Sequence
  Synthetic construct
GRGPDCY

SEQ ID NO: 7340 - protein, 7 aa, Artificial Sequence
  Synthetic construct
GRGPDLF

SEQ ID NO: 7341 - protein, 7 aa, Artificial Sequence
  Synthetic construct
GRGPDLY

SEQ ID NO: 7342 - protein, 7 aa, Artificial Sequence
  Synthetic construct
GRGPDAF

SEQ ID NO: 7343 - protein, 7 aa, Artificial Sequence
  Synthetic construct
GRGPDAY

SEQ ID NO: 7344 - protein, 7 aa, Artificial Sequence
  Synthetic construct
GRGPDQF

SEQ ID NO: 7345 - protein, 7 aa, Artificial Sequence
  Synthetic construct
GRGPDQY

SEQ ID NO: 7346 - protein, 7 aa, Artificial Sequence
  Synthetic construct
GRGPDDF

SEQ ID NO: 7347 - protein, 7 aa, Artificial Sequence
  Synthetic construct
GRGPDDY

SEQ ID NO: 7348 - protein, 7 aa, Artificial Sequence
  Synthetic construct
GRGPDVF

SEQ ID NO: 7349 - protein, 7 aa, Artificial Sequence
  Synthetic construct
GRGPDVY

SEQ ID NO: 7350 - protein, 7 aa, Artificial Sequence
  Synthetic construct
GRGPYFF

SEQ ID NO: 7351 - protein, 7 aa, Artificial Sequence
  Synthetic construct
GRGPYFY

SEQ ID NO: 7352 - protein, 7 aa, Artificial Sequence
  Synthetic construct
GRGPYRF

SEQ ID NO: 7353 - protein, 7 aa, Artificial Sequence
  Synthetic construct
GRGPYRY

SEQ ID NO: 7354 - protein, 7 aa, Artificial Sequence
  Synthetic construct
GRGPYCF

SEQ ID NO: 7355 - protein, 7 aa, Artificial Sequence
  Synthetic construct
GRGPYCY

SEQ ID NO: 7356 - protein, 7 aa, Artificial Sequence
  Synthetic construct
GRGPYLF

SEQ ID NO: 7357 - protein, 7 aa, Artificial Sequence
  Synthetic construct
GRGPYLY

SEQ ID NO: 7358 - protein, 7 aa, Artificial Sequence
  Synthetic construct
GRGPYAF

SEQ ID NO: 7359 - protein, 7 aa, Artificial Sequence
  Synthetic construct
GRGPYAY

SEQ ID NO: 7360 - protein, 7 aa, Artificial Sequence
  Synthetic construct
GRGPYQF

SEQ ID NO: 7361 - protein, 7 aa, Artificial Sequence
  Synthetic construct
GRGPYQY

SEQ ID NO: 7362 - protein, 7 aa, Artificial Sequence
  Synthetic construct
GRGPYDF

SEQ ID NO: 7363 - protein, 7 aa, Artificial Sequence
  Synthetic construct
GRGPYDY

SEQ ID NO: 7364 - protein, 7 aa, Artificial Sequence
  Synthetic construct
GRGPYVF

SEQ ID NO: 7365 - protein, 7 aa, Artificial Sequence
  Synthetic construct
GRGPYVY

SEQ ID NO: 7366 - protein, 7 aa, Artificial Sequence
  Synthetic construct
GRGPFFF

SEQ ID NO: 7367 - protein, 7 aa, Artificial Sequence
  Synthetic construct
GRGPFFY

SEQ ID NO: 7368 - protein, 7 aa, Artificial Sequence
  Synthetic construct
GRGPFRF

SEQ ID NO: 7369 - protein, 7 aa, Artificial Sequence
  Synthetic construct
GRGPFRY

SEQ ID NO: 7370 - protein, 7 aa, Artificial Sequence
  Synthetic construct
GRGPFCF

SEQ ID NO: 7371 - protein, 7 aa, Artificial Sequence
  Synthetic construct
GRGPFCY

SEQ ID NO: 7372 - protein, 7 aa, Artificial Sequence
  Synthetic construct
GRGPFLF

SEQ ID NO: 7373 - protein, 7 aa, Artificial Sequence
  Synthetic construct
GRGPFLY

SEQ ID NO: 7374 - protein, 7 aa, Artificial Sequence
  Synthetic construct
GRGPFAF

SEQ ID NO: 7375 - protein, 7 aa, Artificial Sequence
  Synthetic construct
GRGPFAY

SEQ ID NO: 7376 - protein, 7 aa, Artificial Sequence
  Synthetic construct
GRGPFQF

SEQ ID NO: 7377 - protein, 7 aa, Artificial Sequence
  Synthetic construct
GRGPFQY

SEQ ID NO: 7378 - protein, 7 aa, Artificial Sequence
  Synthetic construct
GRGPFDF

SEQ ID NO: 7379 - protein, 7 aa, Artificial Sequence
  Synthetic construct
GRGPFDY

SEQ ID NO: 7380 - protein, 7 aa, Artificial Sequence
  Synthetic construct
GRGPFVF

SEQ ID NO: 7381 - protein, 7 aa, Artificial Sequence
  Synthetic construct
GRGPFVY

SEQ ID NO: 7382 - protein, 7 aa, Artificial Sequence
  Synthetic construct
GRGPVFF

SEQ ID NO: 7383 - protein, 7 aa, Artificial Sequence
  Synthetic construct
GRGPVFY

SEQ ID NO: 7384 - protein, 7 aa, Artificial Sequence
  Synthetic construct
GRGPVRF

SEQ ID NO: 7385 - protein, 7 aa, Artificial Sequence
  Synthetic construct
GRGPVRY

SEQ ID NO: 7386 - protein, 7 aa, Artificial Sequence
  Synthetic construct
GRGPVCF

SEQ ID NO: 7387 - protein, 7 aa, Artificial Sequence
  Synthetic construct
GRGPVCY

SEQ ID NO: 7388 - protein, 7 aa, Artificial Sequence
  Synthetic construct
GRGPVLF

SEQ ID NO: 7389 - protein, 7 aa, Artificial Sequence
  Synthetic construct
GRGPVLY

SEQ ID NO: 7390 - protein, 7 aa, Artificial Sequence
  Synthetic construct
GRGPVAF

SEQ ID NO: 7391 - protein, 7 aa, Artificial Sequence
  Synthetic construct
GRGPVAY

SEQ ID NO: 7392 - protein, 7 aa, Artificial Sequence
  Synthetic construct
GRGPVQF

SEQ ID NO: 7393 - protein, 7 aa, Artificial Sequence
  Synthetic construct
GRGPVQY

SEQ ID NO: 7394 - protein, 7 aa, Artificial Sequence
  Synthetic construct
GRGPVDF

SEQ ID NO: 7395 - protein, 7 aa, Artificial Sequence
  Synthetic construct
GRGPVDY

SEQ ID NO: 7396 - protein, 7 aa, Artificial Sequence
  Synthetic construct
GRGPVVF

SEQ ID NO: 7397 - protein, 7 aa, Artificial Sequence
  Synthetic construct
GRGPVVY

SEQ ID NO: 7398 - protein, 7 aa, Artificial Sequence
  Synthetic construct
GRGPTFF

SEQ ID NO: 7399 - protein, 7 aa, Artificial Sequence
  Synthetic construct
GRGPTFY

SEQ ID NO: 7400 - protein, 7 aa, Artificial Sequence
  Synthetic construct
GRGPTRF

SEQ ID NO: 7401 - protein, 7 aa, Artificial Sequence
  Synthetic construct
GRGPTRY

SEQ ID NO: 7402 - protein, 7 aa, Artificial Sequence
  Synthetic construct
GRGPTCF

SEQ ID NO: 7403 - protein, 7 aa, Artificial Sequence
  Synthetic construct
GRGPTCY

SEQ ID NO: 7404 - protein, 7 aa, Artificial Sequence
  Synthetic construct
GRGPTLF

SEQ ID NO: 7405 - protein, 7 aa, Artificial Sequence
  Synthetic construct
GRGPTLY

SEQ ID NO: 7406 - protein, 7 aa, Artificial Sequence
  Synthetic construct
GRGPTAF

SEQ ID NO: 7407 - protein, 7 aa, Artificial Sequence
  Synthetic construct
GRGPTAY

SEQ ID NO: 7408 - protein, 7 aa, Artificial Sequence
  Synthetic construct
GRGPTQF

SEQ ID NO: 7409 - protein, 7 aa, Artificial Sequence
  Synthetic construct
GRGPTQY

SEQ ID NO: 7410 - protein, 7 aa, Artificial Sequence
  Synthetic construct
GRGPTDF

SEQ ID NO: 7411 - protein, 7 aa, Artificial Sequence
  Synthetic construct
GRGPTDY

SEQ ID NO: 7412 - protein, 7 aa, Artificial Sequence
  Synthetic construct
GRGPTVF

SEQ ID NO: 7413 - protein, 7 aa, Artificial Sequence
  Synthetic construct
GRGPTVY

SEQ ID NO: 7414 - protein, 7 aa, Artificial Sequence
  Synthetic construct
GRGPGFF

SEQ ID NO: 7415 - protein, 7 aa, Artificial Sequence
  Synthetic construct
GRGPGFY

SEQ ID NO: 7416 - protein, 7 aa, Artificial Sequence
  Synthetic construct
GRGPGRF

SEQ ID NO: 7417 - protein, 7 aa, Artificial Sequence
  Synthetic construct
GRGPGRY

SEQ ID NO: 7418 - protein, 7 aa, Artificial Sequence
  Synthetic construct
GRGPGCF

SEQ ID NO: 7419 - protein, 7 aa, Artificial Sequence
  Synthetic construct
GRGPGCY

SEQ ID NO: 7420 - protein, 7 aa, Artificial Sequence
  Synthetic construct
GRGPGLF

SEQ ID NO: 7421 - protein, 7 aa, Artificial Sequence
  Synthetic construct
GRGPGLY

SEQ ID NO: 7422 - protein, 7 aa, Artificial Sequence
  Synthetic construct
GRGPGAF

SEQ ID NO: 7423 - protein, 7 aa, Artificial Sequence
  Synthetic construct
GRGPGAY

SEQ ID NO: 7424 - protein, 7 aa, Artificial Sequence
  Synthetic construct
GRGPGQF

SEQ ID NO: 7425 - protein, 7 aa, Artificial Sequence
  Synthetic construct
GRGPGQY

SEQ ID NO: 7426 - protein, 7 aa, Artificial Sequence
  Synthetic construct
GRGPGDF

SEQ ID NO: 7427 - protein, 7 aa, Artificial Sequence
  Synthetic construct
GRGPGDY

SEQ ID NO: 7428 - protein, 7 aa, Artificial Sequence
  Synthetic construct
GRGPGVF

SEQ ID NO: 7429 - protein, 7 aa, Artificial Sequence
  Synthetic construct
GRGPGVY

SEQ ID NO: 7430 - protein, 7 aa, Artificial Sequence
  Synthetic construct
GRGPAFF

SEQ ID NO: 7431 - protein, 7 aa, Artificial Sequence
  Synthetic construct
GRGPAFY

SEQ ID NO: 7432 - protein, 7 aa, Artificial Sequence
  Synthetic construct
GRGPARF

SEQ ID NO: 7433 - protein, 7 aa, Artificial Sequence
  Synthetic construct
GRGPARY

SEQ ID NO: 7434 - protein, 7 aa, Artificial Sequence
  Synthetic construct
GRGPACF

SEQ ID NO: 7435 - protein, 7 aa, Artificial Sequence
  Synthetic construct
GRGPACY

SEQ ID NO: 7436 - protein, 7 aa, Artificial Sequence
  Synthetic construct
GRGPALF

SEQ ID NO: 7437 - protein, 7 aa, Artificial Sequence
  Synthetic construct
GRGPALY

SEQ ID NO: 7438 - protein, 7 aa, Artificial Sequence
  Synthetic construct
GRGPAAF

SEQ ID NO: 7439 - protein, 7 aa, Artificial Sequence
  Synthetic construct
GRGPAAY

SEQ ID NO: 7440 - protein, 7 aa, Artificial Sequence
  Synthetic construct
GRGPAQF

SEQ ID NO: 7441 - protein, 7 aa, Artificial Sequence
  Synthetic construct
GRGPAQY

SEQ ID NO: 7442 - protein, 7 aa, Artificial Sequence
  Synthetic construct
GRGPADF

SEQ ID NO: 7443 - protein, 7 aa, Artificial Sequence
  Synthetic construct
GRGPADY

SEQ ID NO: 7444 - protein, 7 aa, Artificial Sequence
  Synthetic construct
GRGPAVF

SEQ ID NO: 7445 - protein, 7 aa, Artificial Sequence
  Synthetic construct
GRGPAVY

SEQ ID NO: 7446 - protein, 7 aa, Artificial Sequence
  Synthetic construct
GRGPQFF

SEQ ID NO: 7447 - protein, 7 aa, Artificial Sequence
  Synthetic construct
GRGPQFY

SEQ ID NO: 7448 - protein, 7 aa, Artificial Sequence
  Synthetic construct
GRGPQRF

SEQ ID NO: 7449 - protein, 7 aa, Artificial Sequence
  Synthetic construct
GRGPQRY

SEQ ID NO: 7450 - protein, 7 aa, Artificial Sequence
  Synthetic construct
GRGPQCF

SEQ ID NO: 7451 - protein, 7 aa, Artificial Sequence
  Synthetic construct
GRGPQCY

SEQ ID NO: 7452 - protein, 7 aa, Artificial Sequence
  Synthetic construct
GRGPQLF

SEQ ID NO: 7453 - protein, 7 aa, Artificial Sequence
  Synthetic construct
GRGPQLY

SEQ ID NO: 7454 - protein, 7 aa, Artificial Sequence
  Synthetic construct
GRGPQAF

SEQ ID NO: 7455 - protein, 7 aa, Artificial Sequence
  Synthetic construct
GRGPQAY

SEQ ID NO: 7456 - protein, 7 aa, Artificial Sequence
  Synthetic construct
GRGPQQF

SEQ ID NO: 7457 - protein, 7 aa, Artificial Sequence
  Synthetic construct
GRGPQQY

SEQ ID NO: 7458 - protein, 7 aa, Artificial Sequence
  Synthetic construct
GRGPQDF

SEQ ID NO: 7459 - protein, 7 aa, Artificial Sequence
  Synthetic construct
GRGPQDY

SEQ ID NO: 7460 - protein, 7 aa, Artificial Sequence
  Synthetic construct
GRGPQVF

SEQ ID NO: 7461 - protein, 7 aa, Artificial Sequence
  Synthetic construct
GRGPQVY

SEQ ID NO: 7462 - protein, 7 aa, Artificial Sequence
  Synthetic construct
GRGHIFF

SEQ ID NO: 7463 - protein, 7 aa, Artificial Sequence
  Synthetic construct
GRGHIFY

SEQ ID NO: 7464 - protein, 7 aa, Artificial Sequence
  Synthetic construct
GRGHIRF

SEQ ID NO: 7465 - protein, 7 aa, Artificial Sequence
  Synthetic construct
GRGHIRY

SEQ ID NO: 7466 - protein, 7 aa, Artificial Sequence
  Synthetic construct
GRGHICF

SEQ ID NO: 7467 - protein, 7 aa, Artificial Sequence
  Synthetic construct
GRGHICY

SEQ ID NO: 7468 - protein, 7 aa, Artificial Sequence
  Synthetic construct
GRGHILF

SEQ ID NO: 7469 - protein, 7 aa, Artificial Sequence
  Synthetic construct
GRGHILY

SEQ ID NO: 7470 - protein, 7 aa, Artificial Sequence
  Synthetic construct
GRGHIAF

SEQ ID NO: 7471 - protein, 7 aa, Artificial Sequence
  Synthetic construct
GRGHIAY

SEQ ID NO: 7472 - protein, 7 aa, Artificial Sequence
  Synthetic construct
GRGHIQF

SEQ ID NO: 7473 - protein, 7 aa, Artificial Sequence
  Synthetic construct
GRGHIQY

SEQ ID NO: 7474 - protein, 7 aa, Artificial Sequence
  Synthetic construct
GRGHIDF

SEQ ID NO: 7475 - protein, 7 aa, Artificial Sequence
  Synthetic construct
GRGHIDY

SEQ ID NO: 7476 - protein, 7 aa, Artificial Sequence
  Synthetic construct
GRGHIVF

SEQ ID NO: 7477 - protein, 7 aa, Artificial Sequence
  Synthetic construct
GRGHIVY

SEQ ID NO: 7478 - protein, 7 aa, Artificial Sequence
  Synthetic construct
GRGHDFF

SEQ ID NO: 7479 - protein, 7 aa, Artificial Sequence
  Synthetic construct
GRGHDFY

SEQ ID NO: 7480 - protein, 7 aa, Artificial Sequence
  Synthetic construct
GRGHDRF

SEQ ID NO: 7481 - protein, 7 aa, Artificial Sequence
  Synthetic construct
GRGHDRY

SEQ ID NO: 7482 - protein, 7 aa, Artificial Sequence
  Synthetic construct
GRGHDCF

SEQ ID NO: 7483 - protein, 7 aa, Artificial Sequence
  Synthetic construct
GRGHDCY

SEQ ID NO: 7484 - protein, 7 aa, Artificial Sequence
  Synthetic construct
GRGHDLF

SEQ ID NO: 7485 - protein, 7 aa, Artificial Sequence
  Synthetic construct
GRGHDLY

SEQ ID NO: 7486 - protein, 7 aa, Artificial Sequence
  Synthetic construct
GRGHDAF

SEQ ID NO: 7487 - protein, 7 aa, Artificial Sequence
  Synthetic construct
GRGHDAY

SEQ ID NO: 7488 - protein, 7 aa, Artificial Sequence
  Synthetic construct
GRGHDQF

SEQ ID NO: 7489 - protein, 7 aa, Artificial Sequence
  Synthetic construct
GRGHDQY

SEQ ID NO: 7490 - protein, 7 aa, Artificial Sequence
  Synthetic construct
GRGHDDF

SEQ ID NO: 7491 - protein, 7 aa, Artificial Sequence
  Synthetic construct
GRGHDDY

SEQ ID NO: 7492 - protein, 7 aa, Artificial Sequence
  Synthetic construct
GRGHDVF

SEQ ID NO: 7493 - protein, 7 aa, Artificial Sequence
  Synthetic construct
GRGHDVY

SEQ ID NO: 7494 - protein, 7 aa, Artificial Sequence
  Synthetic construct
GRGHYFF

SEQ ID NO: 7495 - protein, 7 aa, Artificial Sequence
  Synthetic construct
GRGHYFY

SEQ ID NO: 7496 - protein, 7 aa, Artificial Sequence
  Synthetic construct
GRGHYRF

SEQ ID NO: 7497 - protein, 7 aa, Artificial Sequence
  Synthetic construct
GRGHYRY

SEQ ID NO: 7498 - protein, 7 aa, Artificial Sequence
  Synthetic construct
GRGHYCF

SEQ ID NO: 7499 - protein, 7 aa, Artificial Sequence
  Synthetic construct
GRGHYCY

SEQ ID NO: 7500 - protein, 7 aa, Artificial Sequence
  Synthetic construct
GRGHYLF

SEQ ID NO: 7501 - protein, 7 aa, Artificial Sequence
  Synthetic construct
GRGHYLY

SEQ ID NO: 7502 - protein, 7 aa, Artificial Sequence
  Synthetic construct
GRGHYAF

SEQ ID NO: 7503 - protein, 7 aa, Artificial Sequence
  Synthetic construct
GRGHYAY

SEQ ID NO: 7504 - protein, 7 aa, Artificial Sequence
  Synthetic construct
GRGHYQF

SEQ ID NO: 7505 - protein, 7 aa, Artificial Sequence
  Synthetic construct
GRGHYQY

SEQ ID NO: 7506 - protein, 7 aa, Artificial Sequence
  Synthetic construct
GRGHYDF

SEQ ID NO: 7507 - protein, 7 aa, Artificial Sequence
  Synthetic construct
GRGHYDY

SEQ ID NO: 7508 - protein, 7 aa, Artificial Sequence
  Synthetic construct
GRGHYVF

SEQ ID NO: 7509 - protein, 7 aa, Artificial Sequence
  Synthetic construct
GRGHYVY

SEQ ID NO: 7510 - protein, 7 aa, Artificial Sequence
  Synthetic construct
GRGHFFF

SEQ ID NO: 7511 - protein, 7 aa, Artificial Sequence
  Synthetic construct
GRGHFFY

SEQ ID NO: 7512 - protein, 7 aa, Artificial Sequence
  Synthetic construct
GRGHFRF

SEQ ID NO: 7513 - protein, 7 aa, Artificial Sequence
  Synthetic construct
GRGHFRY

SEQ ID NO: 7514 - protein, 7 aa, Artificial Sequence
  Synthetic construct
GRGHFCF

SEQ ID NO: 7515 - protein, 7 aa, Artificial Sequence
  Synthetic construct
GRGHFCY

SEQ ID NO: 7516 - protein, 7 aa, Artificial Sequence
  Synthetic construct
GRGHFLF

SEQ ID NO: 7517 - protein, 7 aa, Artificial Sequence
  Synthetic construct
GRGHFLY

SEQ ID NO: 7518 - protein, 7 aa, Artificial Sequence
  Synthetic construct
GRGHFAF

SEQ ID NO: 7519 - protein, 7 aa, Artificial Sequence
  Synthetic construct
GRGHFAY

SEQ ID NO: 7520 - protein, 7 aa, Artificial Sequence
  Synthetic construct
GRGHFQF

SEQ ID NO: 7521 - protein, 7 aa, Artificial Sequence
  Synthetic construct
GRGHFQY

SEQ ID NO: 7522 - protein, 7 aa, Artificial Sequence
  Synthetic construct
GRGHFDF

SEQ ID NO: 7523 - protein, 7 aa, Artificial Sequence
  Synthetic construct
GRGHFDY

SEQ ID NO: 7524 - protein, 7 aa, Artificial Sequence
  Synthetic construct
GRGHFVF

SEQ ID NO: 7525 - protein, 7 aa, Artificial Sequence
  Synthetic construct
GRGHFVY

SEQ ID NO: 7526 - protein, 7 aa, Artificial Sequence
  Synthetic construct
GRGHVFF

SEQ ID NO: 7527 - protein, 7 aa, Artificial Sequence
  Synthetic construct
GRGHVFY

SEQ ID NO: 7528 - protein, 7 aa, Artificial Sequence
  Synthetic construct
GRGHVRF

SEQ ID NO: 7529 - protein, 7 aa, Artificial Sequence
  Synthetic construct
GRGHVRY

SEQ ID NO: 7530 - protein, 7 aa, Artificial Sequence
  Synthetic construct
GRGHVCF

SEQ ID NO: 7531 - protein, 7 aa, Artificial Sequence
  Synthetic construct
GRGHVCY

SEQ ID NO: 7532 - protein, 7 aa, Artificial Sequence
  Synthetic construct
GRGHVLF

SEQ ID NO: 7533 - protein, 7 aa, Artificial Sequence
  Synthetic construct
GRGHVLY

SEQ ID NO: 7534 - protein, 7 aa, Artificial Sequence
  Synthetic construct
GRGHVAF

SEQ ID NO: 7535 - protein, 7 aa, Artificial Sequence
  Synthetic construct
GRGHVAY

SEQ ID NO: 7536 - protein, 7 aa, Artificial Sequence
  Synthetic construct
GRGHVQF

SEQ ID NO: 7537 - protein, 7 aa, Artificial Sequence
  Synthetic construct
GRGHVQY

SEQ ID NO: 7538 - protein, 7 aa, Artificial Sequence
  Synthetic construct
GRGHVDF

SEQ ID NO: 7539 - protein, 7 aa, Artificial Sequence
  Synthetic construct
GRGHVDY

SEQ ID NO: 7540 - protein, 7 aa, Artificial Sequence
  Synthetic construct
GRGHVVF

SEQ ID NO: 7541 - protein, 7 aa, Artificial Sequence
  Synthetic construct
GRGHVVY

SEQ ID NO: 7542 - protein, 7 aa, Artificial Sequence
  Synthetic construct
GRGHTFF

SEQ ID NO: 7543 - protein, 7 aa, Artificial Sequence
  Synthetic construct
GRGHTFY

SEQ ID NO: 7544 - protein, 7 aa, Artificial Sequence
  Synthetic construct
GRGHTRF

SEQ ID NO: 7545 - protein, 7 aa, Artificial Sequence
  Synthetic construct
GRGHTRY

SEQ ID NO: 7546 - protein, 7 aa, Artificial Sequence
  Synthetic construct
GRGHTCF

SEQ ID NO: 7547 - protein, 7 aa, Artificial Sequence
  Synthetic construct
GRGHTCY

SEQ ID NO: 7548 - protein, 7 aa, Artificial Sequence
  Synthetic construct
GRGHTLF

SEQ ID NO: 7549 - protein, 7 aa, Artificial Sequence
  Synthetic construct
GRGHTLY

SEQ ID NO: 7550 - protein, 7 aa, Artificial Sequence
  Synthetic construct
GRGHTAF

SEQ ID NO: 7551 - protein, 7 aa, Artificial Sequence
  Synthetic construct
GRGHTAY

SEQ ID NO: 7552 - protein, 7 aa, Artificial Sequence
  Synthetic construct
GRGHTQF

SEQ ID NO: 7553 - protein, 7 aa, Artificial Sequence
  Synthetic construct
GRGHTQY

SEQ ID NO: 7554 - protein, 7 aa, Artificial Sequence
  Synthetic construct
GRGHTDF

SEQ ID NO: 7555 - protein, 7 aa, Artificial Sequence
  Synthetic construct
GRGHTDY

SEQ ID NO: 7556 - protein, 7 aa, Artificial Sequence
  Synthetic construct
GRGHTVF

SEQ ID NO: 7557 - protein, 7 aa, Artificial Sequence
  Synthetic construct
GRGHTVY

SEQ ID NO: 7558 - protein, 7 aa, Artificial Sequence
  Synthetic construct
GRGHGFF

SEQ ID NO: 7559 - protein, 7 aa, Artificial Sequence
  Synthetic construct
GRGHGFY

SEQ ID NO: 7560 - protein, 7 aa, Artificial Sequence
  Synthetic construct
GRGHGRF

SEQ ID NO: 7561 - protein, 7 aa, Artificial Sequence
  Synthetic construct
GRGHGRY

SEQ ID NO: 7562 - protein, 7 aa, Artificial Sequence
  Synthetic construct
GRGHGCF

SEQ ID NO: 7563 - protein, 7 aa, Artificial Sequence
  Synthetic construct
GRGHGCY

SEQ ID NO: 7564 - protein, 7 aa, Artificial Sequence
  Synthetic construct
GRGHGLF

SEQ ID NO: 7565 - protein, 7 aa, Artificial Sequence
  Synthetic construct
GRGHGLY

SEQ ID NO: 7566 - protein, 7 aa, Artificial Sequence
  Synthetic construct
GRGHGAF

SEQ ID NO: 7567 - protein, 7 aa, Artificial Sequence
  Synthetic construct
GRGHGAY

SEQ ID NO: 7568 - protein, 7 aa, Artificial Sequence
  Synthetic construct
GRGHGQF

SEQ ID NO: 7569 - protein, 7 aa, Artificial Sequence
  Synthetic construct
GRGHGQY

SEQ ID NO: 7570 - protein, 7 aa, Artificial Sequence
  Synthetic construct
GRGHGDF

SEQ ID NO: 7571 - protein, 7 aa, Artificial Sequence
  Synthetic construct
GRGHGDY

SEQ ID NO: 7572 - protein, 7 aa, Artificial Sequence
  Synthetic construct
GRGHGVF

SEQ ID NO: 7573 - protein, 7 aa, Artificial Sequence
  Synthetic construct
GRGHGVY

SEQ ID NO: 7574 - protein, 7 aa, Artificial Sequence
  Synthetic construct
GRGHAFF

SEQ ID NO: 7575 - protein, 7 aa, Artificial Sequence
  Synthetic construct
GRGHAFY

SEQ ID NO: 7576 - protein, 7 aa, Artificial Sequence
  Synthetic construct
GRGHARF

SEQ ID NO: 7577 - protein, 7 aa, Artificial Sequence
  Synthetic construct
GRGHARY

SEQ ID NO: 7578 - protein, 7 aa, Artificial Sequence
  Synthetic construct
GRGHACF

SEQ ID NO: 7579 - protein, 7 aa, Artificial Sequence
  Synthetic construct
GRGHACY

SEQ ID NO: 7580 - protein, 7 aa, Artificial Sequence
  Synthetic construct
GRGHALF

SEQ ID NO: 7581 - protein, 7 aa, Artificial Sequence
  Synthetic construct
GRGHALY

SEQ ID NO: 7582 - protein, 7 aa, Artificial Sequence
  Synthetic construct
GRGHAAF

SEQ ID NO: 7583 - protein, 7 aa, Artificial Sequence
  Synthetic construct
GRGHAAY

SEQ ID NO: 7584 - protein, 7 aa, Artificial Sequence
  Synthetic construct
GRGHAQF

SEQ ID NO: 7585 - protein, 7 aa, Artificial Sequence
  Synthetic construct
GRGHAQY

SEQ ID NO: 7586 - protein, 7 aa, Artificial Sequence
  Synthetic construct
GRGHADF

SEQ ID NO: 7587 - protein, 7 aa, Artificial Sequence
  Synthetic construct
GRGHADY

SEQ ID NO: 7588 - protein, 7 aa, Artificial Sequence
  Synthetic construct
GRGHAVF

SEQ ID NO: 7589 - protein, 7 aa, Artificial Sequence
  Synthetic construct
GRGHAVY

SEQ ID NO: 7590 - protein, 7 aa, Artificial Sequence
  Synthetic construct
GRGHQFF

SEQ ID NO: 7591 - protein, 7 aa, Artificial Sequence
  Synthetic construct
GRGHQFY

SEQ ID NO: 7592 - protein, 7 aa, Artificial Sequence
  Synthetic construct
GRGHQRF

SEQ ID NO: 7593 - protein, 7 aa, Artificial Sequence
  Synthetic construct
GRGHQRY

SEQ ID NO: 7594 - protein, 7 aa, Artificial Sequence
  Synthetic construct
GRGHQCF

SEQ ID NO: 7595 - protein, 7 aa, Artificial Sequence
  Synthetic construct
GRGHQCY

SEQ ID NO: 7596 - protein, 7 aa, Artificial Sequence
  Synthetic construct
GRGHQLF

SEQ ID NO: 7597 - protein, 7 aa, Artificial Sequence
  Synthetic construct
GRGHQLY

SEQ ID NO: 7598 - protein, 7 aa, Artificial Sequence
  Synthetic construct
GRGHQAF

SEQ ID NO: 7599 - protein, 7 aa, Artificial Sequence
  Synthetic construct
GRGHQAY

SEQ ID NO: 7600 - protein, 7 aa, Artificial Sequence
  Synthetic construct
GRGHQQF

SEQ ID NO: 7601 - protein, 7 aa, Artificial Sequence
  Synthetic construct
GRGHQQY

SEQ ID NO: 7602 - protein, 7 aa, Artificial Sequence
  Synthetic construct
GRGHQDF

SEQ ID NO: 7603 - protein, 7 aa, Artificial Sequence
  Synthetic construct
GRGHQDY

SEQ ID NO: 7604 - protein, 7 aa, Artificial Sequence
  Synthetic construct
GRGHQVF

SEQ ID NO: 7605 - protein, 7 aa, Artificial Sequence
  Synthetic construct
GRGHQVY

SEQ ID NO: 7606 - protein, 7 aa, Artificial Sequence
  Synthetic construct
GRGLIFF

SEQ ID NO: 7607 - protein, 7 aa, Artificial Sequence
  Synthetic construct
GRGLIFY

SEQ ID NO: 7608 - protein, 7 aa, Artificial Sequence
  Synthetic construct
GRGLIRF

SEQ ID NO: 7609 - protein, 7 aa, Artificial Sequence
  Synthetic construct
GRGLIRY

SEQ ID NO: 7610 - protein, 7 aa, Artificial Sequence
  Synthetic construct
GRGLICF

SEQ ID NO: 7611 - protein, 7 aa, Artificial Sequence
  Synthetic construct
GRGLICY

SEQ ID NO: 7612 - protein, 7 aa, Artificial Sequence
  Synthetic construct
GRGLILF

SEQ ID NO: 7613 - protein, 7 aa, Artificial Sequence
  Synthetic construct
GRGLILY

SEQ ID NO: 7614 - protein, 7 aa, Artificial Sequence
  Synthetic construct
GRGLIAF

SEQ ID NO: 7615 - protein, 7 aa, Artificial Sequence
  Synthetic construct
GRGLIAY

SEQ ID NO: 7616 - protein, 7 aa, Artificial Sequence
  Synthetic construct
GRGLIQF

SEQ ID NO: 7617 - protein, 7 aa, Artificial Sequence
  Synthetic construct
GRGLIQY

SEQ ID NO: 7618 - protein, 7 aa, Artificial Sequence
  Synthetic construct
GRGLIDF

SEQ ID NO: 7619 - protein, 7 aa, Artificial Sequence
  Synthetic construct
GRGLIDY

SEQ ID NO: 7620 - protein, 7 aa, Artificial Sequence
  Synthetic construct
GRGLIVF

SEQ ID NO: 7621 - protein, 7 aa, Artificial Sequence
  Synthetic construct
GRGLIVY

SEQ ID NO: 7622 - protein, 7 aa, Artificial Sequence
  Synthetic construct
GRGLDFF

SEQ ID NO: 7623 - protein, 7 aa, Artificial Sequence
  Synthetic construct
GRGLDFY

SEQ ID NO: 7624 - protein, 7 aa, Artificial Sequence
  Synthetic construct
GRGLDRF

SEQ ID NO: 7625 - protein, 7 aa, Artificial Sequence
  Synthetic construct
GRGLDRY

SEQ ID NO: 7626 - protein, 7 aa, Artificial Sequence
  Synthetic construct
GRGLDCF

SEQ ID NO: 7627 - protein, 7 aa, Artificial Sequence
  Synthetic construct
GRGLDCY

SEQ ID NO: 7628 - protein, 7 aa, Artificial Sequence
  Synthetic construct
GRGLDLF

SEQ ID NO: 7629 - protein, 7 aa, Artificial Sequence
  Synthetic construct
GRGLDLY

SEQ ID NO: 7630 - protein, 7 aa, Artificial Sequence
  Synthetic construct
GRGLDAF

SEQ ID NO: 7631 - protein, 7 aa, Artificial Sequence
  Synthetic construct
GRGLDAY

SEQ ID NO: 7632 - protein, 7 aa, Artificial Sequence
  Synthetic construct
GRGLDQF

SEQ ID NO: 7633 - protein, 7 aa, Artificial Sequence
  Synthetic construct
GRGLDQY

SEQ ID NO: 7634 - protein, 7 aa, Artificial Sequence
  Synthetic construct
GRGLDDF

SEQ ID NO: 7635 - protein, 7 aa, Artificial Sequence
  Synthetic construct
GRGLDDY

SEQ ID NO: 7636 - protein, 7 aa, Artificial Sequence
  Synthetic construct
GRGLDVF

SEQ ID NO: 7637 - protein, 7 aa, Artificial Sequence
  Synthetic construct
GRGLDVY

SEQ ID NO: 7638 - protein, 7 aa, Artificial Sequence
  Synthetic construct
GRGLYFF

SEQ ID NO: 7639 - protein, 7 aa, Artificial Sequence
  Synthetic construct
GRGLYFY

SEQ ID NO: 7640 - protein, 7 aa, Artificial Sequence
  Synthetic construct
GRGLYRF

SEQ ID NO: 7641 - protein, 7 aa, Artificial Sequence
  Synthetic construct
GRGLYRY

SEQ ID NO: 7642 - protein, 7 aa, Artificial Sequence
  Synthetic construct
GRGLYCF

SEQ ID NO: 7643 - protein, 7 aa, Artificial Sequence
  Synthetic construct
GRGLYCY

SEQ ID NO: 7644 - protein, 7 aa, Artificial Sequence
  Synthetic construct
GRGLYLF

SEQ ID NO: 7645 - protein, 7 aa, Artificial Sequence
  Synthetic construct
GRGLYLY

SEQ ID NO: 7646 - protein, 7 aa, Artificial Sequence
  Synthetic construct
GRGLYAF

SEQ ID NO: 7647 - protein, 7 aa, Artificial Sequence
  Synthetic construct
GRGLYAY

SEQ ID NO: 7648 - protein, 7 aa, Artificial Sequence
  Synthetic construct
GRGLYQF

SEQ ID NO: 7649 - protein, 7 aa, Artificial Sequence
  Synthetic construct
GRGLYQY

SEQ ID NO: 7650 - protein, 7 aa, Artificial Sequence
  Synthetic construct
GRGLYDF

SEQ ID NO: 7651 - protein, 7 aa, Artificial Sequence
  Synthetic construct
GRGLYDY

SEQ ID NO: 7652 - protein, 7 aa, Artificial Sequence
  Synthetic construct
GRGLYVF

SEQ ID NO: 7653 - protein, 7 aa, Artificial Sequence
  Synthetic construct
GRGLYVY

SEQ ID NO: 7654 - protein, 7 aa, Artificial Sequence
  Synthetic construct
GRGLFFF

SEQ ID NO: 7655 - protein, 7 aa, Artificial Sequence
  Synthetic construct
GRGLFFY

SEQ ID NO: 7656 - protein, 7 aa, Artificial Sequence
  Synthetic construct
GRGLFRF

SEQ ID NO: 7657 - protein, 7 aa, Artificial Sequence
  Synthetic construct
GRGLFRY

SEQ ID NO: 7658 - protein, 7 aa, Artificial Sequence
  Synthetic construct
GRGLFCF

SEQ ID NO: 7659 - protein, 7 aa, Artificial Sequence
  Synthetic construct
GRGLFCY

SEQ ID NO: 7660 - protein, 7 aa, Artificial Sequence
  Synthetic construct
GRGLFLF

SEQ ID NO: 7661 - protein, 7 aa, Artificial Sequence
  Synthetic construct
GRGLFLY

SEQ ID NO: 7662 - protein, 7 aa, Artificial Sequence
  Synthetic construct
GRGLFAF

SEQ ID NO: 7663 - protein, 7 aa, Artificial Sequence
  Synthetic construct
GRGLFAY

SEQ ID NO: 7664 - protein, 7 aa, Artificial Sequence
  Synthetic construct
GRGLFQF

SEQ ID NO: 7665 - protein, 7 aa, Artificial Sequence
  Synthetic construct
GRGLFQY

SEQ ID NO: 7666 - protein, 7 aa, Artificial Sequence
  Synthetic construct
GRGLFDF

SEQ ID NO: 7667 - protein, 7 aa, Artificial Sequence
  Synthetic construct
GRGLFDY

SEQ ID NO: 7668 - protein, 7 aa, Artificial Sequence
  Synthetic construct
GRGLFVF

SEQ ID NO: 7669 - protein, 7 aa, Artificial Sequence
  Synthetic construct
GRGLFVY

SEQ ID NO: 7670 - protein, 7 aa, Artificial Sequence
  Synthetic construct
GRGLVFF

SEQ ID NO: 7671 - protein, 7 aa, Artificial Sequence
  Synthetic construct
GRGLVFY

SEQ ID NO: 7672 - protein, 7 aa, Artificial Sequence
  Synthetic construct
GRGLVRF

SEQ ID NO: 7673 - protein, 7 aa, Artificial Sequence
  Synthetic construct
GRGLVRY

SEQ ID NO: 7674 - protein, 7 aa, Artificial Sequence
  Synthetic construct
GRGLVCF

SEQ ID NO: 7675 - protein, 7 aa, Artificial Sequence
  Synthetic construct
GRGLVCY

SEQ ID NO: 7676 - protein, 7 aa, Artificial Sequence
  Synthetic construct
GRGLVLF

SEQ ID NO: 7677 - protein, 7 aa, Artificial Sequence
  Synthetic construct
GRGLVLY

SEQ ID NO: 7678 - protein, 7 aa, Artificial Sequence
  Synthetic construct
GRGLVAF

SEQ ID NO: 7679 - protein, 7 aa, Artificial Sequence
  Synthetic construct
GRGLVAY

SEQ ID NO: 7680 - protein, 7 aa, Artificial Sequence
  Synthetic construct
GRGLVQF

SEQ ID NO: 7681 - protein, 7 aa, Artificial Sequence
  Synthetic construct
GRGLVQY

SEQ ID NO: 7682 - protein, 7 aa, Artificial Sequence
  Synthetic construct
GRGLVDF

SEQ ID NO: 7683 - protein, 7 aa, Artificial Sequence
  Synthetic construct
GRGLVDY

SEQ ID NO: 7684 - protein, 7 aa, Artificial Sequence
  Synthetic construct
GRGLVVF

SEQ ID NO: 7685 - protein, 7 aa, Artificial Sequence
  Synthetic construct
GRGLVVY

SEQ ID NO: 7686 - protein, 7 aa, Artificial Sequence
  Synthetic construct
GRGLTFF

SEQ ID NO: 7687 - protein, 7 aa, Artificial Sequence
  Synthetic construct
GRGLTFY

SEQ ID NO: 7688 - protein, 7 aa, Artificial Sequence
  Synthetic construct
GRGLTRF

SEQ ID NO: 7689 - protein, 7 aa, Artificial Sequence
  Synthetic construct
GRGLTRY

SEQ ID NO: 7690 - protein, 7 aa, Artificial Sequence
  Synthetic construct
GRGLTCF

SEQ ID NO: 7691 - protein, 7 aa, Artificial Sequence
  Synthetic construct
GRGLTCY

SEQ ID NO: 7692 - protein, 7 aa, Artificial Sequence
  Synthetic construct
GRGLTLF

SEQ ID NO: 7693 - protein, 7 aa, Artificial Sequence
  Synthetic construct
GRGLTLY

SEQ ID NO: 7694 - protein, 7 aa, Artificial Sequence
  Synthetic construct
GRGLTAF

SEQ ID NO: 7695 - protein, 7 aa, Artificial Sequence
  Synthetic construct
GRGLTAY

SEQ ID NO: 7696 - protein, 7 aa, Artificial Sequence
  Synthetic construct
GRGLTQF

SEQ ID NO: 7697 - protein, 7 aa, Artificial Sequence
  Synthetic construct
GRGLTQY

SEQ ID NO: 7698 - protein, 7 aa, Artificial Sequence
  Synthetic construct
GRGLTDF

SEQ ID NO: 7699 - protein, 7 aa, Artificial Sequence
  Synthetic construct
GRGLTDY

SEQ ID NO: 7700 - protein, 7 aa, Artificial Sequence
  Synthetic construct
GRGLTVF

SEQ ID NO: 7701 - protein, 7 aa, Artificial Sequence
  Synthetic construct
GRGLTVY

SEQ ID NO: 7702 - protein, 7 aa, Artificial Sequence
  Synthetic construct
GRGLGFF

SEQ ID NO: 7703 - protein, 7 aa, Artificial Sequence
  Synthetic construct
GRGLGFY

SEQ ID NO: 7704 - protein, 7 aa, Artificial Sequence
  Synthetic construct
GRGLGRF

SEQ ID NO: 7705 - protein, 7 aa, Artificial Sequence
  Synthetic construct
GRGLGRY

SEQ ID NO: 7706 - protein, 7 aa, Artificial Sequence
  Synthetic construct
GRGLGCF

SEQ ID NO: 7707 - protein, 7 aa, Artificial Sequence
  Synthetic construct
GRGLGCY

SEQ ID NO: 7708 - protein, 7 aa, Artificial Sequence
  Synthetic construct
GRGLGLF

SEQ ID NO: 7709 - protein, 7 aa, Artificial Sequence
  Synthetic construct
GRGLGLY

SEQ ID NO: 7710 - protein, 7 aa, Artificial Sequence
  Synthetic construct
GRGLGAF

SEQ ID NO: 7711 - protein, 7 aa, Artificial Sequence
  Synthetic construct
GRGLGAY

SEQ ID NO: 7712 - protein, 7 aa, Artificial Sequence
  Synthetic construct
GRGLGQF

SEQ ID NO: 7713 - protein, 7 aa, Artificial Sequence
  Synthetic construct
GRGLGQY

SEQ ID NO: 7714 - protein, 7 aa, Artificial Sequence
  Synthetic construct
GRGLGDF

SEQ ID NO: 7715 - protein, 7 aa, Artificial Sequence
  Synthetic construct
GRGLGDY

SEQ ID NO: 7716 - protein, 7 aa, Artificial Sequence
  Synthetic construct
GRGLGVF

SEQ ID NO: 7717 - protein, 7 aa, Artificial Sequence
  Synthetic construct
GRGLGVY

SEQ ID NO: 7718 - protein, 7 aa, Artificial Sequence
  Synthetic construct
GRGLAFF

SEQ ID NO: 7719 - protein, 7 aa, Artificial Sequence
  Synthetic construct
GRGLAFY

SEQ ID NO: 7720 - protein, 7 aa, Artificial Sequence
  Synthetic construct
GRGLARF

SEQ ID NO: 7721 - protein, 7 aa, Artificial Sequence
  Synthetic construct
GRGLARY

SEQ ID NO: 7722 - protein, 7 aa, Artificial Sequence
  Synthetic construct
GRGLACF

SEQ ID NO: 7723 - protein, 7 aa, Artificial Sequence
  Synthetic construct
GRGLACY

SEQ ID NO: 7724 - protein, 7 aa, Artificial Sequence
  Synthetic construct
GRGLALF

SEQ ID NO: 7725 - protein, 7 aa, Artificial Sequence
  Synthetic construct
GRGLALY

SEQ ID NO: 7726 - protein, 7 aa, Artificial Sequence
  Synthetic construct
GRGLAAF

SEQ ID NO: 7727 - protein, 7 aa, Artificial Sequence
  Synthetic construct
GRGLAAY

SEQ ID NO: 7728 - protein, 7 aa, Artificial Sequence
  Synthetic construct
GRGLAQF

SEQ ID NO: 7729 - protein, 7 aa, Artificial Sequence
  Synthetic construct
GRGLAQY

SEQ ID NO: 7730 - protein, 7 aa, Artificial Sequence
  Synthetic construct
GRGLADF

SEQ ID NO: 7731 - protein, 7 aa, Artificial Sequence
  Synthetic construct
GRGLADY

SEQ ID NO: 7732 - protein, 7 aa, Artificial Sequence
  Synthetic construct
GRGLAVF

SEQ ID NO: 7733 - protein, 7 aa, Artificial Sequence
  Synthetic construct
GRGLAVY

SEQ ID NO: 7734 - protein, 7 aa, Artificial Sequence
  Synthetic construct
GRGLQFF

SEQ ID NO: 7735 - protein, 7 aa, Artificial Sequence
  Synthetic construct
GRGLQFY

SEQ ID NO: 7736 - protein, 7 aa, Artificial Sequence
  Synthetic construct
GRGLQRF

SEQ ID NO: 7737 - protein, 7 aa, Artificial Sequence
  Synthetic construct
GRGLQRY

SEQ ID NO: 7738 - protein, 7 aa, Artificial Sequence
  Synthetic construct
GRGLQCF

SEQ ID NO: 7739 - protein, 7 aa, Artificial Sequence
  Synthetic construct
GRGLQCY

SEQ ID NO: 7740 - protein, 7 aa, Artificial Sequence
  Synthetic construct
GRGLQLF

SEQ ID NO: 7741 - protein, 7 aa, Artificial Sequence
  Synthetic construct
GRGLQLY

SEQ ID NO: 7742 - protein, 7 aa, Artificial Sequence
  Synthetic construct
GRGLQAF

SEQ ID NO: 7743 - protein, 7 aa, Artificial Sequence
  Synthetic construct
GRGLQAY

SEQ ID NO: 7744 - protein, 7 aa, Artificial Sequence
  Synthetic construct
GRGLQQF

SEQ ID NO: 7745 - protein, 7 aa, Artificial Sequence
  Synthetic construct
GRGLQQY

SEQ ID NO: 7746 - protein, 7 aa, Artificial Sequence
  Synthetic construct
GRGLQDF

SEQ ID NO: 7747 - protein, 7 aa, Artificial Sequence
  Synthetic construct
GRGLQDY

SEQ ID NO: 7748 - protein, 7 aa, Artificial Sequence
  Synthetic construct
GRGLQVF

SEQ ID NO: 7749 - protein, 7 aa, Artificial Sequence
  Synthetic construct
GRGLQVY

SEQ ID NO: 7750 - protein, 7 aa, Artificial Sequence
  Synthetic construct
GRGFIFF

SEQ ID NO: 7751 - protein, 7 aa, Artificial Sequence
  Synthetic construct
GRGFIFY

SEQ ID NO: 7752 - protein, 7 aa, Artificial Sequence
  Synthetic construct
GRGFIRF

SEQ ID NO: 7753 - protein, 7 aa, Artificial Sequence
  Synthetic construct
GRGFIRY

SEQ ID NO: 7754 - protein, 7 aa, Artificial Sequence
  Synthetic construct
GRGFICF

SEQ ID NO: 7755 - protein, 7 aa, Artificial Sequence
  Synthetic construct
GRGFICY

SEQ ID NO: 7756 - protein, 7 aa, Artificial Sequence
  Synthetic construct
GRGFILF

SEQ ID NO: 7757 - protein, 7 aa, Artificial Sequence
  Synthetic construct
GRGFILY

SEQ ID NO: 7758 - protein, 7 aa, Artificial Sequence
  Synthetic construct
GRGFIAF

SEQ ID NO: 7759 - protein, 7 aa, Artificial Sequence
  Synthetic construct
GRGFIAY

SEQ ID NO: 7760 - protein, 7 aa, Artificial Sequence
  Synthetic construct
GRGFIQF

SEQ ID NO: 7761 - protein, 7 aa, Artificial Sequence
  Synthetic construct
GRGFIQY

SEQ ID NO: 7762 - protein, 7 aa, Artificial Sequence
  Synthetic construct
GRGFIDF

SEQ ID NO: 7763 - protein, 7 aa, Artificial Sequence
  Synthetic construct
GRGFIDY

SEQ ID NO: 7764 - protein, 7 aa, Artificial Sequence
  Synthetic construct
GRGFIVF

SEQ ID NO: 7765 - protein, 7 aa, Artificial Sequence
  Synthetic construct
GRGFIVY

SEQ ID NO: 7766 - protein, 7 aa, Artificial Sequence
  Synthetic construct
GRGFDFF

SEQ ID NO: 7767 - protein, 7 aa, Artificial Sequence
  Synthetic construct
GRGFDFY

SEQ ID NO: 7768 - protein, 7 aa, Artificial Sequence
  Synthetic construct
GRGFDRF

SEQ ID NO: 7769 - protein, 7 aa, Artificial Sequence
  Synthetic construct
GRGFDRY

SEQ ID NO: 7770 - protein, 7 aa, Artificial Sequence
  Synthetic construct
GRGFDCF

SEQ ID NO: 7771 - protein, 7 aa, Artificial Sequence
  Synthetic construct
GRGFDCY

SEQ ID NO: 7772 - protein, 7 aa, Artificial Sequence
  Synthetic construct
GRGFDLF

SEQ ID NO: 7773 - protein, 7 aa, Artificial Sequence
  Synthetic construct
GRGFDLY

SEQ ID NO: 7774 - protein, 7 aa, Artificial Sequence
  Synthetic construct
GRGFDAF

SEQ ID NO: 7775 - protein, 7 aa, Artificial Sequence
  Synthetic construct
GRGFDAY

SEQ ID NO: 7776 - protein, 7 aa, Artificial Sequence
  Synthetic construct
GRGFDQF

SEQ ID NO: 7777 - protein, 7 aa, Artificial Sequence
  Synthetic construct
GRGFDQY

SEQ ID NO: 7778 - protein, 7 aa, Artificial Sequence
  Synthetic construct
GRGFDDF

SEQ ID NO: 7779 - protein, 7 aa, Artificial Sequence
  Synthetic construct
GRGFDDY

SEQ ID NO: 7780 - protein, 7 aa, Artificial Sequence
  Synthetic construct
GRGFDVF

SEQ ID NO: 7781 - protein, 7 aa, Artificial Sequence
  Synthetic construct
GRGFDVY

SEQ ID NO: 7782 - protein, 7 aa, Artificial Sequence
  Synthetic construct
GRGFYFF

SEQ ID NO: 7783 - protein, 7 aa, Artificial Sequence
  Synthetic construct
GRGFYFY

SEQ ID NO: 7784 - protein, 7 aa, Artificial Sequence
  Synthetic construct
GRGFYRF

SEQ ID NO: 7785 - protein, 7 aa, Artificial Sequence
  Synthetic construct
GRGFYRY

SEQ ID NO: 7786 - protein, 7 aa, Artificial Sequence
  Synthetic construct
GRGFYCF

SEQ ID NO: 7787 - protein, 7 aa, Artificial Sequence
  Synthetic construct
GRGFYCY

SEQ ID NO: 7788 - protein, 7 aa, Artificial Sequence
  Synthetic construct
GRGFYLF

SEQ ID NO: 7789 - protein, 7 aa, Artificial Sequence
  Synthetic construct
GRGFYLY

SEQ ID NO: 7790 - protein, 7 aa, Artificial Sequence
  Synthetic construct
GRGFYAF

SEQ ID NO: 7791 - protein, 7 aa, Artificial Sequence
  Synthetic construct
GRGFYAY

SEQ ID NO: 7792 - protein, 7 aa, Artificial Sequence
  Synthetic construct
GRGFYQF

SEQ ID NO: 7793 - protein, 7 aa, Artificial Sequence
  Synthetic construct
GRGFYQY

SEQ ID NO: 7794 - protein, 7 aa, Artificial Sequence
  Synthetic construct
GRGFYDF

SEQ ID NO: 7795 - protein, 7 aa, Artificial Sequence
  Synthetic construct
GRGFYDY

SEQ ID NO: 7796 - protein, 7 aa, Artificial Sequence
  Synthetic construct
GRGFYVF

SEQ ID NO: 7797 - protein, 7 aa, Artificial Sequence
  Synthetic construct
GRGFYVY

SEQ ID NO: 7798 - protein, 7 aa, Artificial Sequence
  Synthetic construct
GRGFFFF

SEQ ID NO: 7799 - protein, 7 aa, Artificial Sequence
  Synthetic construct
GRGFFFY

SEQ ID NO: 7800 - protein, 7 aa, Artificial Sequence
  Synthetic construct
GRGFFRF

SEQ ID NO: 7801 - protein, 7 aa, Artificial Sequence
  Synthetic construct
GRGFFRY

SEQ ID NO: 7802 - protein, 7 aa, Artificial Sequence
  Synthetic construct
GRGFFCF

SEQ ID NO: 7803 - protein, 7 aa, Artificial Sequence
  Synthetic construct
GRGFFCY

SEQ ID NO: 7804 - protein, 7 aa, Artificial Sequence
  Synthetic construct
GRGFFLF

SEQ ID NO: 7805 - protein, 7 aa, Artificial Sequence
  Synthetic construct
GRGFFLY

SEQ ID NO: 7806 - protein, 7 aa, Artificial Sequence
  Synthetic construct
GRGFFAF

SEQ ID NO: 7807 - protein, 7 aa, Artificial Sequence
  Synthetic construct
GRGFFAY

SEQ ID NO: 7808 - protein, 7 aa, Artificial Sequence
  Synthetic construct
GRGFFQF

SEQ ID NO: 7809 - protein, 7 aa, Artificial Sequence
  Synthetic construct
GRGFFQY

SEQ ID NO: 7810 - protein, 7 aa, Artificial Sequence
  Synthetic construct
GRGFFDF

SEQ ID NO: 7811 - protein, 7 aa, Artificial Sequence
  Synthetic construct
GRGFFDY

SEQ ID NO: 7812 - protein, 7 aa, Artificial Sequence
  Synthetic construct
GRGFFVF

SEQ ID NO: 7813 - protein, 7 aa, Artificial Sequence
  Synthetic construct
GRGFFVY

SEQ ID NO: 7814 - protein, 7 aa, Artificial Sequence
  Synthetic construct
GRGFVFF

SEQ ID NO: 7815 - protein, 7 aa, Artificial Sequence
  Synthetic construct
GRGFVFY

SEQ ID NO: 7816 - protein, 7 aa, Artificial Sequence
  Synthetic construct
GRGFVRF

SEQ ID NO: 7817 - protein, 7 aa, Artificial Sequence
  Synthetic construct
GRGFVRY

SEQ ID NO: 7818 - protein, 7 aa, Artificial Sequence
  Synthetic construct
GRGFVCF

SEQ ID NO: 7819 - protein, 7 aa, Artificial Sequence
  Synthetic construct
GRGFVCY

SEQ ID NO: 7820 - protein, 7 aa, Artificial Sequence
  Synthetic construct
GRGFVLF

SEQ ID NO: 7821 - protein, 7 aa, Artificial Sequence
  Synthetic construct
GRGFVLY

SEQ ID NO: 7822 - protein, 7 aa, Artificial Sequence
  Synthetic construct
GRGFVAF

SEQ ID NO: 7823 - protein, 7 aa, Artificial Sequence
  Synthetic construct
GRGFVAY

SEQ ID NO: 7824 - protein, 7 aa, Artificial Sequence
  Synthetic construct
GRGFVQF

SEQ ID NO: 7825 - protein, 7 aa, Artificial Sequence
  Synthetic construct
GRGFVQY

SEQ ID NO: 7826 - protein, 7 aa, Artificial Sequence
  Synthetic construct
GRGFVDF

SEQ ID NO: 7827 - protein, 7 aa, Artificial Sequence
  Synthetic construct
GRGFVDY

SEQ ID NO: 7828 - protein, 7 aa, Artificial Sequence
  Synthetic construct
GRGFVVF

SEQ ID NO: 7829 - protein, 7 aa, Artificial Sequence
  Synthetic construct
GRGFVVY

SEQ ID NO: 7830 - protein, 7 aa, Artificial Sequence
  Synthetic construct
GRGFTFF

SEQ ID NO: 7831 - protein, 7 aa, Artificial Sequence
  Synthetic construct
GRGFTFY

SEQ ID NO: 7832 - protein, 7 aa, Artificial Sequence
  Synthetic construct
GRGFTRF

SEQ ID NO: 7833 - protein, 7 aa, Artificial Sequence
  Synthetic construct
GRGFTRY

SEQ ID NO: 7834 - protein, 7 aa, Artificial Sequence
  Synthetic construct
GRGFTCF

SEQ ID NO: 7835 - protein, 7 aa, Artificial Sequence
  Synthetic construct
GRGFTCY

SEQ ID NO: 7836 - protein, 7 aa, Artificial Sequence
  Synthetic construct
GRGFTLF

SEQ ID NO: 7837 - protein, 7 aa, Artificial Sequence
  Synthetic construct
GRGFTLY

SEQ ID NO: 7838 - protein, 7 aa, Artificial Sequence
  Synthetic construct
GRGFTAF

SEQ ID NO: 7839 - protein, 7 aa, Artificial Sequence
  Synthetic construct
GRGFTAY

SEQ ID NO: 7840 - protein, 7 aa, Artificial Sequence
  Synthetic construct
GRGFTQF

SEQ ID NO: 7841 - protein, 7 aa, Artificial Sequence
  Synthetic construct
GRGFTQY

SEQ ID NO: 7842 - protein, 7 aa, Artificial Sequence
  Synthetic construct
GRGFTDF

SEQ ID NO: 7843 - protein, 7 aa, Artificial Sequence
  Synthetic construct
GRGFTDY

SEQ ID NO: 7844 - protein, 7 aa, Artificial Sequence
  Synthetic construct
GRGFTVF

SEQ ID NO: 7845 - protein, 7 aa, Artificial Sequence
  Synthetic construct
GRGFTVY

SEQ ID NO: 7846 - protein, 7 aa, Artificial Sequence
  Synthetic construct
GRGFGFF

SEQ ID NO: 7847 - protein, 7 aa, Artificial Sequence
  Synthetic construct
GRGFGFY

SEQ ID NO: 7848 - protein, 7 aa, Artificial Sequence
  Synthetic construct
GRGFGRF

SEQ ID NO: 7849 - protein, 7 aa, Artificial Sequence
  Synthetic construct
GRGFGRY

SEQ ID NO: 7850 - protein, 7 aa, Artificial Sequence
  Synthetic construct
GRGFGCF

SEQ ID NO: 7851 - protein, 7 aa, Artificial Sequence
  Synthetic construct
GRGFGCY

SEQ ID NO: 7852 - protein, 7 aa, Artificial Sequence
  Synthetic construct
GRGFGLF

SEQ ID NO: 7853 - protein, 7 aa, Artificial Sequence
  Synthetic construct
GRGFGLY

SEQ ID NO: 7854 - protein, 7 aa, Artificial Sequence
  Synthetic construct
GRGFGAF

SEQ ID NO: 7855 - protein, 7 aa, Artificial Sequence
  Synthetic construct
GRGFGAY

SEQ ID NO: 7856 - protein, 7 aa, Artificial Sequence
  Synthetic construct
GRGFGQF

SEQ ID NO: 7857 - protein, 7 aa, Artificial Sequence
  Synthetic construct
GRGFGQY

SEQ ID NO: 7858 - protein, 7 aa, Artificial Sequence
  Synthetic construct
GRGFGDF

SEQ ID NO: 7859 - protein, 7 aa, Artificial Sequence
  Synthetic construct
GRGFGDY

SEQ ID NO: 7860 - protein, 7 aa, Artificial Sequence
  Synthetic construct
GRGFGVF

SEQ ID NO: 7861 - protein, 7 aa, Artificial Sequence
  Synthetic construct
GRGFGVY

SEQ ID NO: 7862 - protein, 7 aa, Artificial Sequence
  Synthetic construct
GRGFAFF

SEQ ID NO: 7863 - protein, 7 aa, Artificial Sequence
  Synthetic construct
GRGFAFY

SEQ ID NO: 7864 - protein, 7 aa, Artificial Sequence
  Synthetic construct
GRGFARF

SEQ ID NO: 7865 - protein, 7 aa, Artificial Sequence
  Synthetic construct
GRGFARY

SEQ ID NO: 7866 - protein, 7 aa, Artificial Sequence
  Synthetic construct
GRGFACF

SEQ ID NO: 7867 - protein, 7 aa, Artificial Sequence
  Synthetic construct
GRGFACY

SEQ ID NO: 7868 - protein, 7 aa, Artificial Sequence
  Synthetic construct
GRGFALF

SEQ ID NO: 7869 - protein, 7 aa, Artificial Sequence
  Synthetic construct
GRGFALY

SEQ ID NO: 7870 - protein, 7 aa, Artificial Sequence
  Synthetic construct
GRGFAAF

SEQ ID NO: 7871 - protein, 7 aa, Artificial Sequence
  Synthetic construct
GRGFAAY

SEQ ID NO: 7872 - protein, 7 aa, Artificial Sequence
  Synthetic construct
GRGFAQF

SEQ ID NO: 7873 - protein, 7 aa, Artificial Sequence
  Synthetic construct
GRGFAQY

SEQ ID NO: 7874 - protein, 7 aa, Artificial Sequence
  Synthetic construct
GRGFADF

SEQ ID NO: 7875 - protein, 7 aa, Artificial Sequence
  Synthetic construct
GRGFADY

SEQ ID NO: 7876 - protein, 7 aa, Artificial Sequence
  Synthetic construct
GRGFAVF

SEQ ID NO: 7877 - protein, 7 aa, Artificial Sequence
  Synthetic construct
GRGFAVY

SEQ ID NO: 7878 - protein, 7 aa, Artificial Sequence
  Synthetic construct
GRGFQFF

SEQ ID NO: 7879 - protein, 7 aa, Artificial Sequence
  Synthetic construct
GRGFQFY

SEQ ID NO: 7880 - protein, 7 aa, Artificial Sequence
  Synthetic construct
GRGFQRF

SEQ ID NO: 7881 - protein, 7 aa, Artificial Sequence
  Synthetic construct
GRGFQRY

SEQ ID NO: 7882 - protein, 7 aa, Artificial Sequence
  Synthetic construct
GRGFQCF

SEQ ID NO: 7883 - protein, 7 aa, Artificial Sequence
  Synthetic construct
GRGFQCY

SEQ ID NO: 7884 - protein, 7 aa, Artificial Sequence
  Synthetic construct
GRGFQLF

SEQ ID NO: 7885 - protein, 7 aa, Artificial Sequence
  Synthetic construct
GRGFQLY

SEQ ID NO: 7886 - protein, 7 aa, Artificial Sequence
  Synthetic construct
GRGFQAF

SEQ ID NO: 7887 - protein, 7 aa, Artificial Sequence
  Synthetic construct
GRGFQAY

SEQ ID NO: 7888 - protein, 7 aa, Artificial Sequence
  Synthetic construct
GRGFQQF

SEQ ID NO: 7889 - protein, 7 aa, Artificial Sequence
  Synthetic construct
GRGFQQY

SEQ ID NO: 7890 - protein, 7 aa, Artificial Sequence
  Synthetic construct
GRGFQDF

SEQ ID NO: 7891 - protein, 7 aa, Artificial Sequence
  Synthetic construct
GRGFQDY

SEQ ID NO: 7892 - protein, 7 aa, Artificial Sequence
  Synthetic construct
GRGFQVF

SEQ ID NO: 7893 - protein, 7 aa, Artificial Sequence
  Synthetic construct
GRGFQVY

SEQ ID NO: 7894 - protein, 7 aa, Artificial Sequence
  Synthetic construct
GMIYIFF

SEQ ID NO: 7895 - protein, 7 aa, Artificial Sequence
  Synthetic construct
GMIYIFY

SEQ ID NO: 7896 - protein, 7 aa, Artificial Sequence
  Synthetic construct
GMIYIRF

SEQ ID NO: 7897 - protein, 7 aa, Artificial Sequence
  Synthetic construct
GMIYIRY

SEQ ID NO: 7898 - protein, 7 aa, Artificial Sequence
  Synthetic construct
GMIYICF

SEQ ID NO: 7899 - protein, 7 aa, Artificial Sequence
  Synthetic construct
GMIYICY

SEQ ID NO: 7900 - protein, 7 aa, Artificial Sequence
  Synthetic construct
GMIYILF

SEQ ID NO: 7901 - protein, 7 aa, Artificial Sequence
  Synthetic construct
GMIYILY

SEQ ID NO: 7902 - protein, 7 aa, Artificial Sequence
  Synthetic construct
GMIYIAF

SEQ ID NO: 7903 - protein, 7 aa, Artificial Sequence
  Synthetic construct
GMIYIAY

SEQ ID NO: 7904 - protein, 7 aa, Artificial Sequence
  Synthetic construct
GMIYIQF

SEQ ID NO: 7905 - protein, 7 aa, Artificial Sequence
  Synthetic construct
GMIYIQY

SEQ ID NO: 7906 - protein, 7 aa, Artificial Sequence
  Synthetic construct
GMIYIDF

SEQ ID NO: 7907 - protein, 7 aa, Artificial Sequence
  Synthetic construct
GMIYIDY

SEQ ID NO: 7908 - protein, 7 aa, Artificial Sequence
  Synthetic construct
GMIYIVF

SEQ ID NO: 7909 - protein, 7 aa, Artificial Sequence
  Synthetic construct
GMIYIVY

SEQ ID NO: 7910 - protein, 7 aa, Artificial Sequence
  Synthetic construct
GMIYDFF

SEQ ID NO: 7911 - protein, 7 aa, Artificial Sequence
  Synthetic construct
GMIYDFY

SEQ ID NO: 7912 - protein, 7 aa, Artificial Sequence
  Synthetic construct
GMIYDRF

SEQ ID NO: 7913 - protein, 7 aa, Artificial Sequence
  Synthetic construct
GMIYDRY

SEQ ID NO: 7914 - protein, 7 aa, Artificial Sequence
  Synthetic construct
GMIYDCF

SEQ ID NO: 7915 - protein, 7 aa, Artificial Sequence
  Synthetic construct
GMIYDCY

SEQ ID NO: 7916 - protein, 7 aa, Artificial Sequence
  Synthetic construct
GMIYDLF

SEQ ID NO: 7917 - protein, 7 aa, Artificial Sequence
  Synthetic construct
GMIYDLY

SEQ ID NO: 7918 - protein, 7 aa, Artificial Sequence
  Synthetic construct
GMIYDAF

SEQ ID NO: 7919 - protein, 7 aa, Artificial Sequence
  Synthetic construct
GMIYDAY

SEQ ID NO: 7920 - protein, 7 aa, Artificial Sequence
  Synthetic construct
GMIYDQF

SEQ ID NO: 7921 - protein, 7 aa, Artificial Sequence
  Synthetic construct
GMIYDQY

SEQ ID NO: 7922 - protein, 7 aa, Artificial Sequence
  Synthetic construct
GMIYDDF

SEQ ID NO: 7923 - protein, 7 aa, Artificial Sequence
  Synthetic construct
GMIYDDY

SEQ ID NO: 7924 - protein, 7 aa, Artificial Sequence
  Synthetic construct
GMIYDVF

SEQ ID NO: 7925 - protein, 7 aa, Artificial Sequence
  Synthetic construct
GMIYDVY

SEQ ID NO: 7926 - protein, 7 aa, Artificial Sequence
  Synthetic construct
GMIYYFF

SEQ ID NO: 7927 - protein, 7 aa, Artificial Sequence
  Synthetic construct
GMIYYFY

SEQ ID NO: 7928 - protein, 7 aa, Artificial Sequence
  Synthetic construct
GMIYYRF

SEQ ID NO: 7929 - protein, 7 aa, Artificial Sequence
  Synthetic construct
GMIYYRY

SEQ ID NO: 7930 - protein, 7 aa, Artificial Sequence
  Synthetic construct
GMIYYCF

SEQ ID NO: 7931 - protein, 7 aa, Artificial Sequence
  Synthetic construct
GMIYYCY

SEQ ID NO: 7932 - protein, 7 aa, Artificial Sequence
  Synthetic construct
GMIYYLF

SEQ ID NO: 7933 - protein, 7 aa, Artificial Sequence
  Synthetic construct
GMIYYLY

SEQ ID NO: 7934 - protein, 7 aa, Artificial Sequence
  Synthetic construct
GMIYYAF

SEQ ID NO: 7935 - protein, 7 aa, Artificial Sequence
  Synthetic construct
GMIYYAY

SEQ ID NO: 7936 - protein, 7 aa, Artificial Sequence
  Synthetic construct
GMIYYQF

SEQ ID NO: 7937 - protein, 7 aa, Artificial Sequence
  Synthetic construct
GMIYYQY

SEQ ID NO: 7938 - protein, 7 aa, Artificial Sequence
  Synthetic construct
GMIYYDF

SEQ ID NO: 7939 - protein, 7 aa, Artificial Sequence
  Synthetic construct
GMIYYDY

SEQ ID NO: 7940 - protein, 7 aa, Artificial Sequence
  Synthetic construct
GMIYYVF

SEQ ID NO: 7941 - protein, 7 aa, Artificial Sequence
  Synthetic construct
GMIYYVY

SEQ ID NO: 7942 - protein, 7 aa, Artificial Sequence
  Synthetic construct
GMIYFFF

SEQ ID NO: 7943 - protein, 7 aa, Artificial Sequence
  Synthetic construct
GMIYFFY

SEQ ID NO: 7944 - protein, 7 aa, Artificial Sequence
  Synthetic construct
GMIYFRF

SEQ ID NO: 7945 - protein, 7 aa, Artificial Sequence
  Synthetic construct
GMIYFRY

SEQ ID NO: 7946 - protein, 7 aa, Artificial Sequence
  Synthetic construct
GMIYFCF

SEQ ID NO: 7947 - protein, 7 aa, Artificial Sequence
  Synthetic construct
GMIYFCY

SEQ ID NO: 7948 - protein, 7 aa, Artificial Sequence
  Synthetic construct
GMIYFLF

SEQ ID NO: 7949 - protein, 7 aa, Artificial Sequence
  Synthetic construct
GMIYFLY

SEQ ID NO: 7950 - protein, 7 aa, Artificial Sequence
  Synthetic construct
GMIYFAF

SEQ ID NO: 7951 - protein, 7 aa, Artificial Sequence
  Synthetic construct
GMIYFAY

SEQ ID NO: 7952 - protein, 7 aa, Artificial Sequence
  Synthetic construct
GMIYFQF

SEQ ID NO: 7953 - protein, 7 aa, Artificial Sequence
  Synthetic construct
GMIYFQY

SEQ ID NO: 7954 - protein, 7 aa, Artificial Sequence
  Synthetic construct
GMIYFDF

SEQ ID NO: 7955 - protein, 7 aa, Artificial Sequence
  Synthetic construct
GMIYFDY

SEQ ID NO: 7956 - protein, 7 aa, Artificial Sequence
  Synthetic construct
GMIYFVF

SEQ ID NO: 7957 - protein, 7 aa, Artificial Sequence
  Synthetic construct
GMIYFVY

SEQ ID NO: 7958 - protein, 7 aa, Artificial Sequence
  Synthetic construct
GMIYVFF

SEQ ID NO: 7959 - protein, 7 aa, Artificial Sequence
  Synthetic construct
GMIYVFY

SEQ ID NO: 7960 - protein, 7 aa, Artificial Sequence
  Synthetic construct
GMIYVRF

SEQ ID NO: 7961 - protein, 7 aa, Artificial Sequence
  Synthetic construct
GMIYVRY

SEQ ID NO: 7962 - protein, 7 aa, Artificial Sequence
  Synthetic construct
GMIYVCF

SEQ ID NO: 7963 - protein, 7 aa, Artificial Sequence
  Synthetic construct
GMIYVCY

SEQ ID NO: 7964 - protein, 7 aa, Artificial Sequence
  Synthetic construct
GMIYVLF

SEQ ID NO: 7965 - protein, 7 aa, Artificial Sequence
  Synthetic construct
GMIYVLY

SEQ ID NO: 7966 - protein, 7 aa, Artificial Sequence
  Synthetic construct
GMIYVAF

SEQ ID NO: 7967 - protein, 7 aa, Artificial Sequence
  Synthetic construct
GMIYVAY

SEQ ID NO: 7968 - protein, 7 aa, Artificial Sequence
  Synthetic construct
GMIYVQF

SEQ ID NO: 7969 - protein, 7 aa, Artificial Sequence
  Synthetic construct
GMIYVQY

SEQ ID NO: 7970 - protein, 7 aa, Artificial Sequence
  Synthetic construct
GMIYVDF

SEQ ID NO: 7971 - protein, 7 aa, Artificial Sequence
  Synthetic construct
GMIYVDY

SEQ ID NO: 7972 - protein, 7 aa, Artificial Sequence
  Synthetic construct
GMIYVVF

SEQ ID NO: 7973 - protein, 7 aa, Artificial Sequence
  Synthetic construct
GMIYVVY

SEQ ID NO: 7974 - protein, 7 aa, Artificial Sequence
  Synthetic construct
GMIYTFF

SEQ ID NO: 7975 - protein, 7 aa, Artificial Sequence
  Synthetic construct
GMIYTFY

SEQ ID NO: 7976 - protein, 7 aa, Artificial Sequence
  Synthetic construct
GMIYTRF

SEQ ID NO: 7977 - protein, 7 aa, Artificial Sequence
  Synthetic construct
GMIYTRY

SEQ ID NO: 7978 - protein, 7 aa, Artificial Sequence
  Synthetic construct
GMIYTCF

SEQ ID NO: 7979 - protein, 7 aa, Artificial Sequence
  Synthetic construct
GMIYTCY

SEQ ID NO: 7980 - protein, 7 aa, Artificial Sequence
  Synthetic construct
GMIYTLF

SEQ ID NO: 7981 - protein, 7 aa, Artificial Sequence
  Synthetic construct
GMIYTLY

SEQ ID NO: 7982 - protein, 7 aa, Artificial Sequence
  Synthetic construct
GMIYTAF

SEQ ID NO: 7983 - protein, 7 aa, Artificial Sequence
  Synthetic construct
GMIYTAY

SEQ ID NO: 7984 - protein, 7 aa, Artificial Sequence
  Synthetic construct
GMIYTQF

SEQ ID NO: 7985 - protein, 7 aa, Artificial Sequence
  Synthetic construct
GMIYTQY

SEQ ID NO: 7986 - protein, 7 aa, Artificial Sequence
  Synthetic construct
GMIYTDF

SEQ ID NO: 7987 - protein, 7 aa, Artificial Sequence
  Synthetic construct
GMIYTDY

SEQ ID NO: 7988 - protein, 7 aa, Artificial Sequence
  Synthetic construct
GMIYTVF

SEQ ID NO: 7989 - protein, 7 aa, Artificial Sequence
  Synthetic construct
GMIYTVY

SEQ ID NO: 7990 - protein, 7 aa, Artificial Sequence
  Synthetic construct
GMIYGFF

SEQ ID NO: 7991 - protein, 7 aa, Artificial Sequence
  Synthetic construct
GMIYGFY

SEQ ID NO: 7992 - protein, 7 aa, Artificial Sequence
  Synthetic construct
GMIYGRF

SEQ ID NO: 7993 - protein, 7 aa, Artificial Sequence
  Synthetic construct
GMIYGRY

SEQ ID NO: 7994 - protein, 7 aa, Artificial Sequence
  Synthetic construct
GMIYGCF

SEQ ID NO: 7995 - protein, 7 aa, Artificial Sequence
  Synthetic construct
GMIYGCY

SEQ ID NO: 7996 - protein, 7 aa, Artificial Sequence
  Synthetic construct
GMIYGLF

SEQ ID NO: 7997 - protein, 7 aa, Artificial Sequence
  Synthetic construct
GMIYGLY

SEQ ID NO: 7998 - protein, 7 aa, Artificial Sequence
  Synthetic construct
GMIYGAF

SEQ ID NO: 7999 - protein, 7 aa, Artificial Sequence
  Synthetic construct
GMIYGAY

SEQ ID NO: 8000 - protein, 7 aa, Artificial Sequence
  Synthetic construct
GMIYGQF

SEQ ID NO: 8001 - protein, 7 aa, Artificial Sequence
  Synthetic construct
GMIYGQY

SEQ ID NO: 8002 - protein, 7 aa, Artificial Sequence
  Synthetic construct
GMIYGDF

SEQ ID NO: 8003 - protein, 7 aa, Artificial Sequence
  Synthetic construct
GMIYGDY

SEQ ID NO: 8004 - protein, 7 aa, Artificial Sequence
  Synthetic construct
GMIYGVF

SEQ ID NO: 8005 - protein, 7 aa, Artificial Sequence
  Synthetic construct
GMIYGVY

SEQ ID NO: 8006 - protein, 7 aa, Artificial Sequence
  Synthetic construct
GMIYAFF

SEQ ID NO: 8007 - protein, 7 aa, Artificial Sequence
  Synthetic construct
GMIYAFY

SEQ ID NO: 8008 - protein, 7 aa, Artificial Sequence
  Synthetic construct
GMIYARF

SEQ ID NO: 8009 - protein, 7 aa, Artificial Sequence
  Synthetic construct
GMIYARY

SEQ ID NO: 8010 - protein, 7 aa, Artificial Sequence
  Synthetic construct
GMIYACF

SEQ ID NO: 8011 - protein, 7 aa, Artificial Sequence
  Synthetic construct
GMIYACY

SEQ ID NO: 8012 - protein, 7 aa, Artificial Sequence
  Synthetic construct
GMIYALF

SEQ ID NO: 8013 - protein, 7 aa, Artificial Sequence
  Synthetic construct
GMIYALY

SEQ ID NO: 8014 - protein, 7 aa, Artificial Sequence
  Synthetic construct
GMIYAAF

SEQ ID NO: 8015 - protein, 7 aa, Artificial Sequence
  Synthetic construct
GMIYAAY

SEQ ID NO: 8016 - protein, 7 aa, Artificial Sequence
  Synthetic construct
GMIYAQF

SEQ ID NO: 8017 - protein, 7 aa, Artificial Sequence
  Synthetic construct
GMIYAQY

SEQ ID NO: 8018 - protein, 7 aa, Artificial Sequence
  Synthetic construct
GMIYADF

SEQ ID NO: 8019 - protein, 7 aa, Artificial Sequence
  Synthetic construct
GMIYADY

SEQ ID NO: 8020 - protein, 7 aa, Artificial Sequence
  Synthetic construct
GMIYAVF

SEQ ID NO: 8021 - protein, 7 aa, Artificial Sequence
  Synthetic construct
GMIYAVY

SEQ ID NO: 8022 - protein, 7 aa, Artificial Sequence
  Synthetic construct
GMIYQFF

SEQ ID NO: 8023 - protein, 7 aa, Artificial Sequence
  Synthetic construct
GMIYQFY

SEQ ID NO: 8024 - protein, 7 aa, Artificial Sequence
  Synthetic construct
GMIYQRF

SEQ ID NO: 8025 - protein, 7 aa, Artificial Sequence
  Synthetic construct
GMIYQRY

SEQ ID NO: 8026 - protein, 7 aa, Artificial Sequence
  Synthetic construct
GMIYQCF

SEQ ID NO: 8027 - protein, 7 aa, Artificial Sequence
  Synthetic construct
GMIYQCY

SEQ ID NO: 8028 - protein, 7 aa, Artificial Sequence
  Synthetic construct
GMIYQLF

SEQ ID NO: 8029 - protein, 7 aa, Artificial Sequence
  Synthetic construct
GMIYQLY

SEQ ID NO: 8030 - protein, 7 aa, Artificial Sequence
  Synthetic construct
GMIYQAF

SEQ ID NO: 8031 - protein, 7 aa, Artificial Sequence
  Synthetic construct
GMIYQAY

SEQ ID NO: 8032 - protein, 7 aa, Artificial Sequence
  Synthetic construct
GMIYQQF

SEQ ID NO: 8033 - protein, 7 aa, Artificial Sequence
  Synthetic construct
GMIYQQY

SEQ ID NO: 8034 - protein, 7 aa, Artificial Sequence
  Synthetic construct
GMIYQDF

SEQ ID NO: 8035 - protein, 7 aa, Artificial Sequence
  Synthetic construct
GMIYQDY

SEQ ID NO: 8036 - protein, 7 aa, Artificial Sequence
  Synthetic construct
GMIYQVF

SEQ ID NO: 8037 - protein, 7 aa, Artificial Sequence
  Synthetic construct
GMIYQVY

SEQ ID NO: 8038 - protein, 7 aa, Artificial Sequence
  Synthetic construct
GMIPIFF

SEQ ID NO: 8039 - protein, 7 aa, Artificial Sequence
  Synthetic construct
GMIPIFY

SEQ ID NO: 8040 - protein, 7 aa, Artificial Sequence
  Synthetic construct
GMIPIRF

SEQ ID NO: 8041 - protein, 7 aa, Artificial Sequence
  Synthetic construct
GMIPIRY

SEQ ID NO: 8042 - protein, 7 aa, Artificial Sequence
  Synthetic construct
GMIPICF

SEQ ID NO: 8043 - protein, 7 aa, Artificial Sequence
  Synthetic construct
GMIPICY

SEQ ID NO: 8044 - protein, 7 aa, Artificial Sequence
  Synthetic construct
GMIPILF

SEQ ID NO: 8045 - protein, 7 aa, Artificial Sequence
  Synthetic construct
GMIPILY

SEQ ID NO: 8046 - protein, 7 aa, Artificial Sequence
  Synthetic construct
GMIPIAF

SEQ ID NO: 8047 - protein, 7 aa, Artificial Sequence
  Synthetic construct
GMIPIAY

SEQ ID NO: 8048 - protein, 7 aa, Artificial Sequence
  Synthetic construct
GMIPIQF

SEQ ID NO: 8049 - protein, 7 aa, Artificial Sequence
  Synthetic construct
GMIPIQY

SEQ ID NO: 8050 - protein, 7 aa, Artificial Sequence
  Synthetic construct
GMIPIDF

SEQ ID NO: 8051 - protein, 7 aa, Artificial Sequence
  Synthetic construct
GMIPIDY

SEQ ID NO: 8052 - protein, 7 aa, Artificial Sequence
  Synthetic construct
GMIPIVF

SEQ ID NO: 8053 - protein, 7 aa, Artificial Sequence
  Synthetic construct
GMIPIVY

SEQ ID NO: 8054 - protein, 7 aa, Artificial Sequence
  Synthetic construct
GMIPDFF

SEQ ID NO: 8055 - protein, 7 aa, Artificial Sequence
  Synthetic construct
GMIPDFY

SEQ ID NO: 8056 - protein, 7 aa, Artificial Sequence
  Synthetic construct
GMIPDRF

SEQ ID NO: 8057 - protein, 7 aa, Artificial Sequence
  Synthetic construct
GMIPDRY

SEQ ID NO: 8058 - protein, 7 aa, Artificial Sequence
  Synthetic construct
GMIPDCF

SEQ ID NO: 8059 - protein, 7 aa, Artificial Sequence
  Synthetic construct
GMIPDCY

SEQ ID NO: 8060 - protein, 7 aa, Artificial Sequence
  Synthetic construct
GMIPDLF

SEQ ID NO: 8061 - protein, 7 aa, Artificial Sequence
  Synthetic construct
GMIPDLY

SEQ ID NO: 8062 - protein, 7 aa, Artificial Sequence
  Synthetic construct
GMIPDAF

SEQ ID NO: 8063 - protein, 7 aa, Artificial Sequence
  Synthetic construct
GMIPDAY

SEQ ID NO: 8064 - protein, 7 aa, Artificial Sequence
  Synthetic construct
GMIPDQF

SEQ ID NO: 8065 - protein, 7 aa, Artificial Sequence
  Synthetic construct
GMIPDQY

SEQ ID NO: 8066 - protein, 7 aa, Artificial Sequence
  Synthetic construct
GMIPDDF

SEQ ID NO: 8067 - protein, 7 aa, Artificial Sequence
  Synthetic construct
GMIPDDY

SEQ ID NO: 8068 - protein, 7 aa, Artificial Sequence
  Synthetic construct
GMIPDVF

SEQ ID NO: 8069 - protein, 7 aa, Artificial Sequence
  Synthetic construct
GMIPDVY

SEQ ID NO: 8070 - protein, 7 aa, Artificial Sequence
  Synthetic construct
GMIPYFF

SEQ ID NO: 8071 - protein, 7 aa, Artificial Sequence
  Synthetic construct
GMIPYFY

SEQ ID NO: 8072 - protein, 7 aa, Artificial Sequence
  Synthetic construct
GMIPYRF

SEQ ID NO: 8073 - protein, 7 aa, Artificial Sequence
  Synthetic construct
GMIPYRY

SEQ ID NO: 8074 - protein, 7 aa, Artificial Sequence
  Synthetic construct
GMIPYCF

SEQ ID NO: 8075 - protein, 7 aa, Artificial Sequence
  Synthetic construct
GMIPYCY

SEQ ID NO: 8076 - protein, 7 aa, Artificial Sequence
  Synthetic construct
GMIPYLF

SEQ ID NO: 8077 - protein, 7 aa, Artificial Sequence
  Synthetic construct
GMIPYLY

SEQ ID NO: 8078 - protein, 7 aa, Artificial Sequence
  Synthetic construct
GMIPYAF

SEQ ID NO: 8079 - protein, 7 aa, Artificial Sequence
  Synthetic construct
GMIPYAY

SEQ ID NO: 8080 - protein, 7 aa, Artificial Sequence
  Synthetic construct
GMIPYQF

SEQ ID NO: 8081 - protein, 7 aa, Artificial Sequence
  Synthetic construct
GMIPYQY

SEQ ID NO: 8082 - protein, 7 aa, Artificial Sequence
  Synthetic construct
GMIPYDF

SEQ ID NO: 8083 - protein, 7 aa, Artificial Sequence
  Synthetic construct
GMIPYDY

SEQ ID NO: 8084 - protein, 7 aa, Artificial Sequence
  Synthetic construct
GMIPYVF

SEQ ID NO: 8085 - protein, 7 aa, Artificial Sequence
  Synthetic construct
GMIPYVY

SEQ ID NO: 8086 - protein, 7 aa, Artificial Sequence
  Synthetic construct
GMIPFFF

SEQ ID NO: 8087 - protein, 7 aa, Artificial Sequence
  Synthetic construct
GMIPFFY

SEQ ID NO: 8088 - protein, 7 aa, Artificial Sequence
  Synthetic construct
GMIPFRF

SEQ ID NO: 8089 - protein, 7 aa, Artificial Sequence
  Synthetic construct
GMIPFRY

SEQ ID NO: 8090 - protein, 7 aa, Artificial Sequence
  Synthetic construct
GMIPFCF

SEQ ID NO: 8091 - protein, 7 aa, Artificial Sequence
  Synthetic construct
GMIPFCY

SEQ ID NO: 8092 - protein, 7 aa, Artificial Sequence
  Synthetic construct
GMIPFLF

SEQ ID NO: 8093 - protein, 7 aa, Artificial Sequence
  Synthetic construct
GMIPFLY

SEQ ID NO: 8094 - protein, 7 aa, Artificial Sequence
  Synthetic construct
GMIPFAF

SEQ ID NO: 8095 - protein, 7 aa, Artificial Sequence
  Synthetic construct
GMIPFAY

SEQ ID NO: 8096 - protein, 7 aa, Artificial Sequence
  Synthetic construct
GMIPFQF

SEQ ID NO: 8097 - protein, 7 aa, Artificial Sequence
  Synthetic construct
GMIPFQY

SEQ ID NO: 8098 - protein, 7 aa, Artificial Sequence
  Synthetic construct
GMIPFDF

SEQ ID NO: 8099 - protein, 7 aa, Artificial Sequence
  Synthetic construct
GMIPFDY

SEQ ID NO: 8100 - protein, 7 aa, Artificial Sequence
  Synthetic construct
GMIPFVF

SEQ ID NO: 8101 - protein, 7 aa, Artificial Sequence
  Synthetic construct
GMIPFVY

SEQ ID NO: 8102 - protein, 7 aa, Artificial Sequence
  Synthetic construct
GMIPVFF

SEQ ID NO: 8103 - protein, 7 aa, Artificial Sequence
  Synthetic construct
GMIPVFY

SEQ ID NO: 8104 - protein, 7 aa, Artificial Sequence
  Synthetic construct
GMIPVRF

SEQ ID NO: 8105 - protein, 7 aa, Artificial Sequence
  Synthetic construct
GMIPVRY

SEQ ID NO: 8106 - protein, 7 aa, Artificial Sequence
  Synthetic construct
GMIPVCF

SEQ ID NO: 8107 - protein, 7 aa, Artificial Sequence
  Synthetic construct
GMIPVCY

SEQ ID NO: 8108 - protein, 7 aa, Artificial Sequence
  Synthetic construct
GMIPVLF

SEQ ID NO: 8109 - protein, 7 aa, Artificial Sequence
  Synthetic construct
GMIPVLY

SEQ ID NO: 8110 - protein, 7 aa, Artificial Sequence
  Synthetic construct
GMIPVAF

SEQ ID NO: 8111 - protein, 7 aa, Artificial Sequence
  Synthetic construct
GMIPVAY

SEQ ID NO: 8112 - protein, 7 aa, Artificial Sequence
  Synthetic construct
GMIPVQF

SEQ ID NO: 8113 - protein, 7 aa, Artificial Sequence
  Synthetic construct
GMIPVQY

SEQ ID NO: 8114 - protein, 7 aa, Artificial Sequence
  Synthetic construct
GMIPVDF

SEQ ID NO: 8115 - protein, 7 aa, Artificial Sequence
  Synthetic construct
GMIPVDY

SEQ ID NO: 8116 - protein, 7 aa, Artificial Sequence
  Synthetic construct
GMIPVVF

SEQ ID NO: 8117 - protein, 7 aa, Artificial Sequence
  Synthetic construct
GMIPVVY

SEQ ID NO: 8118 - protein, 7 aa, Artificial Sequence
  Synthetic construct
GMIPTFF

SEQ ID NO: 8119 - protein, 7 aa, Artificial Sequence
  Synthetic construct
GMIPTFY

SEQ ID NO: 8120 - protein, 7 aa, Artificial Sequence
  Synthetic construct
GMIPTRF

SEQ ID NO: 8121 - protein, 7 aa, Artificial Sequence
  Synthetic construct
GMIPTRY

SEQ ID NO: 8122 - protein, 7 aa, Artificial Sequence
  Synthetic construct
GMIPTCF

SEQ ID NO: 8123 - protein, 7 aa, Artificial Sequence
  Synthetic construct
GMIPTCY

SEQ ID NO: 8124 - protein, 7 aa, Artificial Sequence
  Synthetic construct
GMIPTLF

SEQ ID NO: 8125 - protein, 7 aa, Artificial Sequence
  Synthetic construct
GMIPTLY

SEQ ID NO: 8126 - protein, 7 aa, Artificial Sequence
  Synthetic construct
GMIPTAF

SEQ ID NO: 8127 - protein, 7 aa, Artificial Sequence
  Synthetic construct
GMIPTAY

SEQ ID NO: 8128 - protein, 7 aa, Artificial Sequence
  Synthetic construct
GMIPTQF

SEQ ID NO: 8129 - protein, 7 aa, Artificial Sequence
  Synthetic construct
GMIPTQY

SEQ ID NO: 8130 - protein, 7 aa, Artificial Sequence
  Synthetic construct
GMIPTDF

SEQ ID NO: 8131 - protein, 7 aa, Artificial Sequence
  Synthetic construct
GMIPTDY

SEQ ID NO: 8132 - protein, 7 aa, Artificial Sequence
  Synthetic construct
GMIPTVF

SEQ ID NO: 8133 - protein, 7 aa, Artificial Sequence
  Synthetic construct
GMIPTVY

SEQ ID NO: 8134 - protein, 7 aa, Artificial Sequence
  Synthetic construct
GMIPGFF

SEQ ID NO: 8135 - protein, 7 aa, Artificial Sequence
  Synthetic construct
GMIPGFY

SEQ ID NO: 8136 - protein, 7 aa, Artificial Sequence
  Synthetic construct
GMIPGRF

SEQ ID NO: 8137 - protein, 7 aa, Artificial Sequence
  Synthetic construct
GMIPGRY

SEQ ID NO: 8138 - protein, 7 aa, Artificial Sequence
  Synthetic construct
GMIPGCF

SEQ ID NO: 8139 - protein, 7 aa, Artificial Sequence
  Synthetic construct
GMIPGCY

SEQ ID NO: 8140 - protein, 7 aa, Artificial Sequence
  Synthetic construct
GMIPGLF

SEQ ID NO: 8141 - protein, 7 aa, Artificial Sequence
  Synthetic construct
GMIPGLY

SEQ ID NO: 8142 - protein, 7 aa, Artificial Sequence
  Synthetic construct
GMIPGAF

SEQ ID NO: 8143 - protein, 7 aa, Artificial Sequence
  Synthetic construct
GMIPGAY

SEQ ID NO: 8144 - protein, 7 aa, Artificial Sequence
  Synthetic construct
GMIPGQF

SEQ ID NO: 8145 - protein, 7 aa, Artificial Sequence
  Synthetic construct
GMIPGQY

SEQ ID NO: 8146 - protein, 7 aa, Artificial Sequence
  Synthetic construct
GMIPGDF

SEQ ID NO: 8147 - protein, 7 aa, Artificial Sequence
  Synthetic construct
GMIPGDY

SEQ ID NO: 8148 - protein, 7 aa, Artificial Sequence
  Synthetic construct
GMIPGVF

SEQ ID NO: 8149 - protein, 7 aa, Artificial Sequence
  Synthetic construct
GMIPGVY

SEQ ID NO: 8150 - protein, 7 aa, Artificial Sequence
  Synthetic construct
GMIPAFF

SEQ ID NO: 8151 - protein, 7 aa, Artificial Sequence
  Synthetic construct
GMIPAFY

SEQ ID NO: 8152 - protein, 7 aa, Artificial Sequence
  Synthetic construct
GMIPARF

SEQ ID NO: 8153 - protein, 7 aa, Artificial Sequence
  Synthetic construct
GMIPARY

SEQ ID NO: 8154 - protein, 7 aa, Artificial Sequence
  Synthetic construct
GMIPACF

SEQ ID NO: 8155 - protein, 7 aa, Artificial Sequence
  Synthetic construct
GMIPACY

SEQ ID NO: 8156 - protein, 7 aa, Artificial Sequence
  Synthetic construct
GMIPALF

SEQ ID NO: 8157 - protein, 7 aa, Artificial Sequence
  Synthetic construct
GMIPALY

SEQ ID NO: 8158 - protein, 7 aa, Artificial Sequence
  Synthetic construct
GMIPAAF

SEQ ID NO: 8159 - protein, 7 aa, Artificial Sequence
  Synthetic construct
GMIPAAY

SEQ ID NO: 8160 - protein, 7 aa, Artificial Sequence
  Synthetic construct
GMIPAQF

SEQ ID NO: 8161 - protein, 7 aa, Artificial Sequence
  Synthetic construct
GMIPAQY

SEQ ID NO: 8162 - protein, 7 aa, Artificial Sequence
  Synthetic construct
GMIPADF

SEQ ID NO: 8163 - protein, 7 aa, Artificial Sequence
  Synthetic construct
GMIPADY

SEQ ID NO: 8164 - protein, 7 aa, Artificial Sequence
  Synthetic construct
GMIPAVF

SEQ ID NO: 8165 - protein, 7 aa, Artificial Sequence
  Synthetic construct
GMIPAVY

SEQ ID NO: 8166 - protein, 7 aa, Artificial Sequence
  Synthetic construct
GMIPQFF

SEQ ID NO: 8167 - protein, 7 aa, Artificial Sequence
  Synthetic construct
GMIPQFY

SEQ ID NO: 8168 - protein, 7 aa, Artificial Sequence
  Synthetic construct
GMIPQRF

SEQ ID NO: 8169 - protein, 7 aa, Artificial Sequence
  Synthetic construct
GMIPQRY

SEQ ID NO: 8170 - protein, 7 aa, Artificial Sequence
  Synthetic construct
GMIPQCF

SEQ ID NO: 8171 - protein, 7 aa, Artificial Sequence
  Synthetic construct
GMIPQCY

SEQ ID NO: 8172 - protein, 7 aa, Artificial Sequence
  Synthetic construct
GMIPQLF

SEQ ID NO: 8173 - protein, 7 aa, Artificial Sequence
  Synthetic construct
GMIPQLY

SEQ ID NO: 8174 - protein, 7 aa, Artificial Sequence
  Synthetic construct
GMIPQAF

SEQ ID NO: 8175 - protein, 7 aa, Artificial Sequence
  Synthetic construct
GMIPQAY

SEQ ID NO: 8176 - protein, 7 aa, Artificial Sequence
  Synthetic construct
GMIPQQF

SEQ ID NO: 8177 - protein, 7 aa, Artificial Sequence
  Synthetic construct
GMIPQQY

SEQ ID NO: 8178 - protein, 7 aa, Artificial Sequence
  Synthetic construct
GMIPQDF

SEQ ID NO: 8179 - protein, 7 aa, Artificial Sequence
  Synthetic construct
GMIPQDY

SEQ ID NO: 8180 - protein, 7 aa, Artificial Sequence
  Synthetic construct
GMIPQVF

SEQ ID NO: 8181 - protein, 7 aa, Artificial Sequence
  Synthetic construct
GMIPQVY

SEQ ID NO: 8182 - protein, 7 aa, Artificial Sequence
  Synthetic construct
GMIHIFF

SEQ ID NO: 8183 - protein, 7 aa, Artificial Sequence
  Synthetic construct
GMIHIFY

SEQ ID NO: 8184 - protein, 7 aa, Artificial Sequence
  Synthetic construct
GMIHIRF

SEQ ID NO: 8185 - protein, 7 aa, Artificial Sequence
  Synthetic construct
GMIHIRY

SEQ ID NO: 8186 - protein, 7 aa, Artificial Sequence
  Synthetic construct
GMIHICF

SEQ ID NO: 8187 - protein, 7 aa, Artificial Sequence
  Synthetic construct
GMIHICY

SEQ ID NO: 8188 - protein, 7 aa, Artificial Sequence
  Synthetic construct
GMIHILF

SEQ ID NO: 8189 - protein, 7 aa, Artificial Sequence
  Synthetic construct
GMIHILY

SEQ ID NO: 8190 - protein, 7 aa, Artificial Sequence
  Synthetic construct
GMIHIAF

SEQ ID NO: 8191 - protein, 7 aa, Artificial Sequence
  Synthetic construct
GMIHIAY

SEQ ID NO: 8192 - protein, 7 aa, Artificial Sequence
  Synthetic construct
GMIHIQF

SEQ ID NO: 8193 - protein, 7 aa, Artificial Sequence
  Synthetic construct
GMIHIQY

SEQ ID NO: 8194 - protein, 7 aa, Artificial Sequence
  Synthetic construct
GMIHIDF

SEQ ID NO: 8195 - protein, 7 aa, Artificial Sequence
  Synthetic construct
GMIHIDY

SEQ ID NO: 8196 - protein, 7 aa, Artificial Sequence
  Synthetic construct
GMIHIVF

SEQ ID NO: 8197 - protein, 7 aa, Artificial Sequence
  Synthetic construct
GMIHIVY

SEQ ID NO: 8198 - protein, 7 aa, Artificial Sequence
  Synthetic construct
GMIHDFF

SEQ ID NO: 8199 - protein, 7 aa, Artificial Sequence
  Synthetic construct
GMIHDFY

SEQ ID NO: 8200 - protein, 7 aa, Artificial Sequence
  Synthetic construct
GMIHDRF

SEQ ID NO: 8201 - protein, 7 aa, Artificial Sequence
  Synthetic construct
GMIHDRY

SEQ ID NO: 8202 - protein, 7 aa, Artificial Sequence
  Synthetic construct
GMIHDCF

SEQ ID NO: 8203 - protein, 7 aa, Artificial Sequence
  Synthetic construct
GMIHDCY

SEQ ID NO: 8204 - protein, 7 aa, Artificial Sequence
  Synthetic construct
GMIHDLF

SEQ ID NO: 8205 - protein, 7 aa, Artificial Sequence
  Synthetic construct
GMIHDLY

SEQ ID NO: 8206 - protein, 7 aa, Artificial Sequence
  Synthetic construct
GMIHDAF

SEQ ID NO: 8207 - protein, 7 aa, Artificial Sequence
  Synthetic construct
GMIHDAY

SEQ ID NO: 8208 - protein, 7 aa, Artificial Sequence
  Synthetic construct
GMIHDQF

SEQ ID NO: 8209 - protein, 7 aa, Artificial Sequence
  Synthetic construct
GMIHDQY

SEQ ID NO: 8210 - protein, 7 aa, Artificial Sequence
  Synthetic construct
GMIHDDF

SEQ ID NO: 8211 - protein, 7 aa, Artificial Sequence
  Synthetic construct
GMIHDDY

SEQ ID NO: 8212 - protein, 7 aa, Artificial Sequence
  Synthetic construct
GMIHDVF

SEQ ID NO: 8213 - protein, 7 aa, Artificial Sequence
  Synthetic construct
GMIHDVY

SEQ ID NO: 8214 - protein, 7 aa, Artificial Sequence
  Synthetic construct
GMIHYFF

SEQ ID NO: 8215 - protein, 7 aa, Artificial Sequence
  Synthetic construct
GMIHYFY

SEQ ID NO: 8216 - protein, 7 aa, Artificial Sequence
  Synthetic construct
GMIHYRF

SEQ ID NO: 8217 - protein, 7 aa, Artificial Sequence
  Synthetic construct
GMIHYRY

SEQ ID NO: 8218 - protein, 7 aa, Artificial Sequence
  Synthetic construct
GMIHYCF

SEQ ID NO: 8219 - protein, 7 aa, Artificial Sequence
  Synthetic construct
GMIHYCY

SEQ ID NO: 8220 - protein, 7 aa, Artificial Sequence
  Synthetic construct
GMIHYLF

SEQ ID NO: 8221 - protein, 7 aa, Artificial Sequence
  Synthetic construct
GMIHYLY

SEQ ID NO: 8222 - protein, 7 aa, Artificial Sequence
  Synthetic construct
GMIHYAF

SEQ ID NO: 8223 - protein, 7 aa, Artificial Sequence
  Synthetic construct
GMIHYAY

SEQ ID NO: 8224 - protein, 7 aa, Artificial Sequence
  Synthetic construct
GMIHYQF

SEQ ID NO: 8225 - protein, 7 aa, Artificial Sequence
  Synthetic construct
GMIHYQY

SEQ ID NO: 8226 - protein, 7 aa, Artificial Sequence
  Synthetic construct
GMIHYDF

SEQ ID NO: 8227 - protein, 7 aa, Artificial Sequence
  Synthetic construct
GMIHYDY

SEQ ID NO: 8228 - protein, 7 aa, Artificial Sequence
  Synthetic construct
GMIHYVF

SEQ ID NO: 8229 - protein, 7 aa, Artificial Sequence
  Synthetic construct
GMIHYVY

SEQ ID NO: 8230 - protein, 7 aa, Artificial Sequence
  Synthetic construct
GMIHFFF

SEQ ID NO: 8231 - protein, 7 aa, Artificial Sequence
  Synthetic construct
GMIHFFY

SEQ ID NO: 8232 - protein, 7 aa, Artificial Sequence
  Synthetic construct
GMIHFRF

SEQ ID NO: 8233 - protein, 7 aa, Artificial Sequence
  Synthetic construct
GMIHFRY

SEQ ID NO: 8234 - protein, 7 aa, Artificial Sequence
  Synthetic construct
GMIHFCF

SEQ ID NO: 8235 - protein, 7 aa, Artificial Sequence
  Synthetic construct
GMIHFCY

SEQ ID NO: 8236 - protein, 7 aa, Artificial Sequence
  Synthetic construct
GMIHFLF

SEQ ID NO: 8237 - protein, 7 aa, Artificial Sequence
  Synthetic construct
GMIHFLY

SEQ ID NO: 8238 - protein, 7 aa, Artificial Sequence
  Synthetic construct
GMIHFAF

SEQ ID NO: 8239 - protein, 7 aa, Artificial Sequence
  Synthetic construct
GMIHFAY

SEQ ID NO: 8240 - protein, 7 aa, Artificial Sequence
  Synthetic construct
GMIHFQF

SEQ ID NO: 8241 - protein, 7 aa, Artificial Sequence
  Synthetic construct
GMIHFQY

SEQ ID NO: 8242 - protein, 7 aa, Artificial Sequence
  Synthetic construct
GMIHFDF

SEQ ID NO: 8243 - protein, 7 aa, Artificial Sequence
  Synthetic construct
GMIHFDY

SEQ ID NO: 8244 - protein, 7 aa, Artificial Sequence
  Synthetic construct
GMIHFVF

SEQ ID NO: 8245 - protein, 7 aa, Artificial Sequence
  Synthetic construct
GMIHFVY

SEQ ID NO: 8246 - protein, 7 aa, Artificial Sequence
  Synthetic construct
GMIHVFF

SEQ ID NO: 8247 - protein, 7 aa, Artificial Sequence
  Synthetic construct
GMIHVFY

SEQ ID NO: 8248 - protein, 7 aa, Artificial Sequence
  Synthetic construct
GMIHVRF

SEQ ID NO: 8249 - protein, 7 aa, Artificial Sequence
  Synthetic construct
GMIHVRY

SEQ ID NO: 8250 - protein, 7 aa, Artificial Sequence
  Synthetic construct
GMIHVCF

SEQ ID NO: 8251 - protein, 7 aa, Artificial Sequence
  Synthetic construct
GMIHVCY

SEQ ID NO: 8252 - protein, 7 aa, Artificial Sequence
  Synthetic construct
GMIHVLF

SEQ ID NO: 8253 - protein, 7 aa, Artificial Sequence
  Synthetic construct
GMIHVLY

SEQ ID NO: 8254 - protein, 7 aa, Artificial Sequence
  Synthetic construct
GMIHVAF

SEQ ID NO: 8255 - protein, 7 aa, Artificial Sequence
  Synthetic construct
GMIHVAY

SEQ ID NO: 8256 - protein, 7 aa, Artificial Sequence
  Synthetic construct
GMIHVQF

SEQ ID NO: 8257 - protein, 7 aa, Artificial Sequence
  Synthetic construct
GMIHVQY

SEQ ID NO: 8258 - protein, 7 aa, Artificial Sequence
  Synthetic construct
GMIHVDF

SEQ ID NO: 8259 - protein, 7 aa, Artificial Sequence
  Synthetic construct
GMIHVDY

SEQ ID NO: 8260 - protein, 7 aa, Artificial Sequence
  Synthetic construct
GMIHVVF

SEQ ID NO: 8261 - protein, 7 aa, Artificial Sequence
  Synthetic construct
GMIHVVY

SEQ ID NO: 8262 - protein, 7 aa, Artificial Sequence
  Synthetic construct
GMIHTFF

SEQ ID NO: 8263 - protein, 7 aa, Artificial Sequence
  Synthetic construct
GMIHTFY

SEQ ID NO: 8264 - protein, 7 aa, Artificial Sequence
  Synthetic construct
GMIHTRF

SEQ ID NO: 8265 - protein, 7 aa, Artificial Sequence
  Synthetic construct
GMIHTRY

SEQ ID NO: 8266 - protein, 7 aa, Artificial Sequence
  Synthetic construct
GMIHTCF

SEQ ID NO: 8267 - protein, 7 aa, Artificial Sequence
  Synthetic construct
GMIHTCY

SEQ ID NO: 8268 - protein, 7 aa, Artificial Sequence
  Synthetic construct
GMIHTLF

SEQ ID NO: 8269 - protein, 7 aa, Artificial Sequence
  Synthetic construct
GMIHTLY

SEQ ID NO: 8270 - protein, 7 aa, Artificial Sequence
  Synthetic construct
GMIHTAF

SEQ ID NO: 8271 - protein, 7 aa, Artificial Sequence
  Synthetic construct
GMIHTAY

SEQ ID NO: 8272 - protein, 7 aa, Artificial Sequence
  Synthetic construct
GMIHTQF

SEQ ID NO: 8273 - protein, 7 aa, Artificial Sequence
  Synthetic construct
GMIHTQY

SEQ ID NO: 8274 - protein, 7 aa, Artificial Sequence
  Synthetic construct
GMIHTDF

SEQ ID NO: 8275 - protein, 7 aa, Artificial Sequence
  Synthetic construct
GMIHTDY

SEQ ID NO: 8276 - protein, 7 aa, Artificial Sequence
  Synthetic construct
GMIHTVF

SEQ ID NO: 8277 - protein, 7 aa, Artificial Sequence
  Synthetic construct
GMIHTVY

SEQ ID NO: 8278 - protein, 7 aa, Artificial Sequence
  Synthetic construct
GMIHGFF

SEQ ID NO: 8279 - protein, 7 aa, Artificial Sequence
  Synthetic construct
GMIHGFY

SEQ ID NO: 8280 - protein, 7 aa, Artificial Sequence
  Synthetic construct
GMIHGRF

SEQ ID NO: 8281 - protein, 7 aa, Artificial Sequence
  Synthetic construct
GMIHGRY

SEQ ID NO: 8282 - protein, 7 aa, Artificial Sequence
  Synthetic construct
GMIHGCF

SEQ ID NO: 8283 - protein, 7 aa, Artificial Sequence
  Synthetic construct
GMIHGCY

SEQ ID NO: 8284 - protein, 7 aa, Artificial Sequence
  Synthetic construct
GMIHGLF

SEQ ID NO: 8285 - protein, 7 aa, Artificial Sequence
  Synthetic construct
GMIHGLY

SEQ ID NO: 8286 - protein, 7 aa, Artificial Sequence
  Synthetic construct
GMIHGAF

SEQ ID NO: 8287 - protein, 7 aa, Artificial Sequence
  Synthetic construct
GMIHGAY

SEQ ID NO: 8288 - protein, 7 aa, Artificial Sequence
  Synthetic construct
GMIHGQF

SEQ ID NO: 8289 - protein, 7 aa, Artificial Sequence
  Synthetic construct
GMIHGQY

SEQ ID NO: 8290 - protein, 7 aa, Artificial Sequence
  Synthetic construct
GMIHGDF

SEQ ID NO: 8291 - protein, 7 aa, Artificial Sequence
  Synthetic construct
GMIHGDY

SEQ ID NO: 8292 - protein, 7 aa, Artificial Sequence
  Synthetic construct
GMIHGVF

SEQ ID NO: 8293 - protein, 7 aa, Artificial Sequence
  Synthetic construct
GMIHGVY

SEQ ID NO: 8294 - protein, 7 aa, Artificial Sequence
  Synthetic construct
GMIHAFF

SEQ ID NO: 8295 - protein, 7 aa, Artificial Sequence
  Synthetic construct
GMIHAFY

SEQ ID NO: 8296 - protein, 7 aa, Artificial Sequence
  Synthetic construct
GMIHARF

SEQ ID NO: 8297 - protein, 7 aa, Artificial Sequence
  Synthetic construct
GMIHARY

SEQ ID NO: 8298 - protein, 7 aa, Artificial Sequence
  Synthetic construct
GMIHACF

SEQ ID NO: 8299 - protein, 7 aa, Artificial Sequence
  Synthetic construct
GMIHACY

SEQ ID NO: 8300 - protein, 7 aa, Artificial Sequence
  Synthetic construct
GMIHALF

SEQ ID NO: 8301 - protein, 7 aa, Artificial Sequence
  Synthetic construct
GMIHALY

SEQ ID NO: 8302 - protein, 7 aa, Artificial Sequence
  Synthetic construct
GMIHAAF

SEQ ID NO: 8303 - protein, 7 aa, Artificial Sequence
  Synthetic construct
GMIHAAY

SEQ ID NO: 8304 - protein, 7 aa, Artificial Sequence
  Synthetic construct
GMIHAQF

SEQ ID NO: 8305 - protein, 7 aa, Artificial Sequence
  Synthetic construct
GMIHAQY

SEQ ID NO: 8306 - protein, 7 aa, Artificial Sequence
  Synthetic construct
GMIHADF

SEQ ID NO: 8307 - protein, 7 aa, Artificial Sequence
  Synthetic construct
GMIHADY

SEQ ID NO: 8308 - protein, 7 aa, Artificial Sequence
  Synthetic construct
GMIHAVF

SEQ ID NO: 8309 - protein, 7 aa, Artificial Sequence
  Synthetic construct
GMIHAVY

SEQ ID NO: 8310 - protein, 7 aa, Artificial Sequence
  Synthetic construct
GMIHQFF

SEQ ID NO: 8311 - protein, 7 aa, Artificial Sequence
  Synthetic construct
GMIHQFY

SEQ ID NO: 8312 - protein, 7 aa, Artificial Sequence
  Synthetic construct
GMIHQRF

SEQ ID NO: 8313 - protein, 7 aa, Artificial Sequence
  Synthetic construct
GMIHQRY

SEQ ID NO: 8314 - protein, 7 aa, Artificial Sequence
  Synthetic construct
GMIHQCF

SEQ ID NO: 8315 - protein, 7 aa, Artificial Sequence
  Synthetic construct
GMIHQCY

SEQ ID NO: 8316 - protein, 7 aa, Artificial Sequence
  Synthetic construct
GMIHQLF

SEQ ID NO: 8317 - protein, 7 aa, Artificial Sequence
  Synthetic construct
GMIHQLY

SEQ ID NO: 8318 - protein, 7 aa, Artificial Sequence
  Synthetic construct
GMIHQAF

SEQ ID NO: 8319 - protein, 7 aa, Artificial Sequence
  Synthetic construct
GMIHQAY

SEQ ID NO: 8320 - protein, 7 aa, Artificial Sequence
  Synthetic construct
GMIHQQF

SEQ ID NO: 8321 - protein, 7 aa, Artificial Sequence
  Synthetic construct
GMIHQQY

SEQ ID NO: 8322 - protein, 7 aa, Artificial Sequence
  Synthetic construct
GMIHQDF

SEQ ID NO: 8323 - protein, 7 aa, Artificial Sequence
  Synthetic construct
GMIHQDY

SEQ ID NO: 8324 - protein, 7 aa, Artificial Sequence
  Synthetic construct
GMIHQVF

SEQ ID NO: 8325 - protein, 7 aa, Artificial Sequence
  Synthetic construct
GMIHQVY

SEQ ID NO: 8326 - protein, 7 aa, Artificial Sequence
  Synthetic construct
GMILIFF

SEQ ID NO: 8327 - protein, 7 aa, Artificial Sequence
  Synthetic construct
GMILIFY

SEQ ID NO: 8328 - protein, 7 aa, Artificial Sequence
  Synthetic construct
GMILIRF

SEQ ID NO: 8329 - protein, 7 aa, Artificial Sequence
  Synthetic construct
GMILIRY

SEQ ID NO: 8330 - protein, 7 aa, Artificial Sequence
  Synthetic construct
GMILICF

SEQ ID NO: 8331 - protein, 7 aa, Artificial Sequence
  Synthetic construct
GMILICY

SEQ ID NO: 8332 - protein, 7 aa, Artificial Sequence
  Synthetic construct
GMILILF

SEQ ID NO: 8333 - protein, 7 aa, Artificial Sequence
  Synthetic construct
GMILILY

SEQ ID NO: 8334 - protein, 7 aa, Artificial Sequence
  Synthetic construct
GMILIAF

SEQ ID NO: 8335 - protein, 7 aa, Artificial Sequence
  Synthetic construct
GMILIAY

SEQ ID NO: 8336 - protein, 7 aa, Artificial Sequence
  Synthetic construct
GMILIQF

SEQ ID NO: 8337 - protein, 7 aa, Artificial Sequence
  Synthetic construct
GMILIQY

SEQ ID NO: 8338 - protein, 7 aa, Artificial Sequence
  Synthetic construct
GMILIDF

SEQ ID NO: 8339 - protein, 7 aa, Artificial Sequence
  Synthetic construct
GMILIDY

SEQ ID NO: 8340 - protein, 7 aa, Artificial Sequence
  Synthetic construct
GMILIVF

SEQ ID NO: 8341 - protein, 7 aa, Artificial Sequence
  Synthetic construct
GMILIVY

SEQ ID NO: 8342 - protein, 7 aa, Artificial Sequence
  Synthetic construct
GMILDFF

SEQ ID NO: 8343 - protein, 7 aa, Artificial Sequence
  Synthetic construct
GMILDFY

SEQ ID NO: 8344 - protein, 7 aa, Artificial Sequence
  Synthetic construct
GMILDRF

SEQ ID NO: 8345 - protein, 7 aa, Artificial Sequence
  Synthetic construct
GMILDRY

SEQ ID NO: 8346 - protein, 7 aa, Artificial Sequence
  Synthetic construct
GMILDCF

SEQ ID NO: 8347 - protein, 7 aa, Artificial Sequence
  Synthetic construct
GMILDCY

SEQ ID NO: 8348 - protein, 7 aa, Artificial Sequence
  Synthetic construct
GMILDLF

SEQ ID NO: 8349 - protein, 7 aa, Artificial Sequence
  Synthetic construct
GMILDLY

SEQ ID NO: 8350 - protein, 7 aa, Artificial Sequence
  Synthetic construct
GMILDAF

SEQ ID NO: 8351 - protein, 7 aa, Artificial Sequence
  Synthetic construct
GMILDAY

SEQ ID NO: 8352 - protein, 7 aa, Artificial Sequence
  Synthetic construct
GMILDQF

SEQ ID NO: 8353 - protein, 7 aa, Artificial Sequence
  Synthetic construct
GMILDQY

SEQ ID NO: 8354 - protein, 7 aa, Artificial Sequence
  Synthetic construct
GMILDDF

SEQ ID NO: 8355 - protein, 7 aa, Artificial Sequence
  Synthetic construct
GMILDDY

SEQ ID NO: 8356 - protein, 7 aa, Artificial Sequence
  Synthetic construct
GMILDVF

SEQ ID NO: 8357 - protein, 7 aa, Artificial Sequence
  Synthetic construct
GMILDVY

SEQ ID NO: 8358 - protein, 7 aa, Artificial Sequence
  Synthetic construct
GMILYFF

SEQ ID NO: 8359 - protein, 7 aa, Artificial Sequence
  Synthetic construct
GMILYFY

SEQ ID NO: 8360 - protein, 7 aa, Artificial Sequence
  Synthetic construct
GMILYRF

SEQ ID NO: 8361 - protein, 7 aa, Artificial Sequence
  Synthetic construct
GMILYRY

SEQ ID NO: 8362 - protein, 7 aa, Artificial Sequence
  Synthetic construct
GMILYCF

SEQ ID NO: 8363 - protein, 7 aa, Artificial Sequence
  Synthetic construct
GMILYCY

SEQ ID NO: 8364 - protein, 7 aa, Artificial Sequence
  Synthetic construct
GMILYLF

SEQ ID NO: 8365 - protein, 7 aa, Artificial Sequence
  Synthetic construct
GMILYLY

SEQ ID NO: 8366 - protein, 7 aa, Artificial Sequence
  Synthetic construct
GMILYAF

SEQ ID NO: 8367 - protein, 7 aa, Artificial Sequence
  Synthetic construct
GMILYAY

SEQ ID NO: 8368 - protein, 7 aa, Artificial Sequence
  Synthetic construct
GMILYQF

SEQ ID NO: 8369 - protein, 7 aa, Artificial Sequence
  Synthetic construct
GMILYQY

SEQ ID NO: 8370 - protein, 7 aa, Artificial Sequence
  Synthetic construct
GMILYDF

SEQ ID NO: 8371 - protein, 7 aa, Artificial Sequence
  Synthetic construct
GMILYDY

SEQ ID NO: 8372 - protein, 7 aa, Artificial Sequence
  Synthetic construct
GMILYVF

SEQ ID NO: 8373 - protein, 7 aa, Artificial Sequence
  Synthetic construct
GMILYVY

SEQ ID NO: 8374 - protein, 7 aa, Artificial Sequence
  Synthetic construct
GMILFFF

SEQ ID NO: 8375 - protein, 7 aa, Artificial Sequence
  Synthetic construct
GMILFFY

SEQ ID NO: 8376 - protein, 7 aa, Artificial Sequence
  Synthetic construct
GMILFRF

SEQ ID NO: 8377 - protein, 7 aa, Artificial Sequence
  Synthetic construct
GMILFRY

SEQ ID NO: 8378 - protein, 7 aa, Artificial Sequence
  Synthetic construct
GMILFCF

SEQ ID NO: 8379 - protein, 7 aa, Artificial Sequence
  Synthetic construct
GMILFCY

SEQ ID NO: 8380 - protein, 7 aa, Artificial Sequence
  Synthetic construct
GMILFLF

SEQ ID NO: 8381 - protein, 7 aa, Artificial Sequence
  Synthetic construct
GMILFLY

SEQ ID NO: 8382 - protein, 7 aa, Artificial Sequence
  Synthetic construct
GMILFAF

SEQ ID NO: 8383 - protein, 7 aa, Artificial Sequence
  Synthetic construct
GMILFAY

SEQ ID NO: 8384 - protein, 7 aa, Artificial Sequence
  Synthetic construct
GMILFQF

SEQ ID NO: 8385 - protein, 7 aa, Artificial Sequence
  Synthetic construct
GMILFQY

SEQ ID NO: 8386 - protein, 7 aa, Artificial Sequence
  Synthetic construct
GMILFDF

SEQ ID NO: 8387 - protein, 7 aa, Artificial Sequence
  Synthetic construct
GMILFDY

SEQ ID NO: 8388 - protein, 7 aa, Artificial Sequence
  Synthetic construct
GMILFVF

SEQ ID NO: 8389 - protein, 7 aa, Artificial Sequence
  Synthetic construct
GMILFVY

SEQ ID NO: 8390 - protein, 7 aa, Artificial Sequence
  Synthetic construct
GMILVFF

SEQ ID NO: 8391 - protein, 7 aa, Artificial Sequence
  Synthetic construct
GMILVFY

SEQ ID NO: 8392 - protein, 7 aa, Artificial Sequence
  Synthetic construct
GMILVRF

SEQ ID NO: 8393 - protein, 7 aa, Artificial Sequence
  Synthetic construct
GMILVRY

SEQ ID NO: 8394 - protein, 7 aa, Artificial Sequence
  Synthetic construct
GMILVCF

SEQ ID NO: 8395 - protein, 7 aa, Artificial Sequence
  Synthetic construct
GMILVCY

SEQ ID NO: 8396 - protein, 7 aa, Artificial Sequence
  Synthetic construct
GMILVLF

SEQ ID NO: 8397 - protein, 7 aa, Artificial Sequence
  Synthetic construct
GMILVLY

SEQ ID NO: 8398 - protein, 7 aa, Artificial Sequence
  Synthetic construct
GMILVAF

SEQ ID NO: 8399 - protein, 7 aa, Artificial Sequence
  Synthetic construct
GMILVAY

SEQ ID NO: 8400 - protein, 7 aa, Artificial Sequence
  Synthetic construct
GMILVQF

SEQ ID NO: 8401 - protein, 7 aa, Artificial Sequence
  Synthetic construct
GMILVQY

SEQ ID NO: 8402 - protein, 7 aa, Artificial Sequence
  Synthetic construct
GMILVDF

SEQ ID NO: 8403 - protein, 7 aa, Artificial Sequence
  Synthetic construct
GMILVDY

SEQ ID NO: 8404 - protein, 7 aa, Artificial Sequence
  Synthetic construct
GMILVVF

SEQ ID NO: 8405 - protein, 7 aa, Artificial Sequence
  Synthetic construct
GMILVVY

SEQ ID NO: 8406 - protein, 7 aa, Artificial Sequence
  Synthetic construct
GMILTFF

SEQ ID NO: 8407 - protein, 7 aa, Artificial Sequence
  Synthetic construct
GMILTFY

SEQ ID NO: 8408 - protein, 7 aa, Artificial Sequence
  Synthetic construct
GMILTRF

SEQ ID NO: 8409 - protein, 7 aa, Artificial Sequence
  Synthetic construct
GMILTRY

SEQ ID NO: 8410 - protein, 7 aa, Artificial Sequence
  Synthetic construct
GMILTCF

SEQ ID NO: 8411 - protein, 7 aa, Artificial Sequence
  Synthetic construct
GMILTCY

SEQ ID NO: 8412 - protein, 7 aa, Artificial Sequence
  Synthetic construct
GMILTLF

SEQ ID NO: 8413 - protein, 7 aa, Artificial Sequence
  Synthetic construct
GMILTLY

SEQ ID NO: 8414 - protein, 7 aa, Artificial Sequence
  Synthetic construct
GMILTAF

SEQ ID NO: 8415 - protein, 7 aa, Artificial Sequence
  Synthetic construct
GMILTAY

SEQ ID NO: 8416 - protein, 7 aa, Artificial Sequence
  Synthetic construct
GMILTQF

SEQ ID NO: 8417 - protein, 7 aa, Artificial Sequence
  Synthetic construct
GMILTQY

SEQ ID NO: 8418 - protein, 7 aa, Artificial Sequence
  Synthetic construct
GMILTDF

SEQ ID NO: 8419 - protein, 7 aa, Artificial Sequence
  Synthetic construct
GMILTDY

SEQ ID NO: 8420 - protein, 7 aa, Artificial Sequence
  Synthetic construct
GMILTVF

SEQ ID NO: 8421 - protein, 7 aa, Artificial Sequence
  Synthetic construct
GMILTVY

SEQ ID NO: 8422 - protein, 7 aa, Artificial Sequence
  Synthetic construct
GMILGFF

SEQ ID NO: 8423 - protein, 7 aa, Artificial Sequence
  Synthetic construct
GMILGFY

SEQ ID NO: 8424 - protein, 7 aa, Artificial Sequence
  Synthetic construct
GMILGRF

SEQ ID NO: 8425 - protein, 7 aa, Artificial Sequence
  Synthetic construct
GMILGRY

SEQ ID NO: 8426 - protein, 7 aa, Artificial Sequence
  Synthetic construct
GMILGCF

SEQ ID NO: 8427 - protein, 7 aa, Artificial Sequence
  Synthetic construct
GMILGCY

SEQ ID NO: 8428 - protein, 7 aa, Artificial Sequence
  Synthetic construct
GMILGLF

SEQ ID NO: 8429 - protein, 7 aa, Artificial Sequence
  Synthetic construct
GMILGLY

SEQ ID NO: 8430 - protein, 7 aa, Artificial Sequence
  Synthetic construct
GMILGAF

SEQ ID NO: 8431 - protein, 7 aa, Artificial Sequence
  Synthetic construct
GMILGAY

SEQ ID NO: 8432 - protein, 7 aa, Artificial Sequence
  Synthetic construct
GMILGQF

SEQ ID NO: 8433 - protein, 7 aa, Artificial Sequence
  Synthetic construct
GMILGQY

SEQ ID NO: 8434 - protein, 7 aa, Artificial Sequence
  Synthetic construct
GMILGDF

SEQ ID NO: 8435 - protein, 7 aa, Artificial Sequence
  Synthetic construct
GMILGDY

SEQ ID NO: 8436 - protein, 7 aa, Artificial Sequence
  Synthetic construct
GMILGVF

SEQ ID NO: 8437 - protein, 7 aa, Artificial Sequence
  Synthetic construct
GMILGVY

SEQ ID NO: 8438 - protein, 7 aa, Artificial Sequence
  Synthetic construct
GMILAFF

SEQ ID NO: 8439 - protein, 7 aa, Artificial Sequence
  Synthetic construct
GMILAFY

SEQ ID NO: 8440 - protein, 7 aa, Artificial Sequence
  Synthetic construct
GMILARF

SEQ ID NO: 8441 - protein, 7 aa, Artificial Sequence
  Synthetic construct
GMILARY

SEQ ID NO: 8442 - protein, 7 aa, Artificial Sequence
  Synthetic construct
GMILACF

SEQ ID NO: 8443 - protein, 7 aa, Artificial Sequence
  Synthetic construct
GMILACY

SEQ ID NO: 8444 - protein, 7 aa, Artificial Sequence
  Synthetic construct
GMILALF

SEQ ID NO: 8445 - protein, 7 aa, Artificial Sequence
  Synthetic construct
GMILALY

SEQ ID NO: 8446 - protein, 7 aa, Artificial Sequence
  Synthetic construct
GMILAAF

SEQ ID NO: 8447 - protein, 7 aa, Artificial Sequence
  Synthetic construct
GMILAAY

SEQ ID NO: 8448 - protein, 7 aa, Artificial Sequence
  Synthetic construct
GMILAQF

SEQ ID NO: 8449 - protein, 7 aa, Artificial Sequence
  Synthetic construct
GMILAQY

SEQ ID NO: 8450 - protein, 7 aa, Artificial Sequence
  Synthetic construct
GMILADF

SEQ ID NO: 8451 - protein, 7 aa, Artificial Sequence
  Synthetic construct
GMILADY

SEQ ID NO: 8452 - protein, 7 aa, Artificial Sequence
  Synthetic construct
GMILAVF

SEQ ID NO: 8453 - protein, 7 aa, Artificial Sequence
  Synthetic construct
GMILAVY

SEQ ID NO: 8454 - protein, 7 aa, Artificial Sequence
  Synthetic construct
GMILQFF

SEQ ID NO: 8455 - protein, 7 aa, Artificial Sequence
  Synthetic construct
GMILQFY

SEQ ID NO: 8456 - protein, 7 aa, Artificial Sequence
  Synthetic construct
GMILQRF

SEQ ID NO: 8457 - protein, 7 aa, Artificial Sequence
  Synthetic construct
GMILQRY

SEQ ID NO: 8458 - protein, 7 aa, Artificial Sequence
  Synthetic construct
GMILQCF

SEQ ID NO: 8459 - protein, 7 aa, Artificial Sequence
  Synthetic construct
GMILQCY

SEQ ID NO: 8460 - protein, 7 aa, Artificial Sequence
  Synthetic construct
GMILQLF

SEQ ID NO: 8461 - protein, 7 aa, Artificial Sequence
  Synthetic construct
GMILQLY

SEQ ID NO: 8462 - protein, 7 aa, Artificial Sequence
  Synthetic construct
GMILQAF

SEQ ID NO: 8463 - protein, 7 aa, Artificial Sequence
  Synthetic construct
GMILQAY

SEQ ID NO: 8464 - protein, 7 aa, Artificial Sequence
  Synthetic construct
GMILQQF

SEQ ID NO: 8465 - protein, 7 aa, Artificial Sequence
  Synthetic construct
GMILQQY

SEQ ID NO: 8466 - protein, 7 aa, Artificial Sequence
  Synthetic construct
GMILQDF

SEQ ID NO: 8467 - protein, 7 aa, Artificial Sequence
  Synthetic construct
GMILQDY

SEQ ID NO: 8468 - protein, 7 aa, Artificial Sequence
  Synthetic construct
GMILQVF

SEQ ID NO: 8469 - protein, 7 aa, Artificial Sequence
  Synthetic construct
GMILQVY

SEQ ID NO: 8470 - protein, 7 aa, Artificial Sequence
  Synthetic construct
GMIFIFF

SEQ ID NO: 8471 - protein, 7 aa, Artificial Sequence
  Synthetic construct
GMIFIFY

SEQ ID NO: 8472 - protein, 7 aa, Artificial Sequence
  Synthetic construct
GMIFIRF

SEQ ID NO: 8473 - protein, 7 aa, Artificial Sequence
  Synthetic construct
GMIFIRY

SEQ ID NO: 8474 - protein, 7 aa, Artificial Sequence
  Synthetic construct
GMIFICF

SEQ ID NO: 8475 - protein, 7 aa, Artificial Sequence
  Synthetic construct
GMIFICY

SEQ ID NO: 8476 - protein, 7 aa, Artificial Sequence
  Synthetic construct
GMIFILF

SEQ ID NO: 8477 - protein, 7 aa, Artificial Sequence
  Synthetic construct
GMIFILY

SEQ ID NO: 8478 - protein, 7 aa, Artificial Sequence
  Synthetic construct
GMIFIAF

SEQ ID NO: 8479 - protein, 7 aa, Artificial Sequence
  Synthetic construct
GMIFIAY

SEQ ID NO: 8480 - protein, 7 aa, Artificial Sequence
  Synthetic construct
GMIFIQF

SEQ ID NO: 8481 - protein, 7 aa, Artificial Sequence
  Synthetic construct
GMIFIQY

SEQ ID NO: 8482 - protein, 7 aa, Artificial Sequence
  Synthetic construct
GMIFIDF

SEQ ID NO: 8483 - protein, 7 aa, Artificial Sequence
  Synthetic construct
GMIFIDY

SEQ ID NO: 8484 - protein, 7 aa, Artificial Sequence
  Synthetic construct
GMIFIVF

SEQ ID NO: 8485 - protein, 7 aa, Artificial Sequence
  Synthetic construct
GMIFIVY

SEQ ID NO: 8486 - protein, 7 aa, Artificial Sequence
  Synthetic construct
GMIFDFF

SEQ ID NO: 8487 - protein, 7 aa, Artificial Sequence
  Synthetic construct
GMIFDFY

SEQ ID NO: 8488 - protein, 7 aa, Artificial Sequence
  Synthetic construct
GMIFDRF

SEQ ID NO: 8489 - protein, 7 aa, Artificial Sequence
  Synthetic construct
GMIFDRY

SEQ ID NO: 8490 - protein, 7 aa, Artificial Sequence
  Synthetic construct
GMIFDCF

SEQ ID NO: 8491 - protein, 7 aa, Artificial Sequence
  Synthetic construct
GMIFDCY

SEQ ID NO: 8492 - protein, 7 aa, Artificial Sequence
  Synthetic construct
GMIFDLF

SEQ ID NO: 8493 - protein, 7 aa, Artificial Sequence
  Synthetic construct
GMIFDLY

SEQ ID NO: 8494 - protein, 7 aa, Artificial Sequence
  Synthetic construct
GMIFDAF

SEQ ID NO: 8495 - protein, 7 aa, Artificial Sequence
  Synthetic construct
GMIFDAY

SEQ ID NO: 8496 - protein, 7 aa, Artificial Sequence
  Synthetic construct
GMIFDQF

SEQ ID NO: 8497 - protein, 7 aa, Artificial Sequence
  Synthetic construct
GMIFDQY

SEQ ID NO: 8498 - protein, 7 aa, Artificial Sequence
  Synthetic construct
GMIFDDF

SEQ ID NO: 8499 - protein, 7 aa, Artificial Sequence
  Synthetic construct
GMIFDDY

SEQ ID NO: 8500 - protein, 7 aa, Artificial Sequence
  Synthetic construct
GMIFDVF

SEQ ID NO: 8501 - protein, 7 aa, Artificial Sequence
  Synthetic construct
GMIFDVY

SEQ ID NO: 8502 - protein, 7 aa, Artificial Sequence
  Synthetic construct
GMIFYFF

SEQ ID NO: 8503 - protein, 7 aa, Artificial Sequence
  Synthetic construct
GMIFYFY

SEQ ID NO: 8504 - protein, 7 aa, Artificial Sequence
  Synthetic construct
GMIFYRF

SEQ ID NO: 8505 - protein, 7 aa, Artificial Sequence
  Synthetic construct
GMIFYRY

SEQ ID NO: 8506 - protein, 7 aa, Artificial Sequence
  Synthetic construct
GMIFYCF

SEQ ID NO: 8507 - protein, 7 aa, Artificial Sequence
  Synthetic construct
GMIFYCY

SEQ ID NO: 8508 - protein, 7 aa, Artificial Sequence
  Synthetic construct
GMIFYLF

SEQ ID NO: 8509 - protein, 7 aa, Artificial Sequence
  Synthetic construct
GMIFYLY

SEQ ID NO: 8510 - protein, 7 aa, Artificial Sequence
  Synthetic construct
GMIFYAF

SEQ ID NO: 8511 - protein, 7 aa, Artificial Sequence
  Synthetic construct
GMIFYAY

SEQ ID NO: 8512 - protein, 7 aa, Artificial Sequence
  Synthetic construct
GMIFYQF

SEQ ID NO: 8513 - protein, 7 aa, Artificial Sequence
  Synthetic construct
GMIFYQY

SEQ ID NO: 8514 - protein, 7 aa, Artificial Sequence
  Synthetic construct
GMIFYDF

SEQ ID NO: 8515 - protein, 7 aa, Artificial Sequence
  Synthetic construct
GMIFYDY

SEQ ID NO: 8516 - protein, 7 aa, Artificial Sequence
  Synthetic construct
GMIFYVF

SEQ ID NO: 8517 - protein, 7 aa, Artificial Sequence
  Synthetic construct
GMIFYVY

SEQ ID NO: 8518 - protein, 7 aa, Artificial Sequence
  Synthetic construct
GMIFFFF

SEQ ID NO: 8519 - protein, 7 aa, Artificial Sequence
  Synthetic construct
GMIFFFY

SEQ ID NO: 8520 - protein, 7 aa, Artificial Sequence
  Synthetic construct
GMIFFRF

SEQ ID NO: 8521 - protein, 7 aa, Artificial Sequence
  Synthetic construct
GMIFFRY

SEQ ID NO: 8522 - protein, 7 aa, Artificial Sequence
  Synthetic construct
GMIFFCF

SEQ ID NO: 8523 - protein, 7 aa, Artificial Sequence
  Synthetic construct
GMIFFCY

SEQ ID NO: 8524 - protein, 7 aa, Artificial Sequence
  Synthetic construct
GMIFFLF

SEQ ID NO: 8525 - protein, 7 aa, Artificial Sequence
  Synthetic construct
GMIFFLY

SEQ ID NO: 8526 - protein, 7 aa, Artificial Sequence
  Synthetic construct
GMIFFAF

SEQ ID NO: 8527 - protein, 7 aa, Artificial Sequence
  Synthetic construct
GMIFFAY

SEQ ID NO: 8528 - protein, 7 aa, Artificial Sequence
  Synthetic construct
GMIFFQF

SEQ ID NO: 8529 - protein, 7 aa, Artificial Sequence
  Synthetic construct
GMIFFQY

SEQ ID NO: 8530 - protein, 7 aa, Artificial Sequence
  Synthetic construct
GMIFFDF

SEQ ID NO: 8531 - protein, 7 aa, Artificial Sequence
  Synthetic construct
GMIFFDY

SEQ ID NO: 8532 - protein, 7 aa, Artificial Sequence
  Synthetic construct
GMIFFVF

SEQ ID NO: 8533 - protein, 7 aa, Artificial Sequence
  Synthetic construct
GMIFFVY

SEQ ID NO: 8534 - protein, 7 aa, Artificial Sequence
  Synthetic construct
GMIFVFF

SEQ ID NO: 8535 - protein, 7 aa, Artificial Sequence
  Synthetic construct
GMIFVFY

SEQ ID NO: 8536 - protein, 7 aa, Artificial Sequence
  Synthetic construct
GMIFVRF

SEQ ID NO: 8537 - protein, 7 aa, Artificial Sequence
  Synthetic construct
GMIFVRY

SEQ ID NO: 8538 - protein, 7 aa, Artificial Sequence
  Synthetic construct
GMIFVCF

SEQ ID NO: 8539 - protein, 7 aa, Artificial Sequence
  Synthetic construct
GMIFVCY

SEQ ID NO: 8540 - protein, 7 aa, Artificial Sequence
  Synthetic construct
GMIFVLF

SEQ ID NO: 8541 - protein, 7 aa, Artificial Sequence
  Synthetic construct
GMIFVLY

SEQ ID NO: 8542 - protein, 7 aa, Artificial Sequence
  Synthetic construct
GMIFVAF

SEQ ID NO: 8543 - protein, 7 aa, Artificial Sequence
  Synthetic construct
GMIFVAY

SEQ ID NO: 8544 - protein, 7 aa, Artificial Sequence
  Synthetic construct
GMIFVQF

SEQ ID NO: 8545 - protein, 7 aa, Artificial Sequence
  Synthetic construct
GMIFVQY

SEQ ID NO: 8546 - protein, 7 aa, Artificial Sequence
  Synthetic construct
GMIFVDF

SEQ ID NO: 8547 - protein, 7 aa, Artificial Sequence
  Synthetic construct
GMIFVDY

SEQ ID NO: 8548 - protein, 7 aa, Artificial Sequence
  Synthetic construct
GMIFVVF

SEQ ID NO: 8549 - protein, 7 aa, Artificial Sequence
  Synthetic construct
GMIFVVY

SEQ ID NO: 8550 - protein, 7 aa, Artificial Sequence
  Synthetic construct
GMIFTFF

SEQ ID NO: 8551 - protein, 7 aa, Artificial Sequence
  Synthetic construct
GMIFTFY

SEQ ID NO: 8552 - protein, 7 aa, Artificial Sequence
  Synthetic construct
GMIFTRF

SEQ ID NO: 8553 - protein, 7 aa, Artificial Sequence
  Synthetic construct
GMIFTRY

SEQ ID NO: 8554 - protein, 7 aa, Artificial Sequence
  Synthetic construct
GMIFTCF

SEQ ID NO: 8555 - protein, 7 aa, Artificial Sequence
  Synthetic construct
GMIFTCY

SEQ ID NO: 8556 - protein, 7 aa, Artificial Sequence
  Synthetic construct
GMIFTLF

SEQ ID NO: 8557 - protein, 7 aa, Artificial Sequence
  Synthetic construct
GMIFTLY

SEQ ID NO: 8558 - protein, 7 aa, Artificial Sequence
  Synthetic construct
GMIFTAF

SEQ ID NO: 8559 - protein, 7 aa, Artificial Sequence
  Synthetic construct
GMIFTAY

SEQ ID NO: 8560 - protein, 7 aa, Artificial Sequence
  Synthetic construct
GMIFTQF

SEQ ID NO: 8561 - protein, 7 aa, Artificial Sequence
  Synthetic construct
GMIFTQY

SEQ ID NO: 8562 - protein, 7 aa, Artificial Sequence
  Synthetic construct
GMIFTDF

SEQ ID NO: 8563 - protein, 7 aa, Artificial Sequence
  Synthetic construct
GMIFTDY

SEQ ID NO: 8564 - protein, 7 aa, Artificial Sequence
  Synthetic construct
GMIFTVF

SEQ ID NO: 8565 - protein, 7 aa, Artificial Sequence
  Synthetic construct
GMIFTVY

SEQ ID NO: 8566 - protein, 7 aa, Artificial Sequence
  Synthetic construct
GMIFGFF

SEQ ID NO: 8567 - protein, 7 aa, Artificial Sequence
  Synthetic construct
GMIFGFY

SEQ ID NO: 8568 - protein, 7 aa, Artificial Sequence
  Synthetic construct
GMIFGRF

SEQ ID NO: 8569 - protein, 7 aa, Artificial Sequence
  Synthetic construct
GMIFGRY

SEQ ID NO: 8570 - protein, 7 aa, Artificial Sequence
  Synthetic construct
GMIFGCF

SEQ ID NO: 8571 - protein, 7 aa, Artificial Sequence
  Synthetic construct
GMIFGCY

SEQ ID NO: 8572 - protein, 7 aa, Artificial Sequence
  Synthetic construct
GMIFGLF

SEQ ID NO: 8573 - protein, 7 aa, Artificial Sequence
  Synthetic construct
GMIFGLY

SEQ ID NO: 8574 - protein, 7 aa, Artificial Sequence
  Synthetic construct
GMIFGAF

SEQ ID NO: 8575 - protein, 7 aa, Artificial Sequence
  Synthetic construct
GMIFGAY

SEQ ID NO: 8576 - protein, 7 aa, Artificial Sequence
  Synthetic construct
GMIFGQF

SEQ ID NO: 8577 - protein, 7 aa, Artificial Sequence
  Synthetic construct
GMIFGQY

SEQ ID NO: 8578 - protein, 7 aa, Artificial Sequence
  Synthetic construct
GMIFGDF

SEQ ID NO: 8579 - protein, 7 aa, Artificial Sequence
  Synthetic construct
GMIFGDY

SEQ ID NO: 8580 - protein, 7 aa, Artificial Sequence
  Synthetic construct
GMIFGVF

SEQ ID NO: 8581 - protein, 7 aa, Artificial Sequence
  Synthetic construct
GMIFGVY

SEQ ID NO: 8582 - protein, 7 aa, Artificial Sequence
  Synthetic construct
GMIFAFF

SEQ ID NO: 8583 - protein, 7 aa, Artificial Sequence
  Synthetic construct
GMIFAFY

SEQ ID NO: 8584 - protein, 7 aa, Artificial Sequence
  Synthetic construct
GMIFARF

SEQ ID NO: 8585 - protein, 7 aa, Artificial Sequence
  Synthetic construct
GMIFARY

SEQ ID NO: 8586 - protein, 7 aa, Artificial Sequence
  Synthetic construct
GMIFACF

SEQ ID NO: 8587 - protein, 7 aa, Artificial Sequence
  Synthetic construct
GMIFACY

SEQ ID NO: 8588 - protein, 7 aa, Artificial Sequence
  Synthetic construct
GMIFALF

SEQ ID NO: 8589 - protein, 7 aa, Artificial Sequence
  Synthetic construct
GMIFALY

SEQ ID NO: 8590 - protein, 7 aa, Artificial Sequence
  Synthetic construct
GMIFAAF

SEQ ID NO: 8591 - protein, 7 aa, Artificial Sequence
  Synthetic construct
GMIFAAY

SEQ ID NO: 8592 - protein, 7 aa, Artificial Sequence
  Synthetic construct
GMIFAQF

SEQ ID NO: 8593 - protein, 7 aa, Artificial Sequence
  Synthetic construct
GMIFAQY

SEQ ID NO: 8594 - protein, 7 aa, Artificial Sequence
  Synthetic construct
GMIFADF

SEQ ID NO: 8595 - protein, 7 aa, Artificial Sequence
  Synthetic construct
GMIFADY

SEQ ID NO: 8596 - protein, 7 aa, Artificial Sequence
  Synthetic construct
GMIFAVF

SEQ ID NO: 8597 - protein, 7 aa, Artificial Sequence
  Synthetic construct
GMIFAVY

SEQ ID NO: 8598 - protein, 7 aa, Artificial Sequence
  Synthetic construct
GMIFQFF

SEQ ID NO: 8599 - protein, 7 aa, Artificial Sequence
  Synthetic construct
GMIFQFY

SEQ ID NO: 8600 - protein, 7 aa, Artificial Sequence
  Synthetic construct
GMIFQRF

SEQ ID NO: 8601 - protein, 7 aa, Artificial Sequence
  Synthetic construct
GMIFQRY

SEQ ID NO: 8602 - protein, 7 aa, Artificial Sequence
  Synthetic construct
GMIFQCF

SEQ ID NO: 8603 - protein, 7 aa, Artificial Sequence
  Synthetic construct
GMIFQCY

SEQ ID NO: 8604 - protein, 7 aa, Artificial Sequence
  Synthetic construct
GMIFQLF

SEQ ID NO: 8605 - protein, 7 aa, Artificial Sequence
  Synthetic construct
GMIFQLY

SEQ ID NO: 8606 - protein, 7 aa, Artificial Sequence
  Synthetic construct
GMIFQAF

SEQ ID NO: 8607 - protein, 7 aa, Artificial Sequence
  Synthetic construct
GMIFQAY

SEQ ID NO: 8608 - protein, 7 aa, Artificial Sequence
  Synthetic construct
GMIFQQF

SEQ ID NO: 8609 - protein, 7 aa, Artificial Sequence
  Synthetic construct
GMIFQQY

SEQ ID NO: 8610 - protein, 7 aa, Artificial Sequence
  Synthetic construct
GMIFQDF

SEQ ID NO: 8611 - protein, 7 aa, Artificial Sequence
  Synthetic construct
GMIFQDY

SEQ ID NO: 8612 - protein, 7 aa, Artificial Sequence
  Synthetic construct
GMIFQVF

SEQ ID NO: 8613 - protein, 7 aa, Artificial Sequence
  Synthetic construct
GMIFQVY

SEQ ID NO: 8614 - protein, 7 aa, Artificial Sequence
  Synthetic construct
GMGYIFF

SEQ ID NO: 8615 - protein, 7 aa, Artificial Sequence
  Synthetic construct
GMGYIFY

SEQ ID NO: 8616 - protein, 7 aa, Artificial Sequence
  Synthetic construct
GMGYIRF

SEQ ID NO: 8617 - protein, 7 aa, Artificial Sequence
  Synthetic construct
GMGYIRY

SEQ ID NO: 8618 - protein, 7 aa, Artificial Sequence
  Synthetic construct
GMGYICF

SEQ ID NO: 8619 - protein, 7 aa, Artificial Sequence
  Synthetic construct
GMGYICY

SEQ ID NO: 8620 - protein, 7 aa, Artificial Sequence
  Synthetic construct
GMGYILF

SEQ ID NO: 8621 - protein, 7 aa, Artificial Sequence
  Synthetic construct
GMGYILY

SEQ ID NO: 8622 - protein, 7 aa, Artificial Sequence
  Synthetic construct
GMGYIAF

SEQ ID NO: 8623 - protein, 7 aa, Artificial Sequence
  Synthetic construct
GMGYIAY

SEQ ID NO: 8624 - protein, 7 aa, Artificial Sequence
  Synthetic construct
GMGYIQF

SEQ ID NO: 8625 - protein, 7 aa, Artificial Sequence
  Synthetic construct
GMGYIQY

SEQ ID NO: 8626 - protein, 7 aa, Artificial Sequence
  Synthetic construct
GMGYIDF

SEQ ID NO: 8627 - protein, 7 aa, Artificial Sequence
  Synthetic construct
GMGYIDY

SEQ ID NO: 8628 - protein, 7 aa, Artificial Sequence
  Synthetic construct
GMGYIVF

SEQ ID NO: 8629 - protein, 7 aa, Artificial Sequence
  Synthetic construct
GMGYIVY

SEQ ID NO: 8630 - protein, 7 aa, Artificial Sequence
  Synthetic construct
GMGYDFF

SEQ ID NO: 8631 - protein, 7 aa, Artificial Sequence
  Synthetic construct
GMGYDFY

SEQ ID NO: 8632 - protein, 7 aa, Artificial Sequence
  Synthetic construct
GMGYDRF

SEQ ID NO: 8633 - protein, 7 aa, Artificial Sequence
  Synthetic construct
GMGYDRY

SEQ ID NO: 8634 - protein, 7 aa, Artificial Sequence
  Synthetic construct
GMGYDCF

SEQ ID NO: 8635 - protein, 7 aa, Artificial Sequence
  Synthetic construct
GMGYDCY

SEQ ID NO: 8636 - protein, 7 aa, Artificial Sequence
  Synthetic construct
GMGYDLF

SEQ ID NO: 8637 - protein, 7 aa, Artificial Sequence
  Synthetic construct
GMGYDLY

SEQ ID NO: 8638 - protein, 7 aa, Artificial Sequence
  Synthetic construct
GMGYDAF

SEQ ID NO: 8639 - protein, 7 aa, Artificial Sequence
  Synthetic construct
GMGYDAY

SEQ ID NO: 8640 - protein, 7 aa, Artificial Sequence
  Synthetic construct
GMGYDQF

SEQ ID NO: 8641 - protein, 7 aa, Artificial Sequence
  Synthetic construct
GMGYDQY

SEQ ID NO: 8642 - protein, 7 aa, Artificial Sequence
  Synthetic construct
GMGYDDF

SEQ ID NO: 8643 - protein, 7 aa, Artificial Sequence
  Synthetic construct
GMGYDDY

SEQ ID NO: 8644 - protein, 7 aa, Artificial Sequence
  Synthetic construct
GMGYDVF

SEQ ID NO: 8645 - protein, 7 aa, Artificial Sequence
  Synthetic construct
GMGYDVY

SEQ ID NO: 8646 - protein, 7 aa, Artificial Sequence
  Synthetic construct
GMGYYFF

SEQ ID NO: 8647 - protein, 7 aa, Artificial Sequence
  Synthetic construct
GMGYYFY

SEQ ID NO: 8648 - protein, 7 aa, Artificial Sequence
  Synthetic construct
GMGYYRF

SEQ ID NO: 8649 - protein, 7 aa, Artificial Sequence
  Synthetic construct
GMGYYRY

SEQ ID NO: 8650 - protein, 7 aa, Artificial Sequence
  Synthetic construct
GMGYYCF

SEQ ID NO: 8651 - protein, 7 aa, Artificial Sequence
  Synthetic construct
GMGYYCY

SEQ ID NO: 8652 - protein, 7 aa, Artificial Sequence
  Synthetic construct
GMGYYLF

SEQ ID NO: 8653 - protein, 7 aa, Artificial Sequence
  Synthetic construct
GMGYYLY

SEQ ID NO: 8654 - protein, 7 aa, Artificial Sequence
  Synthetic construct
GMGYYAF

SEQ ID NO: 8655 - protein, 7 aa, Artificial Sequence
  Synthetic construct
GMGYYAY

SEQ ID NO: 8656 - protein, 7 aa, Artificial Sequence
  Synthetic construct
GMGYYQF

SEQ ID NO: 8657 - protein, 7 aa, Artificial Sequence
  Synthetic construct
GMGYYQY

SEQ ID NO: 8658 - protein, 7 aa, Artificial Sequence
  Synthetic construct
GMGYYDF

SEQ ID NO: 8659 - protein, 7 aa, Artificial Sequence
  Synthetic construct
GMGYYDY

SEQ ID NO: 8660 - protein, 7 aa, Artificial Sequence
  Synthetic construct
GMGYYVF

SEQ ID NO: 8661 - protein, 7 aa, Artificial Sequence
  Synthetic construct
GMGYYVY

SEQ ID NO: 8662 - protein, 7 aa, Artificial Sequence
  Synthetic construct
GMGYFFF

SEQ ID NO: 8663 - protein, 7 aa, Artificial Sequence
  Synthetic construct
GMGYFFY

SEQ ID NO: 8664 - protein, 7 aa, Artificial Sequence
  Synthetic construct
GMGYFRF

SEQ ID NO: 8665 - protein, 7 aa, Artificial Sequence
  Synthetic construct
GMGYFRY

SEQ ID NO: 8666 - protein, 7 aa, Artificial Sequence
  Synthetic construct
GMGYFCF

SEQ ID NO: 8667 - protein, 7 aa, Artificial Sequence
  Synthetic construct
GMGYFCY

SEQ ID NO: 8668 - protein, 7 aa, Artificial Sequence
  Synthetic construct
GMGYFLF

SEQ ID NO: 8669 - protein, 7 aa, Artificial Sequence
  Synthetic construct
GMGYFLY

SEQ ID NO: 8670 - protein, 7 aa, Artificial Sequence
  Synthetic construct
GMGYFAF

SEQ ID NO: 8671 - protein, 7 aa, Artificial Sequence
  Synthetic construct
GMGYFAY

SEQ ID NO: 8672 - protein, 7 aa, Artificial Sequence
  Synthetic construct
GMGYFQF

SEQ ID NO: 8673 - protein, 7 aa, Artificial Sequence
  Synthetic construct
GMGYFQY

SEQ ID NO: 8674 - protein, 7 aa, Artificial Sequence
  Synthetic construct
GMGYFDF

SEQ ID NO: 8675 - protein, 7 aa, Artificial Sequence
  Synthetic construct
GMGYFDY

SEQ ID NO: 8676 - protein, 7 aa, Artificial Sequence
  Synthetic construct
GMGYFVF

SEQ ID NO: 8677 - protein, 7 aa, Artificial Sequence
  Synthetic construct
GMGYFVY

SEQ ID NO: 8678 - protein, 7 aa, Artificial Sequence
  Synthetic construct
GMGYVFF

SEQ ID NO: 8679 - protein, 7 aa, Artificial Sequence
  Synthetic construct
GMGYVFY

SEQ ID NO: 8680 - protein, 7 aa, Artificial Sequence
  Synthetic construct
GMGYVRF

SEQ ID NO: 8681 - protein, 7 aa, Artificial Sequence
  Synthetic construct
GMGYVRY

SEQ ID NO: 8682 - protein, 7 aa, Artificial Sequence
  Synthetic construct
GMGYVCF

SEQ ID NO: 8683 - protein, 7 aa, Artificial Sequence
  Synthetic construct
GMGYVCY

SEQ ID NO: 8684 - protein, 7 aa, Artificial Sequence
  Synthetic construct
GMGYVLF

SEQ ID NO: 8685 - protein, 7 aa, Artificial Sequence
  Synthetic construct
GMGYVLY

SEQ ID NO: 8686 - protein, 7 aa, Artificial Sequence
  Synthetic construct
GMGYVAF

SEQ ID NO: 8687 - protein, 7 aa, Artificial Sequence
  Synthetic construct
GMGYVAY

SEQ ID NO: 8688 - protein, 7 aa, Artificial Sequence
  Synthetic construct
GMGYVQF

SEQ ID NO: 8689 - protein, 7 aa, Artificial Sequence
  Synthetic construct
GMGYVQY

SEQ ID NO: 8690 - protein, 7 aa, Artificial Sequence
  Synthetic construct
GMGYVDF

SEQ ID NO: 8691 - protein, 7 aa, Artificial Sequence
  Synthetic construct
GMGYVDY

SEQ ID NO: 8692 - protein, 7 aa, Artificial Sequence
  Synthetic construct
GMGYVVF

SEQ ID NO: 8693 - protein, 7 aa, Artificial Sequence
  Synthetic construct
GMGYVVY

SEQ ID NO: 8694 - protein, 7 aa, Artificial Sequence
  Synthetic construct
GMGYTFF

SEQ ID NO: 8695 - protein, 7 aa, Artificial Sequence
  Synthetic construct
GMGYTFY

SEQ ID NO: 8696 - protein, 7 aa, Artificial Sequence
  Synthetic construct
GMGYTRF

SEQ ID NO: 8697 - protein, 7 aa, Artificial Sequence
  Synthetic construct
GMGYTRY

SEQ ID NO: 8698 - protein, 7 aa, Artificial Sequence
  Synthetic construct
GMGYTCF

SEQ ID NO: 8699 - protein, 7 aa, Artificial Sequence
  Synthetic construct
GMGYTCY

SEQ ID NO: 8700 - protein, 7 aa, Artificial Sequence
  Synthetic construct
GMGYTLF

SEQ ID NO: 8701 - protein, 7 aa, Artificial Sequence
  Synthetic construct
GMGYTLY

SEQ ID NO: 8702 - protein, 7 aa, Artificial Sequence
  Synthetic construct
GMGYTAF

SEQ ID NO: 8703 - protein, 7 aa, Artificial Sequence
  Synthetic construct
GMGYTAY

SEQ ID NO: 8704 - protein, 7 aa, Artificial Sequence
  Synthetic construct
GMGYTQF

SEQ ID NO: 8705 - protein, 7 aa, Artificial Sequence
  Synthetic construct
GMGYTQY

SEQ ID NO: 8706 - protein, 7 aa, Artificial Sequence
  Synthetic construct
GMGYTDF

SEQ ID NO: 8707 - protein, 7 aa, Artificial Sequence
  Synthetic construct
GMGYTDY

SEQ ID NO: 8708 - protein, 7 aa, Artificial Sequence
  Synthetic construct
GMGYTVF

SEQ ID NO: 8709 - protein, 7 aa, Artificial Sequence
  Synthetic construct
GMGYTVY

SEQ ID NO: 8710 - protein, 7 aa, Artificial Sequence
  Synthetic construct
GMGYGFF

SEQ ID NO: 8711 - protein, 7 aa, Artificial Sequence
  Synthetic construct
GMGYGFY

SEQ ID NO: 8712 - protein, 7 aa, Artificial Sequence
  Synthetic construct
GMGYGRF

SEQ ID NO: 8713 - protein, 7 aa, Artificial Sequence
  Synthetic construct
GMGYGRY

SEQ ID NO: 8714 - protein, 7 aa, Artificial Sequence
  Synthetic construct
GMGYGCF

SEQ ID NO: 8715 - protein, 7 aa, Artificial Sequence
  Synthetic construct
GMGYGCY

SEQ ID NO: 8716 - protein, 7 aa, Artificial Sequence
  Synthetic construct
GMGYGLF

SEQ ID NO: 8717 - protein, 7 aa, Artificial Sequence
  Synthetic construct
GMGYGLY

SEQ ID NO: 8718 - protein, 7 aa, Artificial Sequence
  Synthetic construct
GMGYGAF

SEQ ID NO: 8719 - protein, 7 aa, Artificial Sequence
  Synthetic construct
GMGYGAY

SEQ ID NO: 8720 - protein, 7 aa, Artificial Sequence
  Synthetic construct
GMGYGQF

SEQ ID NO: 8721 - protein, 7 aa, Artificial Sequence
  Synthetic construct
GMGYGQY

SEQ ID NO: 8722 - protein, 7 aa, Artificial Sequence
  Synthetic construct
GMGYGDF

SEQ ID NO: 8723 - protein, 7 aa, Artificial Sequence
  Synthetic construct
GMGYGDY

SEQ ID NO: 8724 - protein, 7 aa, Artificial Sequence
  Synthetic construct
GMGYGVF

SEQ ID NO: 8725 - protein, 7 aa, Artificial Sequence
  Synthetic construct
GMGYGVY

SEQ ID NO: 8726 - protein, 7 aa, Artificial Sequence
  Synthetic construct
GMGYAFF

SEQ ID NO: 8727 - protein, 7 aa, Artificial Sequence
  Synthetic construct
GMGYAFY

SEQ ID NO: 8728 - protein, 7 aa, Artificial Sequence
  Synthetic construct
GMGYARF

SEQ ID NO: 8729 - protein, 7 aa, Artificial Sequence
  Synthetic construct
GMGYARY

SEQ ID NO: 8730 - protein, 7 aa, Artificial Sequence
  Synthetic construct
GMGYACF

SEQ ID NO: 8731 - protein, 7 aa, Artificial Sequence
  Synthetic construct
GMGYACY

SEQ ID NO: 8732 - protein, 7 aa, Artificial Sequence
  Synthetic construct
GMGYALF

SEQ ID NO: 8733 - protein, 7 aa, Artificial Sequence
  Synthetic construct
GMGYALY

SEQ ID NO: 8734 - protein, 7 aa, Artificial Sequence
  Synthetic construct
GMGYAAF

SEQ ID NO: 8735 - protein, 7 aa, Artificial Sequence
  Synthetic construct
GMGYAAY

SEQ ID NO: 8736 - protein, 7 aa, Artificial Sequence
  Synthetic construct
GMGYAQF

SEQ ID NO: 8737 - protein, 7 aa, Artificial Sequence
  Synthetic construct
GMGYAQY

SEQ ID NO: 8738 - protein, 7 aa, Artificial Sequence
  Synthetic construct
GMGYADF

SEQ ID NO: 8739 - protein, 7 aa, Artificial Sequence
  Synthetic construct
GMGYADY

SEQ ID NO: 8740 - protein, 7 aa, Artificial Sequence
  Synthetic construct
GMGYAVF

SEQ ID NO: 8741 - protein, 7 aa, Artificial Sequence
  Synthetic construct
GMGYAVY

SEQ ID NO: 8742 - protein, 7 aa, Artificial Sequence
  Synthetic construct
GMGYQFF

SEQ ID NO: 8743 - protein, 7 aa, Artificial Sequence
  Synthetic construct
GMGYQFY

SEQ ID NO: 8744 - protein, 7 aa, Artificial Sequence
  Synthetic construct
GMGYQRF

SEQ ID NO: 8745 - protein, 7 aa, Artificial Sequence
  Synthetic construct
GMGYQRY

SEQ ID NO: 8746 - protein, 7 aa, Artificial Sequence
  Synthetic construct
GMGYQCF

SEQ ID NO: 8747 - protein, 7 aa, Artificial Sequence
  Synthetic construct
GMGYQCY

SEQ ID NO: 8748 - protein, 7 aa, Artificial Sequence
  Synthetic construct
GMGYQLF

SEQ ID NO: 8749 - protein, 7 aa, Artificial Sequence
  Synthetic construct
GMGYQLY

SEQ ID NO: 8750 - protein, 7 aa, Artificial Sequence
  Synthetic construct
GMGYQAF

SEQ ID NO: 8751 - protein, 7 aa, Artificial Sequence
  Synthetic construct
GMGYQAY

SEQ ID NO: 8752 - protein, 7 aa, Artificial Sequence
  Synthetic construct
GMGYQQF

SEQ ID NO: 8753 - protein, 7 aa, Artificial Sequence
  Synthetic construct
GMGYQQY

SEQ ID NO: 8754 - protein, 7 aa, Artificial Sequence
  Synthetic construct
GMGYQDF

SEQ ID NO: 8755 - protein, 7 aa, Artificial Sequence
  Synthetic construct
GMGYQDY

SEQ ID NO: 8756 - protein, 7 aa, Artificial Sequence
  Synthetic construct
GMGYQVF

SEQ ID NO: 8757 - protein, 7 aa, Artificial Sequence
  Synthetic construct
GMGYQVY

SEQ ID NO: 8758 - protein, 7 aa, Artificial Sequence
  Synthetic construct
GMGPIFF

SEQ ID NO: 8759 - protein, 7 aa, Artificial Sequence
  Synthetic construct
GMGPIFY

SEQ ID NO: 8760 - protein, 7 aa, Artificial Sequence
  Synthetic construct
GMGPIRF

SEQ ID NO: 8761 - protein, 7 aa, Artificial Sequence
  Synthetic construct
GMGPIRY

SEQ ID NO: 8762 - protein, 7 aa, Artificial Sequence
  Synthetic construct
GMGPICF

SEQ ID NO: 8763 - protein, 7 aa, Artificial Sequence
  Synthetic construct
GMGPICY

SEQ ID NO: 8764 - protein, 7 aa, Artificial Sequence
  Synthetic construct
GMGPILF

SEQ ID NO: 8765 - protein, 7 aa, Artificial Sequence
  Synthetic construct
GMGPILY

SEQ ID NO: 8766 - protein, 7 aa, Artificial Sequence
  Synthetic construct
GMGPIAF

SEQ ID NO: 8767 - protein, 7 aa, Artificial Sequence
  Synthetic construct
GMGPIAY

SEQ ID NO: 8768 - protein, 7 aa, Artificial Sequence
  Synthetic construct
GMGPIQF

SEQ ID NO: 8769 - protein, 7 aa, Artificial Sequence
  Synthetic construct
GMGPIQY

SEQ ID NO: 8770 - protein, 7 aa, Artificial Sequence
  Synthetic construct
GMGPIDF

SEQ ID NO: 8771 - protein, 7 aa, Artificial Sequence
  Synthetic construct
GMGPIDY

SEQ ID NO: 8772 - protein, 7 aa, Artificial Sequence
  Synthetic construct
GMGPIVF

SEQ ID NO: 8773 - protein, 7 aa, Artificial Sequence
  Synthetic construct
GMGPIVY

SEQ ID NO: 8774 - protein, 7 aa, Artificial Sequence
  Synthetic construct
GMGPDFF

SEQ ID NO: 8775 - protein, 7 aa, Artificial Sequence
  Synthetic construct
GMGPDFY

SEQ ID NO: 8776 - protein, 7 aa, Artificial Sequence
  Synthetic construct
GMGPDRF

SEQ ID NO: 8777 - protein, 7 aa, Artificial Sequence
  Synthetic construct
GMGPDRY

SEQ ID NO: 8778 - protein, 7 aa, Artificial Sequence
  Synthetic construct
GMGPDCF

SEQ ID NO: 8779 - protein, 7 aa, Artificial Sequence
  Synthetic construct
GMGPDCY

SEQ ID NO: 8780 - protein, 7 aa, Artificial Sequence
  Synthetic construct
GMGPDLF

SEQ ID NO: 8781 - protein, 7 aa, Artificial Sequence
  Synthetic construct
GMGPDLY

SEQ ID NO: 8782 - protein, 7 aa, Artificial Sequence
  Synthetic construct
GMGPDAF

SEQ ID NO: 8783 - protein, 7 aa, Artificial Sequence
  Synthetic construct
GMGPDAY

SEQ ID NO: 8784 - protein, 7 aa, Artificial Sequence
  Synthetic construct
GMGPDQF

SEQ ID NO: 8785 - protein, 7 aa, Artificial Sequence
  Synthetic construct
GMGPDQY

SEQ ID NO: 8786 - protein, 7 aa, Artificial Sequence
  Synthetic construct
GMGPDDF

SEQ ID NO: 8787 - protein, 7 aa, Artificial Sequence
  Synthetic construct
GMGPDDY

SEQ ID NO: 8788 - protein, 7 aa, Artificial Sequence
  Synthetic construct
GMGPDVF

SEQ ID NO: 8789 - protein, 7 aa, Artificial Sequence
  Synthetic construct
GMGPDVY

SEQ ID NO: 8790 - protein, 7 aa, Artificial Sequence
  Synthetic construct
GMGPYFF

SEQ ID NO: 8791 - protein, 7 aa, Artificial Sequence
  Synthetic construct
GMGPYFY

SEQ ID NO: 8792 - protein, 7 aa, Artificial Sequence
  Synthetic construct
GMGPYRF

SEQ ID NO: 8793 - protein, 7 aa, Artificial Sequence
  Synthetic construct
GMGPYRY

SEQ ID NO: 8794 - protein, 7 aa, Artificial Sequence
  Synthetic construct
GMGPYCF

SEQ ID NO: 8795 - protein, 7 aa, Artificial Sequence
  Synthetic construct
GMGPYCY

SEQ ID NO: 8796 - protein, 7 aa, Artificial Sequence
  Synthetic construct
GMGPYLF

SEQ ID NO: 8797 - protein, 7 aa, Artificial Sequence
  Synthetic construct
GMGPYLY

SEQ ID NO: 8798 - protein, 7 aa, Artificial Sequence
  Synthetic construct
GMGPYAF

SEQ ID NO: 8799 - protein, 7 aa, Artificial Sequence
  Synthetic construct
GMGPYAY

SEQ ID NO: 8800 - protein, 7 aa, Artificial Sequence
  Synthetic construct
GMGPYQF

SEQ ID NO: 8801 - protein, 7 aa, Artificial Sequence
  Synthetic construct
GMGPYQY

SEQ ID NO: 8802 - protein, 7 aa, Artificial Sequence
  Synthetic construct
GMGPYDF

SEQ ID NO: 8803 - protein, 7 aa, Artificial Sequence
  Synthetic construct
GMGPYDY

SEQ ID NO: 8804 - protein, 7 aa, Artificial Sequence
  Synthetic construct
GMGPYVF

SEQ ID NO: 8805 - protein, 7 aa, Artificial Sequence
  Synthetic construct
GMGPYVY

SEQ ID NO: 8806 - protein, 7 aa, Artificial Sequence
  Synthetic construct
GMGPFFF

SEQ ID NO: 8807 - protein, 7 aa, Artificial Sequence
  Synthetic construct
GMGPFFY

SEQ ID NO: 8808 - protein, 7 aa, Artificial Sequence
  Synthetic construct
GMGPFRF

SEQ ID NO: 8809 - protein, 7 aa, Artificial Sequence
  Synthetic construct
GMGPFRY

SEQ ID NO: 8810 - protein, 7 aa, Artificial Sequence
  Synthetic construct
GMGPFCF

SEQ ID NO: 8811 - protein, 7 aa, Artificial Sequence
  Synthetic construct
GMGPFCY

SEQ ID NO: 8812 - protein, 7 aa, Artificial Sequence
  Synthetic construct
GMGPFLF

SEQ ID NO: 8813 - protein, 7 aa, Artificial Sequence
  Synthetic construct
GMGPFLY

SEQ ID NO: 8814 - protein, 7 aa, Artificial Sequence
  Synthetic construct
GMGPFAF

SEQ ID NO: 8815 - protein, 7 aa, Artificial Sequence
  Synthetic construct
GMGPFAY

SEQ ID NO: 8816 - protein, 7 aa, Artificial Sequence
  Synthetic construct
GMGPFQF

SEQ ID NO: 8817 - protein, 7 aa, Artificial Sequence
  Synthetic construct
GMGPFQY

SEQ ID NO: 8818 - protein, 7 aa, Artificial Sequence
  Synthetic construct
GMGPFDF

SEQ ID NO: 8819 - protein, 7 aa, Artificial Sequence
  Synthetic construct
GMGPFDY

SEQ ID NO: 8820 - protein, 7 aa, Artificial Sequence
  Synthetic construct
GMGPFVF

SEQ ID NO: 8821 - protein, 7 aa, Artificial Sequence
  Synthetic construct
GMGPFVY

SEQ ID NO: 8822 - protein, 7 aa, Artificial Sequence
  Synthetic construct
GMGPVFF

SEQ ID NO: 8823 - protein, 7 aa, Artificial Sequence
  Synthetic construct
GMGPVFY

SEQ ID NO: 8824 - protein, 7 aa, Artificial Sequence
  Synthetic construct
GMGPVRF

SEQ ID NO: 8825 - protein, 7 aa, Artificial Sequence
  Synthetic construct
GMGPVRY

SEQ ID NO: 8826 - protein, 7 aa, Artificial Sequence
  Synthetic construct
GMGPVCF

SEQ ID NO: 8827 - protein, 7 aa, Artificial Sequence
  Synthetic construct
GMGPVCY

SEQ ID NO: 8828 - protein, 7 aa, Artificial Sequence
  Synthetic construct
GMGPVLF

SEQ ID NO: 8829 - protein, 7 aa, Artificial Sequence
  Synthetic construct
GMGPVLY

SEQ ID NO: 8830 - protein, 7 aa, Artificial Sequence
  Synthetic construct
GMGPVAF

SEQ ID NO: 8831 - protein, 7 aa, Artificial Sequence
  Synthetic construct
GMGPVAY

SEQ ID NO: 8832 - protein, 7 aa, Artificial Sequence
  Synthetic construct
GMGPVQF

SEQ ID NO: 8833 - protein, 7 aa, Artificial Sequence
  Synthetic construct
GMGPVQY

SEQ ID NO: 8834 - protein, 7 aa, Artificial Sequence
  Synthetic construct
GMGPVDF

SEQ ID NO: 8835 - protein, 7 aa, Artificial Sequence
  Synthetic construct
GMGPVDY

SEQ ID NO: 8836 - protein, 7 aa, Artificial Sequence
  Synthetic construct
GMGPVVF

SEQ ID NO: 8837 - protein, 7 aa, Artificial Sequence
  Synthetic construct
GMGPVVY

SEQ ID NO: 8838 - protein, 7 aa, Artificial Sequence
  Synthetic construct
GMGPTFF

SEQ ID NO: 8839 - protein, 7 aa, Artificial Sequence
  Synthetic construct
GMGPTFY

SEQ ID NO: 8840 - protein, 7 aa, Artificial Sequence
  Synthetic construct
GMGPTRF

SEQ ID NO: 8841 - protein, 7 aa, Artificial Sequence
  Synthetic construct
GMGPTRY

SEQ ID NO: 8842 - protein, 7 aa, Artificial Sequence
  Synthetic construct
GMGPTCF

SEQ ID NO: 8843 - protein, 7 aa, Artificial Sequence
  Synthetic construct
GMGPTCY

SEQ ID NO: 8844 - protein, 7 aa, Artificial Sequence
  Synthetic construct
GMGPTLF

SEQ ID NO: 8845 - protein, 7 aa, Artificial Sequence
  Synthetic construct
GMGPTLY

SEQ ID NO: 8846 - protein, 7 aa, Artificial Sequence
  Synthetic construct
GMGPTAF

SEQ ID NO: 8847 - protein, 7 aa, Artificial Sequence
  Synthetic construct
GMGPTAY

SEQ ID NO: 8848 - protein, 7 aa, Artificial Sequence
  Synthetic construct
GMGPTQF

SEQ ID NO: 8849 - protein, 7 aa, Artificial Sequence
  Synthetic construct
GMGPTQY

SEQ ID NO: 8850 - protein, 7 aa, Artificial Sequence
  Synthetic construct
GMGPTDF

SEQ ID NO: 8851 - protein, 7 aa, Artificial Sequence
  Synthetic construct
GMGPTDY

SEQ ID NO: 8852 - protein, 7 aa, Artificial Sequence
  Synthetic construct
GMGPTVF

SEQ ID NO: 8853 - protein, 7 aa, Artificial Sequence
  Synthetic construct
GMGPTVY

SEQ ID NO: 8854 - protein, 7 aa, Artificial Sequence
  Synthetic construct
GMGPGFF

SEQ ID NO: 8855 - protein, 7 aa, Artificial Sequence
  Synthetic construct
GMGPGFY

SEQ ID NO: 8856 - protein, 7 aa, Artificial Sequence
  Synthetic construct
GMGPGRF

SEQ ID NO: 8857 - protein, 7 aa, Artificial Sequence
  Synthetic construct
GMGPGRY

SEQ ID NO: 8858 - protein, 7 aa, Artificial Sequence
  Synthetic construct
GMGPGCF

SEQ ID NO: 8859 - protein, 7 aa, Artificial Sequence
  Synthetic construct
GMGPGCY

SEQ ID NO: 8860 - protein, 7 aa, Artificial Sequence
  Synthetic construct
GMGPGLF

SEQ ID NO: 8861 - protein, 7 aa, Artificial Sequence
  Synthetic construct
GMGPGLY

SEQ ID NO: 8862 - protein, 7 aa, Artificial Sequence
  Synthetic construct
GMGPGAF

SEQ ID NO: 8863 - protein, 7 aa, Artificial Sequence
  Synthetic construct
GMGPGAY

SEQ ID NO: 8864 - protein, 7 aa, Artificial Sequence
  Synthetic construct
GMGPGQF

SEQ ID NO: 8865 - protein, 7 aa, Artificial Sequence
  Synthetic construct
GMGPGQY

SEQ ID NO: 8866 - protein, 7 aa, Artificial Sequence
  Synthetic construct
GMGPGDF

SEQ ID NO: 8867 - protein, 7 aa, Artificial Sequence
  Synthetic construct
GMGPGDY

SEQ ID NO: 8868 - protein, 7 aa, Artificial Sequence
  Synthetic construct
GMGPGVF

SEQ ID NO: 8869 - protein, 7 aa, Artificial Sequence
  Synthetic construct
GMGPGVY

SEQ ID NO: 8870 - protein, 7 aa, Artificial Sequence
  Synthetic construct
GMGPAFF

SEQ ID NO: 8871 - protein, 7 aa, Artificial Sequence
  Synthetic construct
GMGPAFY

SEQ ID NO: 8872 - protein, 7 aa, Artificial Sequence
  Synthetic construct
GMGPARF

SEQ ID NO: 8873 - protein, 7 aa, Artificial Sequence
  Synthetic construct
GMGPARY

SEQ ID NO: 8874 - protein, 7 aa, Artificial Sequence
  Synthetic construct
GMGPACF

SEQ ID NO: 8875 - protein, 7 aa, Artificial Sequence
  Synthetic construct
GMGPACY

SEQ ID NO: 8876 - protein, 7 aa, Artificial Sequence
  Synthetic construct
GMGPALF

SEQ ID NO: 8877 - protein, 7 aa, Artificial Sequence
  Synthetic construct
GMGPALY

SEQ ID NO: 8878 - protein, 7 aa, Artificial Sequence
  Synthetic construct
GMGPAAF

SEQ ID NO: 8879 - protein, 7 aa, Artificial Sequence
  Synthetic construct
GMGPAAY

SEQ ID NO: 8880 - protein, 7 aa, Artificial Sequence
  Synthetic construct
GMGPAQF

SEQ ID NO: 8881 - protein, 7 aa, Artificial Sequence
  Synthetic construct
GMGPAQY

SEQ ID NO: 8882 - protein, 7 aa, Artificial Sequence
  Synthetic construct
GMGPADF

SEQ ID NO: 8883 - protein, 7 aa, Artificial Sequence
  Synthetic construct
GMGPADY

SEQ ID NO: 8884 - protein, 7 aa, Artificial Sequence
  Synthetic construct
GMGPAVF

SEQ ID NO: 8885 - protein, 7 aa, Artificial Sequence
  Synthetic construct
GMGPAVY

SEQ ID NO: 8886 - protein, 7 aa, Artificial Sequence
  Synthetic construct
GMGPQFF

SEQ ID NO: 8887 - protein, 7 aa, Artificial Sequence
  Synthetic construct
GMGPQFY

SEQ ID NO: 8888 - protein, 7 aa, Artificial Sequence
  Synthetic construct
GMGPQRF

SEQ ID NO: 8889 - protein, 7 aa, Artificial Sequence
  Synthetic construct
GMGPQRY

SEQ ID NO: 8890 - protein, 7 aa, Artificial Sequence
  Synthetic construct
GMGPQCF

SEQ ID NO: 8891 - protein, 7 aa, Artificial Sequence
  Synthetic construct
GMGPQCY

SEQ ID NO: 8892 - protein, 7 aa, Artificial Sequence
  Synthetic construct
GMGPQLF

SEQ ID NO: 8893 - protein, 7 aa, Artificial Sequence
  Synthetic construct
GMGPQLY

SEQ ID NO: 8894 - protein, 7 aa, Artificial Sequence
  Synthetic construct
GMGPQAF

SEQ ID NO: 8895 - protein, 7 aa, Artificial Sequence
  Synthetic construct
GMGPQAY

SEQ ID NO: 8896 - protein, 7 aa, Artificial Sequence
  Synthetic construct
GMGPQQF

SEQ ID NO: 8897 - protein, 7 aa, Artificial Sequence
  Synthetic construct
GMGPQQY

SEQ ID NO: 8898 - protein, 7 aa, Artificial Sequence
  Synthetic construct
GMGPQDF

SEQ ID NO: 8899 - protein, 7 aa, Artificial Sequence
  Synthetic construct
GMGPQDY

SEQ ID NO: 8900 - protein, 7 aa, Artificial Sequence
  Synthetic construct
GMGPQVF

SEQ ID NO: 8901 - protein, 7 aa, Artificial Sequence
  Synthetic construct
GMGPQVY

SEQ ID NO: 8902 - protein, 7 aa, Artificial Sequence
  Synthetic construct
GMGHIFF

SEQ ID NO: 8903 - protein, 7 aa, Artificial Sequence
  Synthetic construct
GMGHIFY

SEQ ID NO: 8904 - protein, 7 aa, Artificial Sequence
  Synthetic construct
GMGHIRF

SEQ ID NO: 8905 - protein, 7 aa, Artificial Sequence
  Synthetic construct
GMGHIRY

SEQ ID NO: 8906 - protein, 7 aa, Artificial Sequence
  Synthetic construct
GMGHICF

SEQ ID NO: 8907 - protein, 7 aa, Artificial Sequence
  Synthetic construct
GMGHICY

SEQ ID NO: 8908 - protein, 7 aa, Artificial Sequence
  Synthetic construct
GMGHILF

SEQ ID NO: 8909 - protein, 7 aa, Artificial Sequence
  Synthetic construct
GMGHILY

SEQ ID NO: 8910 - protein, 7 aa, Artificial Sequence
  Synthetic construct
GMGHIAF

SEQ ID NO: 8911 - protein, 7 aa, Artificial Sequence
  Synthetic construct
GMGHIAY

SEQ ID NO: 8912 - protein, 7 aa, Artificial Sequence
  Synthetic construct
GMGHIQF

SEQ ID NO: 8913 - protein, 7 aa, Artificial Sequence
  Synthetic construct
GMGHIQY

SEQ ID NO: 8914 - protein, 7 aa, Artificial Sequence
  Synthetic construct
GMGHIDF

SEQ ID NO: 8915 - protein, 7 aa, Artificial Sequence
  Synthetic construct
GMGHIDY

SEQ ID NO: 8916 - protein, 7 aa, Artificial Sequence
  Synthetic construct
GMGHIVF

SEQ ID NO: 8917 - protein, 7 aa, Artificial Sequence
  Synthetic construct
GMGHIVY

SEQ ID NO: 8918 - protein, 7 aa, Artificial Sequence
  Synthetic construct
GMGHDFF

SEQ ID NO: 8919 - protein, 7 aa, Artificial Sequence
  Synthetic construct
GMGHDFY

SEQ ID NO: 8920 - protein, 7 aa, Artificial Sequence
  Synthetic construct
GMGHDRF

SEQ ID NO: 8921 - protein, 7 aa, Artificial Sequence
  Synthetic construct
GMGHDRY

SEQ ID NO: 8922 - protein, 7 aa, Artificial Sequence
  Synthetic construct
GMGHDCF

SEQ ID NO: 8923 - protein, 7 aa, Artificial Sequence
  Synthetic construct
GMGHDCY

SEQ ID NO: 8924 - protein, 7 aa, Artificial Sequence
  Synthetic construct
GMGHDLF

SEQ ID NO: 8925 - protein, 7 aa, Artificial Sequence
  Synthetic construct
GMGHDLY

SEQ ID NO: 8926 - protein, 7 aa, Artificial Sequence
  Synthetic construct
GMGHDAF

SEQ ID NO: 8927 - protein, 7 aa, Artificial Sequence
  Synthetic construct
GMGHDAY

SEQ ID NO: 8928 - protein, 7 aa, Artificial Sequence
  Synthetic construct
GMGHDQF

SEQ ID NO: 8929 - protein, 7 aa, Artificial Sequence
  Synthetic construct
GMGHDQY

SEQ ID NO: 8930 - protein, 7 aa, Artificial Sequence
  Synthetic construct
GMGHDDF

SEQ ID NO: 8931 - protein, 7 aa, Artificial Sequence
  Synthetic construct
GMGHDDY

SEQ ID NO: 8932 - protein, 7 aa, Artificial Sequence
  Synthetic construct
GMGHDVF

SEQ ID NO: 8933 - protein, 7 aa, Artificial Sequence
  Synthetic construct
GMGHDVY

SEQ ID NO: 8934 - protein, 7 aa, Artificial Sequence
  Synthetic construct
GMGHYFF

SEQ ID NO: 8935 - protein, 7 aa, Artificial Sequence
  Synthetic construct
GMGHYFY

SEQ ID NO: 8936 - protein, 7 aa, Artificial Sequence
  Synthetic construct
GMGHYRF

SEQ ID NO: 8937 - protein, 7 aa, Artificial Sequence
  Synthetic construct
GMGHYRY

SEQ ID NO: 8938 - protein, 7 aa, Artificial Sequence
  Synthetic construct
GMGHYCF

SEQ ID NO: 8939 - protein, 7 aa, Artificial Sequence
  Synthetic construct
GMGHYCY

SEQ ID NO: 8940 - protein, 7 aa, Artificial Sequence
  Synthetic construct
GMGHYLF

SEQ ID NO: 8941 - protein, 7 aa, Artificial Sequence
  Synthetic construct
GMGHYLY

SEQ ID NO: 8942 - protein, 7 aa, Artificial Sequence
  Synthetic construct
GMGHYAF

SEQ ID NO: 8943 - protein, 7 aa, Artificial Sequence
  Synthetic construct
GMGHYAY

SEQ ID NO: 8944 - protein, 7 aa, Artificial Sequence
  Synthetic construct
GMGHYQF

SEQ ID NO: 8945 - protein, 7 aa, Artificial Sequence
  Synthetic construct
GMGHYQY

SEQ ID NO: 8946 - protein, 7 aa, Artificial Sequence
  Synthetic construct
GMGHYDF

SEQ ID NO: 8947 - protein, 7 aa, Artificial Sequence
  Synthetic construct
GMGHYDY

SEQ ID NO: 8948 - protein, 7 aa, Artificial Sequence
  Synthetic construct
GMGHYVF

SEQ ID NO: 8949 - protein, 7 aa, Artificial Sequence
  Synthetic construct
GMGHYVY

SEQ ID NO: 8950 - protein, 7 aa, Artificial Sequence
  Synthetic construct
GMGHFFF

SEQ ID NO: 8951 - protein, 7 aa, Artificial Sequence
  Synthetic construct
GMGHFFY

SEQ ID NO: 8952 - protein, 7 aa, Artificial Sequence
  Synthetic construct
GMGHFRF

SEQ ID NO: 8953 - protein, 7 aa, Artificial Sequence
  Synthetic construct
GMGHFRY

SEQ ID NO: 8954 - protein, 7 aa, Artificial Sequence
  Synthetic construct
GMGHFCF

SEQ ID NO: 8955 - protein, 7 aa, Artificial Sequence
  Synthetic construct
GMGHFCY

SEQ ID NO: 8956 - protein, 7 aa, Artificial Sequence
  Synthetic construct
GMGHFLF

SEQ ID NO: 8957 - protein, 7 aa, Artificial Sequence
  Synthetic construct
GMGHFLY

SEQ ID NO: 8958 - protein, 7 aa, Artificial Sequence
  Synthetic construct
GMGHFAF

SEQ ID NO: 8959 - protein, 7 aa, Artificial Sequence
  Synthetic construct
GMGHFAY

SEQ ID NO: 8960 - protein, 7 aa, Artificial Sequence
  Synthetic construct
GMGHFQF

SEQ ID NO: 8961 - protein, 7 aa, Artificial Sequence
  Synthetic construct
GMGHFQY

SEQ ID NO: 8962 - protein, 7 aa, Artificial Sequence
  Synthetic construct
GMGHFDF

SEQ ID NO: 8963 - protein, 7 aa, Artificial Sequence
  Synthetic construct
GMGHFDY

SEQ ID NO: 8964 - protein, 7 aa, Artificial Sequence
  Synthetic construct
GMGHFVF

SEQ ID NO: 8965 - protein, 7 aa, Artificial Sequence
  Synthetic construct
GMGHFVY

SEQ ID NO: 8966 - protein, 7 aa, Artificial Sequence
  Synthetic construct
GMGHVFF

SEQ ID NO: 8967 - protein, 7 aa, Artificial Sequence
  Synthetic construct
GMGHVFY

SEQ ID NO: 8968 - protein, 7 aa, Artificial Sequence
  Synthetic construct
GMGHVRF

SEQ ID NO: 8969 - protein, 7 aa, Artificial Sequence
  Synthetic construct
GMGHVRY

SEQ ID NO: 8970 - protein, 7 aa, Artificial Sequence
  Synthetic construct
GMGHVCF

SEQ ID NO: 8971 - protein, 7 aa, Artificial Sequence
  Synthetic construct
GMGHVCY

SEQ ID NO: 8972 - protein, 7 aa, Artificial Sequence
  Synthetic construct
GMGHVLF

SEQ ID NO: 8973 - protein, 7 aa, Artificial Sequence
  Synthetic construct
GMGHVLY

SEQ ID NO: 8974 - protein, 7 aa, Artificial Sequence
  Synthetic construct
GMGHVAF

SEQ ID NO: 8975 - protein, 7 aa, Artificial Sequence
  Synthetic construct
GMGHVAY

SEQ ID NO: 8976 - protein, 7 aa, Artificial Sequence
  Synthetic construct
GMGHVQF

SEQ ID NO: 8977 - protein, 7 aa, Artificial Sequence
  Synthetic construct
GMGHVQY

SEQ ID NO: 8978 - protein, 7 aa, Artificial Sequence
  Synthetic construct
GMGHVDF

SEQ ID NO: 8979 - protein, 7 aa, Artificial Sequence
  Synthetic construct
GMGHVDY

SEQ ID NO: 8980 - protein, 7 aa, Artificial Sequence
  Synthetic construct
GMGHVVF

SEQ ID NO: 8981 - protein, 7 aa, Artificial Sequence
  Synthetic construct
GMGHVVY

SEQ ID NO: 8982 - protein, 7 aa, Artificial Sequence
  Synthetic construct
GMGHTFF

SEQ ID NO: 8983 - protein, 7 aa, Artificial Sequence
  Synthetic construct
GMGHTFY

SEQ ID NO: 8984 - protein, 7 aa, Artificial Sequence
  Synthetic construct
GMGHTRF

SEQ ID NO: 8985 - protein, 7 aa, Artificial Sequence
  Synthetic construct
GMGHTRY

SEQ ID NO: 8986 - protein, 7 aa, Artificial Sequence
  Synthetic construct
GMGHTCF

SEQ ID NO: 8987 - protein, 7 aa, Artificial Sequence
  Synthetic construct
GMGHTCY

SEQ ID NO: 8988 - protein, 7 aa, Artificial Sequence
  Synthetic construct
GMGHTLF

SEQ ID NO: 8989 - protein, 7 aa, Artificial Sequence
  Synthetic construct
GMGHTLY

SEQ ID NO: 8990 - protein, 7 aa, Artificial Sequence
  Synthetic construct
GMGHTAF

SEQ ID NO: 8991 - protein, 7 aa, Artificial Sequence
  Synthetic construct
GMGHTAY

SEQ ID NO: 8992 - protein, 7 aa, Artificial Sequence
  Synthetic construct
GMGHTQF

SEQ ID NO: 8993 - protein, 7 aa, Artificial Sequence
  Synthetic construct
GMGHTQY

SEQ ID NO: 8994 - protein, 7 aa, Artificial Sequence
  Synthetic construct
GMGHTDF

SEQ ID NO: 8995 - protein, 7 aa, Artificial Sequence
  Synthetic construct
GMGHTDY

SEQ ID NO: 8996 - protein, 7 aa, Artificial Sequence
  Synthetic construct
GMGHTVF

SEQ ID NO: 8997 - protein, 7 aa, Artificial Sequence
  Synthetic construct
GMGHTVY

SEQ ID NO: 8998 - protein, 7 aa, Artificial Sequence
  Synthetic construct
GMGHGFF

SEQ ID NO: 8999 - protein, 7 aa, Artificial Sequence
  Synthetic construct
GMGHGFY

SEQ ID NO: 9000 - protein, 7 aa, Artificial Sequence
  Synthetic construct
GMGHGRF

SEQ ID NO: 9001 - protein, 7 aa, Artificial Sequence
  Synthetic construct
GMGHGRY

SEQ ID NO: 9002 - protein, 7 aa, Artificial Sequence
  Synthetic construct
GMGHGCF

SEQ ID NO: 9003 - protein, 7 aa, Artificial Sequence
  Synthetic construct
GMGHGCY

SEQ ID NO: 9004 - protein, 7 aa, Artificial Sequence
  Synthetic construct
GMGHGLF

SEQ ID NO: 9005 - protein, 7 aa, Artificial Sequence
  Synthetic construct
GMGHGLY

SEQ ID NO: 9006 - protein, 7 aa, Artificial Sequence
  Synthetic construct
GMGHGAF

SEQ ID NO: 9007 - protein, 7 aa, Artificial Sequence
  Synthetic construct
GMGHGAY

SEQ ID NO: 9008 - protein, 7 aa, Artificial Sequence
  Synthetic construct
GMGHGQF

SEQ ID NO: 9009 - protein, 7 aa, Artificial Sequence
  Synthetic construct
GMGHGQY

SEQ ID NO: 9010 - protein, 7 aa, Artificial Sequence
  Synthetic construct
GMGHGDF

SEQ ID NO: 9011 - protein, 7 aa, Artificial Sequence
  Synthetic construct
GMGHGDY

SEQ ID NO: 9012 - protein, 7 aa, Artificial Sequence
  Synthetic construct
GMGHGVF

SEQ ID NO: 9013 - protein, 7 aa, Artificial Sequence
  Synthetic construct
GMGHGVY

SEQ ID NO: 9014 - protein, 7 aa, Artificial Sequence
  Synthetic construct
GMGHAFF

SEQ ID NO: 9015 - protein, 7 aa, Artificial Sequence
  Synthetic construct
GMGHAFY

SEQ ID NO: 9016 - protein, 7 aa, Artificial Sequence
  Synthetic construct
GMGHARF

SEQ ID NO: 9017 - protein, 7 aa, Artificial Sequence
  Synthetic construct
GMGHARY

SEQ ID NO: 9018 - protein, 7 aa, Artificial Sequence
  Synthetic construct
GMGHACF

SEQ ID NO: 9019 - protein, 7 aa, Artificial Sequence
  Synthetic construct
GMGHACY

SEQ ID NO: 9020 - protein, 7 aa, Artificial Sequence
  Synthetic construct
GMGHALF

SEQ ID NO: 9021 - protein, 7 aa, Artificial Sequence
  Synthetic construct
GMGHALY

SEQ ID NO: 9022 - protein, 7 aa, Artificial Sequence
  Synthetic construct
GMGHAAF

SEQ ID NO: 9023 - protein, 7 aa, Artificial Sequence
  Synthetic construct
GMGHAAY

SEQ ID NO: 9024 - protein, 7 aa, Artificial Sequence
  Synthetic construct
GMGHAQF

SEQ ID NO: 9025 - protein, 7 aa, Artificial Sequence
  Synthetic construct
GMGHAQY

SEQ ID NO: 9026 - protein, 7 aa, Artificial Sequence
  Synthetic construct
GMGHADF

SEQ ID NO: 9027 - protein, 7 aa, Artificial Sequence
  Synthetic construct
GMGHADY

SEQ ID NO: 9028 - protein, 7 aa, Artificial Sequence
  Synthetic construct
GMGHAVF

SEQ ID NO: 9029 - protein, 7 aa, Artificial Sequence
  Synthetic construct
GMGHAVY

SEQ ID NO: 9030 - protein, 7 aa, Artificial Sequence
  Synthetic construct
GMGHQFF

SEQ ID NO: 9031 - protein, 7 aa, Artificial Sequence
  Synthetic construct
GMGHQFY

SEQ ID NO: 9032 - protein, 7 aa, Artificial Sequence
  Synthetic construct
GMGHQRF

SEQ ID NO: 9033 - protein, 7 aa, Artificial Sequence
  Synthetic construct
GMGHQRY

SEQ ID NO: 9034 - protein, 7 aa, Artificial Sequence
  Synthetic construct
GMGHQCF

SEQ ID NO: 9035 - protein, 7 aa, Artificial Sequence
  Synthetic construct
GMGHQCY

SEQ ID NO: 9036 - protein, 7 aa, Artificial Sequence
  Synthetic construct
GMGHQLF

SEQ ID NO: 9037 - protein, 7 aa, Artificial Sequence
  Synthetic construct
GMGHQLY

SEQ ID NO: 9038 - protein, 7 aa, Artificial Sequence
  Synthetic construct
GMGHQAF

SEQ ID NO: 9039 - protein, 7 aa, Artificial Sequence
  Synthetic construct
GMGHQAY

SEQ ID NO: 9040 - protein, 7 aa, Artificial Sequence
  Synthetic construct
GMGHQQF

SEQ ID NO: 9041 - protein, 7 aa, Artificial Sequence
  Synthetic construct
GMGHQQY

SEQ ID NO: 9042 - protein, 7 aa, Artificial Sequence
  Synthetic construct
GMGHQDF

SEQ ID NO: 9043 - protein, 7 aa, Artificial Sequence
  Synthetic construct
GMGHQDY

SEQ ID NO: 9044 - protein, 7 aa, Artificial Sequence
  Synthetic construct
GMGHQVF

SEQ ID NO: 9045 - protein, 7 aa, Artificial Sequence
  Synthetic construct
GMGHQVY

SEQ ID NO: 9046 - protein, 7 aa, Artificial Sequence
  Synthetic construct
GMGLIFF

SEQ ID NO: 9047 - protein, 7 aa, Artificial Sequence
  Synthetic construct
GMGLIFY

SEQ ID NO: 9048 - protein, 7 aa, Artificial Sequence
  Synthetic construct
GMGLIRF

SEQ ID NO: 9049 - protein, 7 aa, Artificial Sequence
  Synthetic construct
GMGLIRY

SEQ ID NO: 9050 - protein, 7 aa, Artificial Sequence
  Synthetic construct
GMGLICF

SEQ ID NO: 9051 - protein, 7 aa, Artificial Sequence
  Synthetic construct
GMGLICY

SEQ ID NO: 9052 - protein, 7 aa, Artificial Sequence
  Synthetic construct
GMGLILF

SEQ ID NO: 9053 - protein, 7 aa, Artificial Sequence
  Synthetic construct
GMGLILY

SEQ ID NO: 9054 - protein, 7 aa, Artificial Sequence
  Synthetic construct
GMGLIAF

SEQ ID NO: 9055 - protein, 7 aa, Artificial Sequence
  Synthetic construct
GMGLIAY

SEQ ID NO: 9056 - protein, 7 aa, Artificial Sequence
  Synthetic construct
GMGLIQF

SEQ ID NO: 9057 - protein, 7 aa, Artificial Sequence
  Synthetic construct
GMGLIQY

SEQ ID NO: 9058 - protein, 7 aa, Artificial Sequence
  Synthetic construct
GMGLIDF

SEQ ID NO: 9059 - protein, 7 aa, Artificial Sequence
  Synthetic construct
GMGLIDY

SEQ ID NO: 9060 - protein, 7 aa, Artificial Sequence
  Synthetic construct
GMGLIVF

SEQ ID NO: 9061 - protein, 7 aa, Artificial Sequence
  Synthetic construct
GMGLIVY

SEQ ID NO: 9062 - protein, 7 aa, Artificial Sequence
  Synthetic construct
GMGLDFF

SEQ ID NO: 9063 - protein, 7 aa, Artificial Sequence
  Synthetic construct
GMGLDFY

SEQ ID NO: 9064 - protein, 7 aa, Artificial Sequence
  Synthetic construct
GMGLDRF

SEQ ID NO: 9065 - protein, 7 aa, Artificial Sequence
  Synthetic construct
GMGLDRY

SEQ ID NO: 9066 - protein, 7 aa, Artificial Sequence
  Synthetic construct
GMGLDCF

SEQ ID NO: 9067 - protein, 7 aa, Artificial Sequence
  Synthetic construct
GMGLDCY

SEQ ID NO: 9068 - protein, 7 aa, Artificial Sequence
  Synthetic construct
GMGLDLF

SEQ ID NO: 9069 - protein, 7 aa, Artificial Sequence
  Synthetic construct
GMGLDLY

SEQ ID NO: 9070 - protein, 7 aa, Artificial Sequence
  Synthetic construct
GMGLDAF

SEQ ID NO: 9071 - protein, 7 aa, Artificial Sequence
  Synthetic construct
GMGLDAY

SEQ ID NO: 9072 - protein, 7 aa, Artificial Sequence
  Synthetic construct
GMGLDQF

SEQ ID NO: 9073 - protein, 7 aa, Artificial Sequence
  Synthetic construct
GMGLDQY

SEQ ID NO: 9074 - protein, 7 aa, Artificial Sequence
  Synthetic construct
GMGLDDF

SEQ ID NO: 9075 - protein, 7 aa, Artificial Sequence
  Synthetic construct
GMGLDDY

SEQ ID NO: 9076 - protein, 7 aa, Artificial Sequence
  Synthetic construct
GMGLDVF

SEQ ID NO: 9077 - protein, 7 aa, Artificial Sequence
  Synthetic construct
GMGLDVY

SEQ ID NO: 9078 - protein, 7 aa, Artificial Sequence
  Synthetic construct
GMGLYFF

SEQ ID NO: 9079 - protein, 7 aa, Artificial Sequence
  Synthetic construct
GMGLYFY

SEQ ID NO: 9080 - protein, 7 aa, Artificial Sequence
  Synthetic construct
GMGLYRF

SEQ ID NO: 9081 - protein, 7 aa, Artificial Sequence
  Synthetic construct
GMGLYRY

SEQ ID NO: 9082 - protein, 7 aa, Artificial Sequence
  Synthetic construct
GMGLYCF

SEQ ID NO: 9083 - protein, 7 aa, Artificial Sequence
  Synthetic construct
GMGLYCY

SEQ ID NO: 9084 - protein, 7 aa, Artificial Sequence
  Synthetic construct
GMGLYLF

SEQ ID NO: 9085 - protein, 7 aa, Artificial Sequence
  Synthetic construct
GMGLYLY

SEQ ID NO: 9086 - protein, 7 aa, Artificial Sequence
  Synthetic construct
GMGLYAF

SEQ ID NO: 9087 - protein, 7 aa, Artificial Sequence
  Synthetic construct
GMGLYAY

SEQ ID NO: 9088 - protein, 7 aa, Artificial Sequence
  Synthetic construct
GMGLYQF

SEQ ID NO: 9089 - protein, 7 aa, Artificial Sequence
  Synthetic construct
GMGLYQY

SEQ ID NO: 9090 - protein, 7 aa, Artificial Sequence
  Synthetic construct
GMGLYDF

SEQ ID NO: 9091 - protein, 7 aa, Artificial Sequence
  Synthetic construct
GMGLYDY

SEQ ID NO: 9092 - protein, 7 aa, Artificial Sequence
  Synthetic construct
GMGLYVF

SEQ ID NO: 9093 - protein, 7 aa, Artificial Sequence
  Synthetic construct
GMGLYVY

SEQ ID NO: 9094 - protein, 7 aa, Artificial Sequence
  Synthetic construct
GMGLFFF

SEQ ID NO: 9095 - protein, 7 aa, Artificial Sequence
  Synthetic construct
GMGLFFY

SEQ ID NO: 9096 - protein, 7 aa, Artificial Sequence
  Synthetic construct
GMGLFRF

SEQ ID NO: 9097 - protein, 7 aa, Artificial Sequence
  Synthetic construct
GMGLFRY

SEQ ID NO: 9098 - protein, 7 aa, Artificial Sequence
  Synthetic construct
GMGLFCF

SEQ ID NO: 9099 - protein, 7 aa, Artificial Sequence
  Synthetic construct
GMGLFCY

SEQ ID NO: 9100 - protein, 7 aa, Artificial Sequence
  Synthetic construct
GMGLFLF

SEQ ID NO: 9101 - protein, 7 aa, Artificial Sequence
  Synthetic construct
GMGLFLY

SEQ ID NO: 9102 - protein, 7 aa, Artificial Sequence
  Synthetic construct
GMGLFAF

SEQ ID NO: 9103 - protein, 7 aa, Artificial Sequence
  Synthetic construct
GMGLFAY

SEQ ID NO: 9104 - protein, 7 aa, Artificial Sequence
  Synthetic construct
GMGLFQF

SEQ ID NO: 9105 - protein, 7 aa, Artificial Sequence
  Synthetic construct
GMGLFQY

SEQ ID NO: 9106 - protein, 7 aa, Artificial Sequence
  Synthetic construct
GMGLFDF

SEQ ID NO: 9107 - protein, 7 aa, Artificial Sequence
  Synthetic construct
GMGLFDY

SEQ ID NO: 9108 - protein, 7 aa, Artificial Sequence
  Synthetic construct
GMGLFVF

SEQ ID NO: 9109 - protein, 7 aa, Artificial Sequence
  Synthetic construct
GMGLFVY

SEQ ID NO: 9110 - protein, 7 aa, Artificial Sequence
  Synthetic construct
GMGLVFF

SEQ ID NO: 9111 - protein, 7 aa, Artificial Sequence
  Synthetic construct
GMGLVFY

SEQ ID NO: 9112 - protein, 7 aa, Artificial Sequence
  Synthetic construct
GMGLVRF

SEQ ID NO: 9113 - protein, 7 aa, Artificial Sequence
  Synthetic construct
GMGLVRY

SEQ ID NO: 9114 - protein, 7 aa, Artificial Sequence
  Synthetic construct
GMGLVCF

SEQ ID NO: 9115 - protein, 7 aa, Artificial Sequence
  Synthetic construct
GMGLVCY

SEQ ID NO: 9116 - protein, 7 aa, Artificial Sequence
  Synthetic construct
GMGLVLF

SEQ ID NO: 9117 - protein, 7 aa, Artificial Sequence
  Synthetic construct
GMGLVLY

SEQ ID NO: 9118 - protein, 7 aa, Artificial Sequence
  Synthetic construct
GMGLVAF

SEQ ID NO: 9119 - protein, 7 aa, Artificial Sequence
  Synthetic construct
GMGLVAY

SEQ ID NO: 9120 - protein, 7 aa, Artificial Sequence
  Synthetic construct
GMGLVQF

SEQ ID NO: 9121 - protein, 7 aa, Artificial Sequence
  Synthetic construct
GMGLVQY

SEQ ID NO: 9122 - protein, 7 aa, Artificial Sequence
  Synthetic construct
GMGLVDF

SEQ ID NO: 9123 - protein, 7 aa, Artificial Sequence
  Synthetic construct
GMGLVDY

SEQ ID NO: 9124 - protein, 7 aa, Artificial Sequence
  Synthetic construct
GMGLVVF

SEQ ID NO: 9125 - protein, 7 aa, Artificial Sequence
  Synthetic construct
GMGLVVY

SEQ ID NO: 9126 - protein, 7 aa, Artificial Sequence
  Synthetic construct
GMGLTFF

SEQ ID NO: 9127 - protein, 7 aa, Artificial Sequence
  Synthetic construct
GMGLTFY

SEQ ID NO: 9128 - protein, 7 aa, Artificial Sequence
  Synthetic construct
GMGLTRF

SEQ ID NO: 9129 - protein, 7 aa, Artificial Sequence
  Synthetic construct
GMGLTRY

SEQ ID NO: 9130 - protein, 7 aa, Artificial Sequence
  Synthetic construct
GMGLTCF

SEQ ID NO: 9131 - protein, 7 aa, Artificial Sequence
  Synthetic construct
GMGLTCY

SEQ ID NO: 9132 - protein, 7 aa, Artificial Sequence
  Synthetic construct
GMGLTLF

SEQ ID NO: 9133 - protein, 7 aa, Artificial Sequence
  Synthetic construct
GMGLTLY

SEQ ID NO: 9134 - protein, 7 aa, Artificial Sequence
  Synthetic construct
GMGLTAF

SEQ ID NO: 9135 - protein, 7 aa, Artificial Sequence
  Synthetic construct
GMGLTAY

SEQ ID NO: 9136 - protein, 7 aa, Artificial Sequence
  Synthetic construct
GMGLTQF

SEQ ID NO: 9137 - protein, 7 aa, Artificial Sequence
  Synthetic construct
GMGLTQY

SEQ ID NO: 9138 - protein, 7 aa, Artificial Sequence
  Synthetic construct
GMGLTDF

SEQ ID NO: 9139 - protein, 7 aa, Artificial Sequence
  Synthetic construct
GMGLTDY

SEQ ID NO: 9140 - protein, 7 aa, Artificial Sequence
  Synthetic construct
GMGLTVF

SEQ ID NO: 9141 - protein, 7 aa, Artificial Sequence
  Synthetic construct
GMGLTVY

SEQ ID NO: 9142 - protein, 7 aa, Artificial Sequence
  Synthetic construct
GMGLGFF

SEQ ID NO: 9143 - protein, 7 aa, Artificial Sequence
  Synthetic construct
GMGLGFY

SEQ ID NO: 9144 - protein, 7 aa, Artificial Sequence
  Synthetic construct
GMGLGRF

SEQ ID NO: 9145 - protein, 7 aa, Artificial Sequence
  Synthetic construct
GMGLGRY

SEQ ID NO: 9146 - protein, 7 aa, Artificial Sequence
  Synthetic construct
GMGLGCF

SEQ ID NO: 9147 - protein, 7 aa, Artificial Sequence
  Synthetic construct
GMGLGCY

SEQ ID NO: 9148 - protein, 7 aa, Artificial Sequence
  Synthetic construct
GMGLGLF

SEQ ID NO: 9149 - protein, 7 aa, Artificial Sequence
  Synthetic construct
GMGLGLY

SEQ ID NO: 9150 - protein, 7 aa, Artificial Sequence
  Synthetic construct
GMGLGAF

SEQ ID NO: 9151 - protein, 7 aa, Artificial Sequence
  Synthetic construct
GMGLGAY

SEQ ID NO: 9152 - protein, 7 aa, Artificial Sequence
  Synthetic construct
GMGLGQF

SEQ ID NO: 9153 - protein, 7 aa, Artificial Sequence
  Synthetic construct
GMGLGQY

SEQ ID NO: 9154 - protein, 7 aa, Artificial Sequence
  Synthetic construct
GMGLGDF

SEQ ID NO: 9155 - protein, 7 aa, Artificial Sequence
  Synthetic construct
GMGLGDY

SEQ ID NO: 9156 - protein, 7 aa, Artificial Sequence
  Synthetic construct
GMGLGVF

SEQ ID NO: 9157 - protein, 7 aa, Artificial Sequence
  Synthetic construct
GMGLGVY

SEQ ID NO: 9158 - protein, 7 aa, Artificial Sequence
  Synthetic construct
GMGLAFF

SEQ ID NO: 9159 - protein, 7 aa, Artificial Sequence
  Synthetic construct
GMGLAFY

SEQ ID NO: 9160 - protein, 7 aa, Artificial Sequence
  Synthetic construct
GMGLARF

SEQ ID NO: 9161 - protein, 7 aa, Artificial Sequence
  Synthetic construct
GMGLARY

SEQ ID NO: 9162 - protein, 7 aa, Artificial Sequence
  Synthetic construct
GMGLACF

SEQ ID NO: 9163 - protein, 7 aa, Artificial Sequence
  Synthetic construct
GMGLACY

SEQ ID NO: 9164 - protein, 7 aa, Artificial Sequence
  Synthetic construct
GMGLALF

SEQ ID NO: 9165 - protein, 7 aa, Artificial Sequence
  Synthetic construct
GMGLALY

SEQ ID NO: 9166 - protein, 7 aa, Artificial Sequence
  Synthetic construct
GMGLAAF

SEQ ID NO: 9167 - protein, 7 aa, Artificial Sequence
  Synthetic construct
GMGLAAY

SEQ ID NO: 9168 - protein, 7 aa, Artificial Sequence
  Synthetic construct
GMGLAQF

SEQ ID NO: 9169 - protein, 7 aa, Artificial Sequence
  Synthetic construct
GMGLAQY

SEQ ID NO: 9170 - protein, 7 aa, Artificial Sequence
  Synthetic construct
GMGLADF

SEQ ID NO: 9171 - protein, 7 aa, Artificial Sequence
  Synthetic construct
GMGLADY

SEQ ID NO: 9172 - protein, 7 aa, Artificial Sequence
  Synthetic construct
GMGLAVF

SEQ ID NO: 9173 - protein, 7 aa, Artificial Sequence
  Synthetic construct
GMGLAVY

SEQ ID NO: 9174 - protein, 7 aa, Artificial Sequence
  Synthetic construct
GMGLQFF

SEQ ID NO: 9175 - protein, 7 aa, Artificial Sequence
  Synthetic construct
GMGLQFY

SEQ ID NO: 9176 - protein, 7 aa, Artificial Sequence
  Synthetic construct
GMGLQRF

SEQ ID NO: 9177 - protein, 7 aa, Artificial Sequence
  Synthetic construct
GMGLQRY

SEQ ID NO: 9178 - protein, 7 aa, Artificial Sequence
  Synthetic construct
GMGLQCF

SEQ ID NO: 9179 - protein, 7 aa, Artificial Sequence
  Synthetic construct
GMGLQCY

SEQ ID NO: 9180 - protein, 7 aa, Artificial Sequence
  Synthetic construct
GMGLQLF

SEQ ID NO: 9181 - protein, 7 aa, Artificial Sequence
  Synthetic construct
GMGLQLY

SEQ ID NO: 9182 - protein, 7 aa, Artificial Sequence
  Synthetic construct
GMGLQAF

SEQ ID NO: 9183 - protein, 7 aa, Artificial Sequence
  Synthetic construct
GMGLQAY

SEQ ID NO: 9184 - protein, 7 aa, Artificial Sequence
  Synthetic construct
GMGLQQF

SEQ ID NO: 9185 - protein, 7 aa, Artificial Sequence
  Synthetic construct
GMGLQQY

SEQ ID NO: 9186 - protein, 7 aa, Artificial Sequence
  Synthetic construct
GMGLQDF

SEQ ID NO: 9187 - protein, 7 aa, Artificial Sequence
  Synthetic construct
GMGLQDY

SEQ ID NO: 9188 - protein, 7 aa, Artificial Sequence
  Synthetic construct
GMGLQVF

SEQ ID NO: 9189 - protein, 7 aa, Artificial Sequence
  Synthetic construct
GMGLQVY

SEQ ID NO: 9190 - protein, 7 aa, Artificial Sequence
  Synthetic construct
GMGFIFF

SEQ ID NO: 9191 - protein, 7 aa, Artificial Sequence
  Synthetic construct
GMGFIFY

SEQ ID NO: 9192 - protein, 7 aa, Artificial Sequence
  Synthetic construct
GMGFIRF

SEQ ID NO: 9193 - protein, 7 aa, Artificial Sequence
  Synthetic construct
GMGFIRY

SEQ ID NO: 9194 - protein, 7 aa, Artificial Sequence
  Synthetic construct
GMGFICF

SEQ ID NO: 9195 - protein, 7 aa, Artificial Sequence
  Synthetic construct
GMGFICY

SEQ ID NO: 9196 - protein, 7 aa, Artificial Sequence
  Synthetic construct
GMGFILF

SEQ ID NO: 9197 - protein, 7 aa, Artificial Sequence
  Synthetic construct
GMGFILY

SEQ ID NO: 9198 - protein, 7 aa, Artificial Sequence
  Synthetic construct
GMGFIAF

SEQ ID NO: 9199 - protein, 7 aa, Artificial Sequence
  Synthetic construct
GMGFIAY

SEQ ID NO: 9200 - protein, 7 aa, Artificial Sequence
  Synthetic construct
GMGFIQF

SEQ ID NO: 9201 - protein, 7 aa, Artificial Sequence
  Synthetic construct
GMGFIQY

SEQ ID NO: 9202 - protein, 7 aa, Artificial Sequence
  Synthetic construct
GMGFIDF

SEQ ID NO: 9203 - protein, 7 aa, Artificial Sequence
  Synthetic construct
GMGFIDY

SEQ ID NO: 9204 - protein, 7 aa, Artificial Sequence
  Synthetic construct
GMGFIVF

SEQ ID NO: 9205 - protein, 7 aa, Artificial Sequence
  Synthetic construct
GMGFIVY

SEQ ID NO: 9206 - protein, 7 aa, Artificial Sequence
  Synthetic construct
GMGFDFF

SEQ ID NO: 9207 - protein, 7 aa, Artificial Sequence
  Synthetic construct
GMGFDFY

SEQ ID NO: 9208 - protein, 7 aa, Artificial Sequence
  Synthetic construct
GMGFDRF

SEQ ID NO: 9209 - protein, 7 aa, Artificial Sequence
  Synthetic construct
GMGFDRY

SEQ ID NO: 9210 - protein, 7 aa, Artificial Sequence
  Synthetic construct
GMGFDCF

SEQ ID NO: 9211 - protein, 7 aa, Artificial Sequence
  Synthetic construct
GMGFDCY

SEQ ID NO: 9212 - protein, 7 aa, Artificial Sequence
  Synthetic construct
GMGFDLF

SEQ ID NO: 9213 - protein, 7 aa, Artificial Sequence
  Synthetic construct
GMGFDLY

SEQ ID NO: 9214 - protein, 7 aa, Artificial Sequence
  Synthetic construct
GMGFDAF

SEQ ID NO: 9215 - protein, 7 aa, Artificial Sequence
  Synthetic construct
GMGFDAY

SEQ ID NO: 9216 - protein, 7 aa, Artificial Sequence
  Synthetic construct
GMGFDQF

SEQ ID NO: 9217 - protein, 7 aa, Artificial Sequence
  Synthetic construct
GMGFDQY

SEQ ID NO: 9218 - protein, 7 aa, Artificial Sequence
  Synthetic construct
GMGFDDF

SEQ ID NO: 9219 - protein, 7 aa, Artificial Sequence
  Synthetic construct
GMGFDDY

SEQ ID NO: 9220 - protein, 7 aa, Artificial Sequence
  Synthetic construct
GMGFDVF

SEQ ID NO: 9221 - protein, 7 aa, Artificial Sequence
  Synthetic construct
GMGFDVY

SEQ ID NO: 9222 - protein, 7 aa, Artificial Sequence
  Synthetic construct
GMGFYFF

SEQ ID NO: 9223 - protein, 7 aa, Artificial Sequence
  Synthetic construct
GMGFYFY

SEQ ID NO: 9224 - protein, 7 aa, Artificial Sequence
  Synthetic construct
GMGFYRF

SEQ ID NO: 9225 - protein, 7 aa, Artificial Sequence
  Synthetic construct
GMGFYRY

SEQ ID NO: 9226 - protein, 7 aa, Artificial Sequence
  Synthetic construct
GMGFYCF

SEQ ID NO: 9227 - protein, 7 aa, Artificial Sequence
  Synthetic construct
GMGFYCY

SEQ ID NO: 9228 - protein, 7 aa, Artificial Sequence
  Synthetic construct
GMGFYLF

SEQ ID NO: 9229 - protein, 7 aa, Artificial Sequence
  Synthetic construct
GMGFYLY

SEQ ID NO: 9230 - protein, 7 aa, Artificial Sequence
  Synthetic construct
GMGFYAF

SEQ ID NO: 9231 - protein, 7 aa, Artificial Sequence
  Synthetic construct
GMGFYAY

SEQ ID NO: 9232 - protein, 7 aa, Artificial Sequence
  Synthetic construct
GMGFYQF

SEQ ID NO: 9233 - protein, 7 aa, Artificial Sequence
  Synthetic construct
GMGFYQY

SEQ ID NO: 9234 - protein, 7 aa, Artificial Sequence
  Synthetic construct
GMGFYDF

SEQ ID NO: 9235 - protein, 7 aa, Artificial Sequence
  Synthetic construct
GMGFYDY

SEQ ID NO: 9236 - protein, 7 aa, Artificial Sequence
  Synthetic construct
GMGFYVF

SEQ ID NO: 9237 - protein, 7 aa, Artificial Sequence
  Synthetic construct
GMGFYVY

SEQ ID NO: 9238 - protein, 7 aa, Artificial Sequence
  Synthetic construct
GMGFFFF

SEQ ID NO: 9239 - protein, 7 aa, Artificial Sequence
  Synthetic construct
GMGFFFY

SEQ ID NO: 9240 - protein, 7 aa, Artificial Sequence
  Synthetic construct
GMGFFRF

SEQ ID NO: 9241 - protein, 7 aa, Artificial Sequence
  Synthetic construct
GMGFFRY

SEQ ID NO: 9242 - protein, 7 aa, Artificial Sequence
  Synthetic construct
GMGFFCF

SEQ ID NO: 9243 - protein, 7 aa, Artificial Sequence
  Synthetic construct
GMGFFCY

SEQ ID NO: 9244 - protein, 7 aa, Artificial Sequence
  Synthetic construct
GMGFFLF

SEQ ID NO: 9245 - protein, 7 aa, Artificial Sequence
  Synthetic construct
GMGFFLY

SEQ ID NO: 9246 - protein, 7 aa, Artificial Sequence
  Synthetic construct
GMGFFAF

SEQ ID NO: 9247 - protein, 7 aa, Artificial Sequence
  Synthetic construct
GMGFFAY

SEQ ID NO: 9248 - protein, 7 aa, Artificial Sequence
  Synthetic construct
GMGFFQF

SEQ ID NO: 9249 - protein, 7 aa, Artificial Sequence
  Synthetic construct
GMGFFQY

SEQ ID NO: 9250 - protein, 7 aa, Artificial Sequence
  Synthetic construct
GMGFFDF

SEQ ID NO: 9251 - protein, 7 aa, Artificial Sequence
  Synthetic construct
GMGFFDY

SEQ ID NO: 9252 - protein, 7 aa, Artificial Sequence
  Synthetic construct
GMGFFVF

SEQ ID NO: 9253 - protein, 7 aa, Artificial Sequence
  Synthetic construct
GMGFFVY

SEQ ID NO: 9254 - protein, 7 aa, Artificial Sequence
  Synthetic construct
GMGFVFF

SEQ ID NO: 9255 - protein, 7 aa, Artificial Sequence
  Synthetic construct
GMGFVFY

SEQ ID NO: 9256 - protein, 7 aa, Artificial Sequence
  Synthetic construct
GMGFVRF

SEQ ID NO: 9257 - protein, 7 aa, Artificial Sequence
  Synthetic construct
GMGFVRY

SEQ ID NO: 9258 - protein, 7 aa, Artificial Sequence
  Synthetic construct
GMGFVCF

SEQ ID NO: 9259 - protein, 7 aa, Artificial Sequence
  Synthetic construct
GMGFVCY

SEQ ID NO: 9260 - protein, 7 aa, Artificial Sequence
  Synthetic construct
GMGFVLF

SEQ ID NO: 9261 - protein, 7 aa, Artificial Sequence
  Synthetic construct
GMGFVLY

SEQ ID NO: 9262 - protein, 7 aa, Artificial Sequence
  Synthetic construct
GMGFVAF

SEQ ID NO: 9263 - protein, 7 aa, Artificial Sequence
  Synthetic construct
GMGFVAY

SEQ ID NO: 9264 - protein, 7 aa, Artificial Sequence
  Synthetic construct
GMGFVQF

SEQ ID NO: 9265 - protein, 7 aa, Artificial Sequence
  Synthetic construct
GMGFVQY

SEQ ID NO: 9266 - protein, 7 aa, Artificial Sequence
  Synthetic construct
GMGFVDF

SEQ ID NO: 9267 - protein, 7 aa, Artificial Sequence
  Synthetic construct
GMGFVDY

SEQ ID NO: 9268 - protein, 7 aa, Artificial Sequence
  Synthetic construct
GMGFVVF

SEQ ID NO: 9269 - protein, 7 aa, Artificial Sequence
  Synthetic construct
GMGFVVY

SEQ ID NO: 9270 - protein, 7 aa, Artificial Sequence
  Synthetic construct
GMGFTFF

SEQ ID NO: 9271 - protein, 7 aa, Artificial Sequence
  Synthetic construct
GMGFTFY

SEQ ID NO: 9272 - protein, 7 aa, Artificial Sequence
  Synthetic construct
GMGFTRF

SEQ ID NO: 9273 - protein, 7 aa, Artificial Sequence
  Synthetic construct
GMGFTRY

SEQ ID NO: 9274 - protein, 7 aa, Artificial Sequence
  Synthetic construct
GMGFTCF

SEQ ID NO: 9275 - protein, 7 aa, Artificial Sequence
  Synthetic construct
GMGFTCY

SEQ ID NO: 9276 - protein, 7 aa, Artificial Sequence
  Synthetic construct
GMGFTLF

SEQ ID NO: 9277 - protein, 7 aa, Artificial Sequence
  Synthetic construct
GMGFTLY

SEQ ID NO: 9278 - protein, 7 aa, Artificial Sequence
  Synthetic construct
GMGFTAF

SEQ ID NO: 9279 - protein, 7 aa, Artificial Sequence
  Synthetic construct
GMGFTAY

SEQ ID NO: 9280 - protein, 7 aa, Artificial Sequence
  Synthetic construct
GMGFTQF

SEQ ID NO: 9281 - protein, 7 aa, Artificial Sequence
  Synthetic construct
GMGFTQY

SEQ ID NO: 9282 - protein, 7 aa, Artificial Sequence
  Synthetic construct
GMGFTDF

SEQ ID NO: 9283 - protein, 7 aa, Artificial Sequence
  Synthetic construct
GMGFTDY

SEQ ID NO: 9284 - protein, 7 aa, Artificial Sequence
  Synthetic construct
GMGFTVF

SEQ ID NO: 9285 - protein, 7 aa, Artificial Sequence
  Synthetic construct
GMGFTVY

SEQ ID NO: 9286 - protein, 7 aa, Artificial Sequence
  Synthetic construct
GMGFGFF

SEQ ID NO: 9287 - protein, 7 aa, Artificial Sequence
  Synthetic construct
GMGFGFY

SEQ ID NO: 9288 - protein, 7 aa, Artificial Sequence
  Synthetic construct
GMGFGRF

SEQ ID NO: 9289 - protein, 7 aa, Artificial Sequence
  Synthetic construct
GMGFGRY

SEQ ID NO: 9290 - protein, 7 aa, Artificial Sequence
  Synthetic construct
GMGFGCF

SEQ ID NO: 9291 - protein, 7 aa, Artificial Sequence
  Synthetic construct
GMGFGCY

SEQ ID NO: 9292 - protein, 7 aa, Artificial Sequence
  Synthetic construct
GMGFGLF

SEQ ID NO: 9293 - protein, 7 aa, Artificial Sequence
  Synthetic construct
GMGFGLY

SEQ ID NO: 9294 - protein, 7 aa, Artificial Sequence
  Synthetic construct
GMGFGAF

SEQ ID NO: 9295 - protein, 7 aa, Artificial Sequence
  Synthetic construct
GMGFGAY

SEQ ID NO: 9296 - protein, 7 aa, Artificial Sequence
  Synthetic construct
GMGFGQF

SEQ ID NO: 9297 - protein, 7 aa, Artificial Sequence
  Synthetic construct
GMGFGQY

SEQ ID NO: 9298 - protein, 7 aa, Artificial Sequence
  Synthetic construct
GMGFGDF

SEQ ID NO: 9299 - protein, 7 aa, Artificial Sequence
  Synthetic construct
GMGFGDY

SEQ ID NO: 9300 - protein, 7 aa, Artificial Sequence
  Synthetic construct
GMGFGVF

SEQ ID NO: 9301 - protein, 7 aa, Artificial Sequence
  Synthetic construct
GMGFGVY

SEQ ID NO: 9302 - protein, 7 aa, Artificial Sequence
  Synthetic construct
GMGFAFF

SEQ ID NO: 9303 - protein, 7 aa, Artificial Sequence
  Synthetic construct
GMGFAFY

SEQ ID NO: 9304 - protein, 7 aa, Artificial Sequence
  Synthetic construct
GMGFARF

SEQ ID NO: 9305 - protein, 7 aa, Artificial Sequence
  Synthetic construct
GMGFARY

SEQ ID NO: 9306 - protein, 7 aa, Artificial Sequence
  Synthetic construct
GMGFACF

SEQ ID NO: 9307 - protein, 7 aa, Artificial Sequence
  Synthetic construct
GMGFACY

SEQ ID NO: 9308 - protein, 7 aa, Artificial Sequence
  Synthetic construct
GMGFALF

SEQ ID NO: 9309 - protein, 7 aa, Artificial Sequence
  Synthetic construct
GMGFALY

SEQ ID NO: 9310 - protein, 7 aa, Artificial Sequence
  Synthetic construct
GMGFAAF

SEQ ID NO: 9311 - protein, 7 aa, Artificial Sequence
  Synthetic construct
GMGFAAY

SEQ ID NO: 9312 - protein, 7 aa, Artificial Sequence
  Synthetic construct
GMGFAQF

SEQ ID NO: 9313 - protein, 7 aa, Artificial Sequence
  Synthetic construct
GMGFAQY

SEQ ID NO: 9314 - protein, 7 aa, Artificial Sequence
  Synthetic construct
GMGFADF

SEQ ID NO: 9315 - protein, 7 aa, Artificial Sequence
  Synthetic construct
GMGFADY

SEQ ID NO: 9316 - protein, 7 aa, Artificial Sequence
  Synthetic construct
GMGFAVF

SEQ ID NO: 9317 - protein, 7 aa, Artificial Sequence
  Synthetic construct
GMGFAVY

SEQ ID NO: 9318 - protein, 7 aa, Artificial Sequence
  Synthetic construct
GMGFQFF

SEQ ID NO: 9319 - protein, 7 aa, Artificial Sequence
  Synthetic construct
GMGFQFY

SEQ ID NO: 9320 - protein, 7 aa, Artificial Sequence
  Synthetic construct
GMGFQRF

SEQ ID NO: 9321 - protein, 7 aa, Artificial Sequence
  Synthetic construct
GMGFQRY

SEQ ID NO: 9322 - protein, 7 aa, Artificial Sequence
  Synthetic construct
GMGFQCF

SEQ ID NO: 9323 - protein, 7 aa, Artificial Sequence
  Synthetic construct
GMGFQCY

SEQ ID NO: 9324 - protein, 7 aa, Artificial Sequence
  Synthetic construct
GMGFQLF

SEQ ID NO: 9325 - protein, 7 aa, Artificial Sequence
  Synthetic construct
GMGFQLY

SEQ ID NO: 9326 - protein, 7 aa, Artificial Sequence
  Synthetic construct
GMGFQAF

SEQ ID NO: 9327 - protein, 7 aa, Artificial Sequence
  Synthetic construct
GMGFQAY

SEQ ID NO: 9328 - protein, 7 aa, Artificial Sequence
  Synthetic construct
GMGFQQF

SEQ ID NO: 9329 - protein, 7 aa, Artificial Sequence
  Synthetic construct
GMGFQQY

SEQ ID NO: 9330 - protein, 7 aa, Artificial Sequence
  Synthetic construct
GMGFQDF

SEQ ID NO: 9331 - protein, 7 aa, Artificial Sequence
  Synthetic construct
GMGFQDY

SEQ ID NO: 9332 - protein, 7 aa, Artificial Sequence
  Synthetic construct
GMGFQVF

SEQ ID NO: 9333 - protein, 7 aa, Artificial Sequence
  Synthetic construct
GMGFQVY

SEQ ID NO: 9334 - protein, 7 aa, Artificial Sequence
  Synthetic construct
GSIYIFF

SEQ ID NO: 9335 - protein, 7 aa, Artificial Sequence
  Synthetic construct
GSIYIFY

SEQ ID NO: 9336 - protein, 7 aa, Artificial Sequence
  Synthetic construct
GSIYIRF

SEQ ID NO: 9337 - protein, 7 aa, Artificial Sequence
  Synthetic construct
GSIYIRY

SEQ ID NO: 9338 - protein, 7 aa, Artificial Sequence
  Synthetic construct
GSIYICF

SEQ ID NO: 9339 - protein, 7 aa, Artificial Sequence
  Synthetic construct
GSIYICY

SEQ ID NO: 9340 - protein, 7 aa, Artificial Sequence
  Synthetic construct
GSIYILF

SEQ ID NO: 9341 - protein, 7 aa, Artificial Sequence
  Synthetic construct
GSIYILY

SEQ ID NO: 9342 - protein, 7 aa, Artificial Sequence
  Synthetic construct
GSIYIAF

SEQ ID NO: 9343 - protein, 7 aa, Artificial Sequence
  Synthetic construct
GSIYIAY

SEQ ID NO: 9344 - protein, 7 aa, Artificial Sequence
  Synthetic construct
GSIYIQF

SEQ ID NO: 9345 - protein, 7 aa, Artificial Sequence
  Synthetic construct
GSIYIQY

SEQ ID NO: 9346 - protein, 7 aa, Artificial Sequence
  Synthetic construct
GSIYIDF

SEQ ID NO: 9347 - protein, 7 aa, Artificial Sequence
  Synthetic construct
GSIYIDY

SEQ ID NO: 9348 - protein, 7 aa, Artificial Sequence
  Synthetic construct
GSIYIVF

SEQ ID NO: 9349 - protein, 7 aa, Artificial Sequence
  Synthetic construct
GSIYIVY

SEQ ID NO: 9350 - protein, 7 aa, Artificial Sequence
  Synthetic construct
GSIYDFF

SEQ ID NO: 9351 - protein, 7 aa, Artificial Sequence
  Synthetic construct
GSIYDFY

SEQ ID NO: 9352 - protein, 7 aa, Artificial Sequence
  Synthetic construct
GSIYDRF

SEQ ID NO: 9353 - protein, 7 aa, Artificial Sequence
  Synthetic construct
GSIYDRY

SEQ ID NO: 9354 - protein, 7 aa, Artificial Sequence
  Synthetic construct
GSIYDCF

SEQ ID NO: 9355 - protein, 7 aa, Artificial Sequence
  Synthetic construct
GSIYDCY

SEQ ID NO: 9356 - protein, 7 aa, Artificial Sequence
  Synthetic construct
GSIYDLF

SEQ ID NO: 9357 - protein, 7 aa, Artificial Sequence
  Synthetic construct
GSIYDLY

SEQ ID NO: 9358 - protein, 7 aa, Artificial Sequence
  Synthetic construct
GSIYDAF

SEQ ID NO: 9359 - protein, 7 aa, Artificial Sequence
  Synthetic construct
GSIYDAY

SEQ ID NO: 9360 - protein, 7 aa, Artificial Sequence
  Synthetic construct
GSIYDQF

SEQ ID NO: 9361 - protein, 7 aa, Artificial Sequence
  Synthetic construct
GSIYDQY

SEQ ID NO: 9362 - protein, 7 aa, Artificial Sequence
  Synthetic construct
GSIYDDF

SEQ ID NO: 9363 - protein, 7 aa, Artificial Sequence
  Synthetic construct
GSIYDDY

SEQ ID NO: 9364 - protein, 7 aa, Artificial Sequence
  Synthetic construct
GSIYDVF

SEQ ID NO: 9365 - protein, 7 aa, Artificial Sequence
  Synthetic construct
GSIYDVY

SEQ ID NO: 9366 - protein, 7 aa, Artificial Sequence
  Synthetic construct
GSIYYFF

SEQ ID NO: 9367 - protein, 7 aa, Artificial Sequence
  Synthetic construct
GSIYYFY

SEQ ID NO: 9368 - protein, 7 aa, Artificial Sequence
  Synthetic construct
GSIYYRF

SEQ ID NO: 9369 - protein, 7 aa, Artificial Sequence
  Synthetic construct
GSIYYRY

SEQ ID NO: 9370 - protein, 7 aa, Artificial Sequence
  Synthetic construct
GSIYYCF

SEQ ID NO: 9371 - protein, 7 aa, Artificial Sequence
  Synthetic construct
GSIYYCY

SEQ ID NO: 9372 - protein, 7 aa, Artificial Sequence
  Synthetic construct
GSIYYLF

SEQ ID NO: 9373 - protein, 7 aa, Artificial Sequence
  Synthetic construct
GSIYYLY

SEQ ID NO: 9374 - protein, 7 aa, Artificial Sequence
  Synthetic construct
GSIYYAF

SEQ ID NO: 9375 - protein, 7 aa, Artificial Sequence
  Synthetic construct
GSIYYAY

SEQ ID NO: 9376 - protein, 7 aa, Artificial Sequence
  Synthetic construct
GSIYYQF

SEQ ID NO: 9377 - protein, 7 aa, Artificial Sequence
  Synthetic construct
GSIYYQY

SEQ ID NO: 9378 - protein, 7 aa, Artificial Sequence
  Synthetic construct
GSIYYDF

SEQ ID NO: 9379 - protein, 7 aa, Artificial Sequence
  Synthetic construct
GSIYYDY

SEQ ID NO: 9380 - protein, 7 aa, Artificial Sequence
  Synthetic construct
GSIYYVF

SEQ ID NO: 9381 - protein, 7 aa, Artificial Sequence
  Synthetic construct
GSIYYVY

SEQ ID NO: 9382 - protein, 7 aa, Artificial Sequence
  Synthetic construct
GSIYFFF

SEQ ID NO: 9383 - protein, 7 aa, Artificial Sequence
  Synthetic construct
GSIYFFY

SEQ ID NO: 9384 - protein, 7 aa, Artificial Sequence
  Synthetic construct
GSIYFRF

SEQ ID NO: 9385 - protein, 7 aa, Artificial Sequence
  Synthetic construct
GSIYFRY

SEQ ID NO: 9386 - protein, 7 aa, Artificial Sequence
  Synthetic construct
GSIYFCF

SEQ ID NO: 9387 - protein, 7 aa, Artificial Sequence
  Synthetic construct
GSIYFCY

SEQ ID NO: 9388 - protein, 7 aa, Artificial Sequence
  Synthetic construct
GSIYFLF

SEQ ID NO: 9389 - protein, 7 aa, Artificial Sequence
  Synthetic construct
GSIYFLY

SEQ ID NO: 9390 - protein, 7 aa, Artificial Sequence
  Synthetic construct
GSIYFAF

SEQ ID NO: 9391 - protein, 7 aa, Artificial Sequence
  Synthetic construct
GSIYFAY

SEQ ID NO: 9392 - protein, 7 aa, Artificial Sequence
  Synthetic construct
GSIYFQF

SEQ ID NO: 9393 - protein, 7 aa, Artificial Sequence
  Synthetic construct
GSIYFQY

SEQ ID NO: 9394 - protein, 7 aa, Artificial Sequence
  Synthetic construct
GSIYFDF

SEQ ID NO: 9395 - protein, 7 aa, Artificial Sequence
  Synthetic construct
GSIYFDY

SEQ ID NO: 9396 - protein, 7 aa, Artificial Sequence
  Synthetic construct
GSIYFVF

SEQ ID NO: 9397 - protein, 7 aa, Artificial Sequence
  Synthetic construct
GSIYFVY

SEQ ID NO: 9398 - protein, 7 aa, Artificial Sequence
  Synthetic construct
GSIYVFF

SEQ ID NO: 9399 - protein, 7 aa, Artificial Sequence
  Synthetic construct
GSIYVFY

SEQ ID NO: 9400 - protein, 7 aa, Artificial Sequence
  Synthetic construct
GSIYVRF

SEQ ID NO: 9401 - protein, 7 aa, Artificial Sequence
  Synthetic construct
GSIYVRY

SEQ ID NO: 9402 - protein, 7 aa, Artificial Sequence
  Synthetic construct
GSIYVCF

SEQ ID NO: 9403 - protein, 7 aa, Artificial Sequence
  Synthetic construct
GSIYVCY

SEQ ID NO: 9404 - protein, 7 aa, Artificial Sequence
  Synthetic construct
GSIYVLF

SEQ ID NO: 9405 - protein, 7 aa, Artificial Sequence
  Synthetic construct
GSIYVLY

SEQ ID NO: 9406 - protein, 7 aa, Artificial Sequence
  Synthetic construct
GSIYVAF

SEQ ID NO: 9407 - protein, 7 aa, Artificial Sequence
  Synthetic construct
GSIYVAY

SEQ ID NO: 9408 - protein, 7 aa, Artificial Sequence
  Synthetic construct
GSIYVQF

SEQ ID NO: 9409 - protein, 7 aa, Artificial Sequence
  Synthetic construct
GSIYVQY

SEQ ID NO: 9410 - protein, 7 aa, Artificial Sequence
  Synthetic construct
GSIYVDF

SEQ ID NO: 9411 - protein, 7 aa, Artificial Sequence
  Synthetic construct
GSIYVDY

SEQ ID NO: 9412 - protein, 7 aa, Artificial Sequence
  Synthetic construct
GSIYVVF

SEQ ID NO: 9413 - protein, 7 aa, Artificial Sequence
  Synthetic construct
GSIYVVY

SEQ ID NO: 9414 - protein, 7 aa, Artificial Sequence
  Synthetic construct
GSIYTFF

SEQ ID NO: 9415 - protein, 7 aa, Artificial Sequence
  Synthetic construct
GSIYTFY

SEQ ID NO: 9416 - protein, 7 aa, Artificial Sequence
  Synthetic construct
GSIYTRF

SEQ ID NO: 9417 - protein, 7 aa, Artificial Sequence
  Synthetic construct
GSIYTRY

SEQ ID NO: 9418 - protein, 7 aa, Artificial Sequence
  Synthetic construct
GSIYTCF

SEQ ID NO: 9419 - protein, 7 aa, Artificial Sequence
  Synthetic construct
GSIYTCY

SEQ ID NO: 9420 - protein, 7 aa, Artificial Sequence
  Synthetic construct
GSIYTLF

SEQ ID NO: 9421 - protein, 7 aa, Artificial Sequence
  Synthetic construct
GSIYTLY

SEQ ID NO: 9422 - protein, 7 aa, Artificial Sequence
  Synthetic construct
GSIYTAF

SEQ ID NO: 9423 - protein, 7 aa, Artificial Sequence
  Synthetic construct
GSIYTAY

SEQ ID NO: 9424 - protein, 7 aa, Artificial Sequence
  Synthetic construct
GSIYTQF

SEQ ID NO: 9425 - protein, 7 aa, Artificial Sequence
  Synthetic construct
GSIYTQY

SEQ ID NO: 9426 - protein, 7 aa, Artificial Sequence
  Synthetic construct
GSIYTDF

SEQ ID NO: 9427 - protein, 7 aa, Artificial Sequence
  Synthetic construct
GSIYTDY

SEQ ID NO: 9428 - protein, 7 aa, Artificial Sequence
  Synthetic construct
GSIYTVF

SEQ ID NO: 9429 - protein, 7 aa, Artificial Sequence
  Synthetic construct
GSIYTVY

SEQ ID NO: 9430 - protein, 7 aa, Artificial Sequence
  Synthetic construct
GSIYGFF

SEQ ID NO: 9431 - protein, 7 aa, Artificial Sequence
  Synthetic construct
GSIYGFY

SEQ ID NO: 9432 - protein, 7 aa, Artificial Sequence
  Synthetic construct
GSIYGRF

SEQ ID NO: 9433 - protein, 7 aa, Artificial Sequence
  Synthetic construct
GSIYGRY

SEQ ID NO: 9434 - protein, 7 aa, Artificial Sequence
  Synthetic construct
GSIYGCF

SEQ ID NO: 9435 - protein, 7 aa, Artificial Sequence
  Synthetic construct
GSIYGCY

SEQ ID NO: 9436 - protein, 7 aa, Artificial Sequence
  Synthetic construct
GSIYGLF

SEQ ID NO: 9437 - protein, 7 aa, Artificial Sequence
  Synthetic construct
GSIYGLY

SEQ ID NO: 9438 - protein, 7 aa, Artificial Sequence
  Synthetic construct
GSIYGAF

SEQ ID NO: 9439 - protein, 7 aa, Artificial Sequence
  Synthetic construct
GSIYGAY

SEQ ID NO: 9440 - protein, 7 aa, Artificial Sequence
  Synthetic construct
GSIYGQF

SEQ ID NO: 9441 - protein, 7 aa, Artificial Sequence
  Synthetic construct
GSIYGQY

SEQ ID NO: 9442 - protein, 7 aa, Artificial Sequence
  Synthetic construct
GSIYGDF

SEQ ID NO: 9443 - protein, 7 aa, Artificial Sequence
  Synthetic construct
GSIYGDY

SEQ ID NO: 9444 - protein, 7 aa, Artificial Sequence
  Synthetic construct
GSIYGVF

SEQ ID NO: 9445 - protein, 7 aa, Artificial Sequence
  Synthetic construct
GSIYGVY

SEQ ID NO: 9446 - protein, 7 aa, Artificial Sequence
  Synthetic construct
GSIYAFF

SEQ ID NO: 9447 - protein, 7 aa, Artificial Sequence
  Synthetic construct
GSIYAFY

SEQ ID NO: 9448 - protein, 7 aa, Artificial Sequence
  Synthetic construct
GSIYARF

SEQ ID NO: 9449 - protein, 7 aa, Artificial Sequence
  Synthetic construct
GSIYARY

SEQ ID NO: 9450 - protein, 7 aa, Artificial Sequence
  Synthetic construct
GSIYACF

SEQ ID NO: 9451 - protein, 7 aa, Artificial Sequence
  Synthetic construct
GSIYACY

SEQ ID NO: 9452 - protein, 7 aa, Artificial Sequence
  Synthetic construct
GSIYALF

SEQ ID NO: 9453 - protein, 7 aa, Artificial Sequence
  Synthetic construct
GSIYALY

SEQ ID NO: 9454 - protein, 7 aa, Artificial Sequence
  Synthetic construct
GSIYAAF

SEQ ID NO: 9455 - protein, 7 aa, Artificial Sequence
  Synthetic construct
GSIYAAY

SEQ ID NO: 9456 - protein, 7 aa, Artificial Sequence
  Synthetic construct
GSIYAQF

SEQ ID NO: 9457 - protein, 7 aa, Artificial Sequence
  Synthetic construct
GSIYAQY

SEQ ID NO: 9458 - protein, 7 aa, Artificial Sequence
  Synthetic construct
GSIYADF

SEQ ID NO: 9459 - protein, 7 aa, Artificial Sequence
  Synthetic construct
GSIYADY

SEQ ID NO: 9460 - protein, 7 aa, Artificial Sequence
  Synthetic construct
GSIYAVF

SEQ ID NO: 9461 - protein, 7 aa, Artificial Sequence
  Synthetic construct
GSIYAVY

SEQ ID NO: 9462 - protein, 7 aa, Artificial Sequence
  Synthetic construct
GSIYQFF

SEQ ID NO: 9463 - protein, 7 aa, Artificial Sequence
  Synthetic construct
GSIYQFY

SEQ ID NO: 9464 - protein, 7 aa, Artificial Sequence
  Synthetic construct
GSIYQRF

SEQ ID NO: 9465 - protein, 7 aa, Artificial Sequence
  Synthetic construct
GSIYQRY

SEQ ID NO: 9466 - protein, 7 aa, Artificial Sequence
  Synthetic construct
GSIYQCF

SEQ ID NO: 9467 - protein, 7 aa, Artificial Sequence
  Synthetic construct
GSIYQCY

SEQ ID NO: 9468 - protein, 7 aa, Artificial Sequence
  Synthetic construct
GSIYQLF

SEQ ID NO: 9469 - protein, 7 aa, Artificial Sequence
  Synthetic construct
GSIYQLY

SEQ ID NO: 9470 - protein, 7 aa, Artificial Sequence
  Synthetic construct
GSIYQAF

SEQ ID NO: 9471 - protein, 7 aa, Artificial Sequence
  Synthetic construct
GSIYQAY

SEQ ID NO: 9472 - protein, 7 aa, Artificial Sequence
  Synthetic construct
GSIYQQF

SEQ ID NO: 9473 - protein, 7 aa, Artificial Sequence
  Synthetic construct
GSIYQQY

SEQ ID NO: 9474 - protein, 7 aa, Artificial Sequence
  Synthetic construct
GSIYQDF

SEQ ID NO: 9475 - protein, 7 aa, Artificial Sequence
  Synthetic construct
GSIYQDY

SEQ ID NO: 9476 - protein, 7 aa, Artificial Sequence
  Synthetic construct
GSIYQVF

SEQ ID NO: 9477 - protein, 7 aa, Artificial Sequence
  Synthetic construct
GSIYQVY

SEQ ID NO: 9478 - protein, 7 aa, Artificial Sequence
  Synthetic construct
GSIPIFF

SEQ ID NO: 9479 - protein, 7 aa, Artificial Sequence
  Synthetic construct
GSIPIFY

SEQ ID NO: 9480 - protein, 7 aa, Artificial Sequence
  Synthetic construct
GSIPIRF

SEQ ID NO: 9481 - protein, 7 aa, Artificial Sequence
  Synthetic construct
GSIPIRY

SEQ ID NO: 9482 - protein, 7 aa, Artificial Sequence
  Synthetic construct
GSIPICF

SEQ ID NO: 9483 - protein, 7 aa, Artificial Sequence
  Synthetic construct
GSIPICY

SEQ ID NO: 9484 - protein, 7 aa, Artificial Sequence
  Synthetic construct
GSIPILF

SEQ ID NO: 9485 - protein, 7 aa, Artificial Sequence
  Synthetic construct
GSIPILY

SEQ ID NO: 9486 - protein, 7 aa, Artificial Sequence
  Synthetic construct
GSIPIAF

SEQ ID NO: 9487 - protein, 7 aa, Artificial Sequence
  Synthetic construct
GSIPIAY

SEQ ID NO: 9488 - protein, 7 aa, Artificial Sequence
  Synthetic construct
GSIPIQF

SEQ ID NO: 9489 - protein, 7 aa, Artificial Sequence
  Synthetic construct
GSIPIQY

SEQ ID NO: 9490 - protein, 7 aa, Artificial Sequence
  Synthetic construct
GSIPIDF

SEQ ID NO: 9491 - protein, 7 aa, Artificial Sequence
  Synthetic construct
GSIPIDY

SEQ ID NO: 9492 - protein, 7 aa, Artificial Sequence
  Synthetic construct
GSIPIVF

SEQ ID NO: 9493 - protein, 7 aa, Artificial Sequence
  Synthetic construct
GSIPIVY

SEQ ID NO: 9494 - protein, 7 aa, Artificial Sequence
  Synthetic construct
GSIPDFF

SEQ ID NO: 9495 - protein, 7 aa, Artificial Sequence
  Synthetic construct
GSIPDFY

SEQ ID NO: 9496 - protein, 7 aa, Artificial Sequence
  Synthetic construct
GSIPDRF

SEQ ID NO: 9497 - protein, 7 aa, Artificial Sequence
  Synthetic construct
GSIPDRY

SEQ ID NO: 9498 - protein, 7 aa, Artificial Sequence
  Synthetic construct
GSIPDCF

SEQ ID NO: 9499 - protein, 7 aa, Artificial Sequence
  Synthetic construct
GSIPDCY

SEQ ID NO: 9500 - protein, 7 aa, Artificial Sequence
  Synthetic construct
GSIPDLF

SEQ ID NO: 9501 - protein, 7 aa, Artificial Sequence
  Synthetic construct
GSIPDLY

SEQ ID NO: 9502 - protein, 7 aa, Artificial Sequence
  Synthetic construct
GSIPDAF

SEQ ID NO: 9503 - protein, 7 aa, Artificial Sequence
  Synthetic construct
GSIPDAY

SEQ ID NO: 9504 - protein, 7 aa, Artificial Sequence
  Synthetic construct
GSIPDQF

SEQ ID NO: 9505 - protein, 7 aa, Artificial Sequence
  Synthetic construct
GSIPDQY

SEQ ID NO: 9506 - protein, 7 aa, Artificial Sequence
  Synthetic construct
GSIPDDF

SEQ ID NO: 9507 - protein, 7 aa, Artificial Sequence
  Synthetic construct
GSIPDDY

SEQ ID NO: 9508 - protein, 7 aa, Artificial Sequence
  Synthetic construct
GSIPDVF

SEQ ID NO: 9509 - protein, 7 aa, Artificial Sequence
  Synthetic construct
GSIPDVY

SEQ ID NO: 9510 - protein, 7 aa, Artificial Sequence
  Synthetic construct
GSIPYFF

SEQ ID NO: 9511 - protein, 7 aa, Artificial Sequence
  Synthetic construct
GSIPYFY

SEQ ID NO: 9512 - protein, 7 aa, Artificial Sequence
  Synthetic construct
GSIPYRF

SEQ ID NO: 9513 - protein, 7 aa, Artificial Sequence
  Synthetic construct
GSIPYRY

SEQ ID NO: 9514 - protein, 7 aa, Artificial Sequence
  Synthetic construct
GSIPYCF

SEQ ID NO: 9515 - protein, 7 aa, Artificial Sequence
  Synthetic construct
GSIPYCY

SEQ ID NO: 9516 - protein, 7 aa, Artificial Sequence
  Synthetic construct
GSIPYLF

SEQ ID NO: 9517 - protein, 7 aa, Artificial Sequence
  Synthetic construct
GSIPYLY

SEQ ID NO: 9518 - protein, 7 aa, Artificial Sequence
  Synthetic construct
GSIPYAF

SEQ ID NO: 9519 - protein, 7 aa, Artificial Sequence
  Synthetic construct
GSIPYAY

SEQ ID NO: 9520 - protein, 7 aa, Artificial Sequence
  Synthetic construct
GSIPYQF

SEQ ID NO: 9521 - protein, 7 aa, Artificial Sequence
  Synthetic construct
GSIPYQY

SEQ ID NO: 9522 - protein, 7 aa, Artificial Sequence
  Synthetic construct
GSIPYDF

SEQ ID NO: 9523 - protein, 7 aa, Artificial Sequence
  Synthetic construct
GSIPYDY

SEQ ID NO: 9524 - protein, 7 aa, Artificial Sequence
  Synthetic construct
GSIPYVF

SEQ ID NO: 9525 - protein, 7 aa, Artificial Sequence
  Synthetic construct
GSIPYVY

SEQ ID NO: 9526 - protein, 7 aa, Artificial Sequence
  Synthetic construct
GSIPFFF

SEQ ID NO: 9527 - protein, 7 aa, Artificial Sequence
  Synthetic construct
GSIPFFY

SEQ ID NO: 9528 - protein, 7 aa, Artificial Sequence
  Synthetic construct
GSIPFRF

SEQ ID NO: 9529 - protein, 7 aa, Artificial Sequence
  Synthetic construct
GSIPFRY

SEQ ID NO: 9530 - protein, 7 aa, Artificial Sequence
  Synthetic construct
GSIPFCF

SEQ ID NO: 9531 - protein, 7 aa, Artificial Sequence
  Synthetic construct
GSIPFCY

SEQ ID NO: 9532 - protein, 7 aa, Artificial Sequence
  Synthetic construct
GSIPFLF

SEQ ID NO: 9533 - protein, 7 aa, Artificial Sequence
  Synthetic construct
GSIPFLY

SEQ ID NO: 9534 - protein, 7 aa, Artificial Sequence
  Synthetic construct
GSIPFAF

SEQ ID NO: 9535 - protein, 7 aa, Artificial Sequence
  Synthetic construct
GSIPFAY

SEQ ID NO: 9536 - protein, 7 aa, Artificial Sequence
  Synthetic construct
GSIPFQF

SEQ ID NO: 9537 - protein, 7 aa, Artificial Sequence
  Synthetic construct
GSIPFQY

SEQ ID NO: 9538 - protein, 7 aa, Artificial Sequence
  Synthetic construct
GSIPFDF

SEQ ID NO: 9539 - protein, 7 aa, Artificial Sequence
  Synthetic construct
GSIPFDY

SEQ ID NO: 9540 - protein, 7 aa, Artificial Sequence
  Synthetic construct
GSIPFVF

SEQ ID NO: 9541 - protein, 7 aa, Artificial Sequence
  Synthetic construct
GSIPFVY

SEQ ID NO: 9542 - protein, 7 aa, Artificial Sequence
  Synthetic construct
GSIPVFF

SEQ ID NO: 9543 - protein, 7 aa, Artificial Sequence
  Synthetic construct
GSIPVFY

SEQ ID NO: 9544 - protein, 7 aa, Artificial Sequence
  Synthetic construct
GSIPVRF

SEQ ID NO: 9545 - protein, 7 aa, Artificial Sequence
  Synthetic construct
GSIPVRY

SEQ ID NO: 9546 - protein, 7 aa, Artificial Sequence
  Synthetic construct
GSIPVCF

SEQ ID NO: 9547 - protein, 7 aa, Artificial Sequence
  Synthetic construct
GSIPVCY

SEQ ID NO: 9548 - protein, 7 aa, Artificial Sequence
  Synthetic construct
GSIPVLF

SEQ ID NO: 9549 - protein, 7 aa, Artificial Sequence
  Synthetic construct
GSIPVLY

SEQ ID NO: 9550 - protein, 7 aa, Artificial Sequence
  Synthetic construct
GSIPVAF

SEQ ID NO: 9551 - protein, 7 aa, Artificial Sequence
  Synthetic construct
GSIPVAY

SEQ ID NO: 9552 - protein, 7 aa, Artificial Sequence
  Synthetic construct
GSIPVQF

SEQ ID NO: 9553 - protein, 7 aa, Artificial Sequence
  Synthetic construct
GSIPVQY

SEQ ID NO: 9554 - protein, 7 aa, Artificial Sequence
  Synthetic construct
GSIPVDF

SEQ ID NO: 9555 - protein, 7 aa, Artificial Sequence
  Synthetic construct
GSIPVDY

SEQ ID NO: 9556 - protein, 7 aa, Artificial Sequence
  Synthetic construct
GSIPVVF

SEQ ID NO: 9557 - protein, 7 aa, Artificial Sequence
  Synthetic construct
GSIPVVY

SEQ ID NO: 9558 - protein, 7 aa, Artificial Sequence
  Synthetic construct
GSIPTFF

SEQ ID NO: 9559 - protein, 7 aa, Artificial Sequence
  Synthetic construct
GSIPTFY

SEQ ID NO: 9560 - protein, 7 aa, Artificial Sequence
  Synthetic construct
GSIPTRF

SEQ ID NO: 9561 - protein, 7 aa, Artificial Sequence
  Synthetic construct
GSIPTRY

SEQ ID NO: 9562 - protein, 7 aa, Artificial Sequence
  Synthetic construct
GSIPTCF

SEQ ID NO: 9563 - protein, 7 aa, Artificial Sequence
  Synthetic construct
GSIPTCY

SEQ ID NO: 9564 - protein, 7 aa, Artificial Sequence
  Synthetic construct
GSIPTLF

SEQ ID NO: 9565 - protein, 7 aa, Artificial Sequence
  Synthetic construct
GSIPTLY

SEQ ID NO: 9566 - protein, 7 aa, Artificial Sequence
  Synthetic construct
GSIPTAF

SEQ ID NO: 9567 - protein, 7 aa, Artificial Sequence
  Synthetic construct
GSIPTAY

SEQ ID NO: 9568 - protein, 7 aa, Artificial Sequence
  Synthetic construct
GSIPTQF

SEQ ID NO: 9569 - protein, 7 aa, Artificial Sequence
  Synthetic construct
GSIPTQY

SEQ ID NO: 9570 - protein, 7 aa, Artificial Sequence
  Synthetic construct
GSIPTDF

SEQ ID NO: 9571 - protein, 7 aa, Artificial Sequence
  Synthetic construct
GSIPTDY

SEQ ID NO: 9572 - protein, 7 aa, Artificial Sequence
  Synthetic construct
GSIPTVF

SEQ ID NO: 9573 - protein, 7 aa, Artificial Sequence
  Synthetic construct
GSIPTVY

SEQ ID NO: 9574 - protein, 7 aa, Artificial Sequence
  Synthetic construct
GSIPGFF

SEQ ID NO: 9575 - protein, 7 aa, Artificial Sequence
  Synthetic construct
GSIPGFY

SEQ ID NO: 9576 - protein, 7 aa, Artificial Sequence
  Synthetic construct
GSIPGRF

SEQ ID NO: 9577 - protein, 7 aa, Artificial Sequence
  Synthetic construct
GSIPGRY

SEQ ID NO: 9578 - protein, 7 aa, Artificial Sequence
  Synthetic construct
GSIPGCF

SEQ ID NO: 9579 - protein, 7 aa, Artificial Sequence
  Synthetic construct
GSIPGCY

SEQ ID NO: 9580 - protein, 7 aa, Artificial Sequence
  Synthetic construct
GSIPGLF

SEQ ID NO: 9581 - protein, 7 aa, Artificial Sequence
  Synthetic construct
GSIPGLY

SEQ ID NO: 9582 - protein, 7 aa, Artificial Sequence
  Synthetic construct
GSIPGAF

SEQ ID NO: 9583 - protein, 7 aa, Artificial Sequence
  Synthetic construct
GSIPGAY

SEQ ID NO: 9584 - protein, 7 aa, Artificial Sequence
  Synthetic construct
GSIPGQF

SEQ ID NO: 9585 - protein, 7 aa, Artificial Sequence
  Synthetic construct
GSIPGQY

SEQ ID NO: 9586 - protein, 7 aa, Artificial Sequence
  Synthetic construct
GSIPGDF

SEQ ID NO: 9587 - protein, 7 aa, Artificial Sequence
  Synthetic construct
GSIPGDY

SEQ ID NO: 9588 - protein, 7 aa, Artificial Sequence
  Synthetic construct
GSIPGVF

SEQ ID NO: 9589 - protein, 7 aa, Artificial Sequence
  Synthetic construct
GSIPGVY

SEQ ID NO: 9590 - protein, 7 aa, Artificial Sequence
  Synthetic construct
GSIPAFF

SEQ ID NO: 9591 - protein, 7 aa, Artificial Sequence
  Synthetic construct
GSIPAFY

SEQ ID NO: 9592 - protein, 7 aa, Artificial Sequence
  Synthetic construct
GSIPARF

SEQ ID NO: 9593 - protein, 7 aa, Artificial Sequence
  Synthetic construct
GSIPARY

SEQ ID NO: 9594 - protein, 7 aa, Artificial Sequence
  Synthetic construct
GSIPACF

SEQ ID NO: 9595 - protein, 7 aa, Artificial Sequence
  Synthetic construct
GSIPACY

SEQ ID NO: 9596 - protein, 7 aa, Artificial Sequence
  Synthetic construct
GSIPALF

SEQ ID NO: 9597 - protein, 7 aa, Artificial Sequence
  Synthetic construct
GSIPALY

SEQ ID NO: 9598 - protein, 7 aa, Artificial Sequence
  Synthetic construct
GSIPAAF

SEQ ID NO: 9599 - protein, 7 aa, Artificial Sequence
  Synthetic construct
GSIPAAY

SEQ ID NO: 9600 - protein, 7 aa, Artificial Sequence
  Synthetic construct
GSIPAQF

SEQ ID NO: 9601 - protein, 7 aa, Artificial Sequence
  Synthetic construct
GSIPAQY

SEQ ID NO: 9602 - protein, 7 aa, Artificial Sequence
  Synthetic construct
GSIPADF

SEQ ID NO: 9603 - protein, 7 aa, Artificial Sequence
  Synthetic construct
GSIPADY

SEQ ID NO: 9604 - protein, 7 aa, Artificial Sequence
  Synthetic construct
GSIPAVF

SEQ ID NO: 9605 - protein, 7 aa, Artificial Sequence
  Synthetic construct
GSIPAVY

SEQ ID NO: 9606 - protein, 7 aa, Artificial Sequence
  Synthetic construct
GSIPQFF

SEQ ID NO: 9607 - protein, 7 aa, Artificial Sequence
  Synthetic construct
GSIPQFY

SEQ ID NO: 9608 - protein, 7 aa, Artificial Sequence
  Synthetic construct
GSIPQRF

SEQ ID NO: 9609 - protein, 7 aa, Artificial Sequence
  Synthetic construct
GSIPQRY

SEQ ID NO: 9610 - protein, 7 aa, Artificial Sequence
  Synthetic construct
GSIPQCF

SEQ ID NO: 9611 - protein, 7 aa, Artificial Sequence
  Synthetic construct
GSIPQCY

SEQ ID NO: 9612 - protein, 7 aa, Artificial Sequence
  Synthetic construct
GSIPQLF

SEQ ID NO: 9613 - protein, 7 aa, Artificial Sequence
  Synthetic construct
GSIPQLY

SEQ ID NO: 9614 - protein, 7 aa, Artificial Sequence
  Synthetic construct
GSIPQAF

SEQ ID NO: 9615 - protein, 7 aa, Artificial Sequence
  Synthetic construct
GSIPQAY

SEQ ID NO: 9616 - protein, 7 aa, Artificial Sequence
  Synthetic construct
GSIPQQF

SEQ ID NO: 9617 - protein, 7 aa, Artificial Sequence
  Synthetic construct
GSIPQQY

SEQ ID NO: 9618 - protein, 7 aa, Artificial Sequence
  Synthetic construct
GSIPQDF

SEQ ID NO: 9619 - protein, 7 aa, Artificial Sequence
  Synthetic construct
GSIPQDY

SEQ ID NO: 9620 - protein, 7 aa, Artificial Sequence
  Synthetic construct
GSIPQVF

SEQ ID NO: 9621 - protein, 7 aa, Artificial Sequence
  Synthetic construct
GSIPQVY

SEQ ID NO: 9622 - protein, 7 aa, Artificial Sequence
  Synthetic construct
GSIHIFF

SEQ ID NO: 9623 - protein, 7 aa, Artificial Sequence
  Synthetic construct
GSIHIFY

SEQ ID NO: 9624 - protein, 7 aa, Artificial Sequence
  Synthetic construct
GSIHIRF

SEQ ID NO: 9625 - protein, 7 aa, Artificial Sequence
  Synthetic construct
GSIHIRY

SEQ ID NO: 9626 - protein, 7 aa, Artificial Sequence
  Synthetic construct
GSIHICF

SEQ ID NO: 9627 - protein, 7 aa, Artificial Sequence
  Synthetic construct
GSIHICY

SEQ ID NO: 9628 - protein, 7 aa, Artificial Sequence
  Synthetic construct
GSIHILF

SEQ ID NO: 9629 - protein, 7 aa, Artificial Sequence
  Synthetic construct
GSIHILY

SEQ ID NO: 9630 - protein, 7 aa, Artificial Sequence
  Synthetic construct
GSIHIAF

SEQ ID NO: 9631 - protein, 7 aa, Artificial Sequence
  Synthetic construct
GSIHIAY

SEQ ID NO: 9632 - protein, 7 aa, Artificial Sequence
  Synthetic construct
GSIHIQF

SEQ ID NO: 9633 - protein, 7 aa, Artificial Sequence
  Synthetic construct
GSIHIQY

SEQ ID NO: 9634 - protein, 7 aa, Artificial Sequence
  Synthetic construct
GSIHIDF

SEQ ID NO: 9635 - protein, 7 aa, Artificial Sequence
  Synthetic construct
GSIHIDY

SEQ ID NO: 9636 - protein, 7 aa, Artificial Sequence
  Synthetic construct
GSIHIVF

SEQ ID NO: 9637 - protein, 7 aa, Artificial Sequence
  Synthetic construct
GSIHIVY

SEQ ID NO: 9638 - protein, 7 aa, Artificial Sequence
  Synthetic construct
GSIHDFF

SEQ ID NO: 9639 - protein, 7 aa, Artificial Sequence
  Synthetic construct
GSIHDFY

SEQ ID NO: 9640 - protein, 7 aa, Artificial Sequence
  Synthetic construct
GSIHDRF

SEQ ID NO: 9641 - protein, 7 aa, Artificial Sequence
  Synthetic construct
GSIHDRY

SEQ ID NO: 9642 - protein, 7 aa, Artificial Sequence
  Synthetic construct
GSIHDCF

SEQ ID NO: 9643 - protein, 7 aa, Artificial Sequence
  Synthetic construct
GSIHDCY

SEQ ID NO: 9644 - protein, 7 aa, Artificial Sequence
  Synthetic construct
GSIHDLF

SEQ ID NO: 9645 - protein, 7 aa, Artificial Sequence
  Synthetic construct
GSIHDLY

SEQ ID NO: 9646 - protein, 7 aa, Artificial Sequence
  Synthetic construct
GSIHDAF

SEQ ID NO: 9647 - protein, 7 aa, Artificial Sequence
  Synthetic construct
GSIHDAY

SEQ ID NO: 9648 - protein, 7 aa, Artificial Sequence
  Synthetic construct
GSIHDQF

SEQ ID NO: 9649 - protein, 7 aa, Artificial Sequence
  Synthetic construct
GSIHDQY

SEQ ID NO: 9650 - protein, 7 aa, Artificial Sequence
  Synthetic construct
GSIHDDF

SEQ ID NO: 9651 - protein, 7 aa, Artificial Sequence
  Synthetic construct
GSIHDDY

SEQ ID NO: 9652 - protein, 7 aa, Artificial Sequence
  Synthetic construct
GSIHDVF

SEQ ID NO: 9653 - protein, 7 aa, Artificial Sequence
  Synthetic construct
GSIHDVY

SEQ ID NO: 9654 - protein, 7 aa, Artificial Sequence
  Synthetic construct
GSIHYFF

SEQ ID NO: 9655 - protein, 7 aa, Artificial Sequence
  Synthetic construct
GSIHYFY

SEQ ID NO: 9656 - protein, 7 aa, Artificial Sequence
  Synthetic construct
GSIHYRF

SEQ ID NO: 9657 - protein, 7 aa, Artificial Sequence
  Synthetic construct
GSIHYRY

SEQ ID NO: 9658 - protein, 7 aa, Artificial Sequence
  Synthetic construct
GSIHYCF

SEQ ID NO: 9659 - protein, 7 aa, Artificial Sequence
  Synthetic construct
GSIHYCY

SEQ ID NO: 9660 - protein, 7 aa, Artificial Sequence
  Synthetic construct
GSIHYLF

SEQ ID NO: 9661 - protein, 7 aa, Artificial Sequence
  Synthetic construct
GSIHYLY

SEQ ID NO: 9662 - protein, 7 aa, Artificial Sequence
  Synthetic construct
GSIHYAF

SEQ ID NO: 9663 - protein, 7 aa, Artificial Sequence
  Synthetic construct
GSIHYAY

SEQ ID NO: 9664 - protein, 7 aa, Artificial Sequence
  Synthetic construct
GSIHYQF

SEQ ID NO: 9665 - protein, 7 aa, Artificial Sequence
  Synthetic construct
GSIHYQY

SEQ ID NO: 9666 - protein, 7 aa, Artificial Sequence
  Synthetic construct
GSIHYDF

SEQ ID NO: 9667 - protein, 7 aa, Artificial Sequence
  Synthetic construct
GSIHYDY

SEQ ID NO: 9668 - protein, 7 aa, Artificial Sequence
  Synthetic construct
GSIHYVF

SEQ ID NO: 9669 - protein, 7 aa, Artificial Sequence
  Synthetic construct
GSIHYVY

SEQ ID NO: 9670 - protein, 7 aa, Artificial Sequence
  Synthetic construct
GSIHFFF

SEQ ID NO: 9671 - protein, 7 aa, Artificial Sequence
  Synthetic construct
GSIHFFY

SEQ ID NO: 9672 - protein, 7 aa, Artificial Sequence
  Synthetic construct
GSIHFRF

SEQ ID NO: 9673 - protein, 7 aa, Artificial Sequence
  Synthetic construct
GSIHFRY

SEQ ID NO: 9674 - protein, 7 aa, Artificial Sequence
  Synthetic construct
GSIHFCF

SEQ ID NO: 9675 - protein, 7 aa, Artificial Sequence
  Synthetic construct
GSIHFCY

SEQ ID NO: 9676 - protein, 7 aa, Artificial Sequence
  Synthetic construct
GSIHFLF

SEQ ID NO: 9677 - protein, 7 aa, Artificial Sequence
  Synthetic construct
GSIHFLY

SEQ ID NO: 9678 - protein, 7 aa, Artificial Sequence
  Synthetic construct
GSIHFAF

SEQ ID NO: 9679 - protein, 7 aa, Artificial Sequence
  Synthetic construct
GSIHFAY

SEQ ID NO: 9680 - protein, 7 aa, Artificial Sequence
  Synthetic construct
GSIHFQF

SEQ ID NO: 9681 - protein, 7 aa, Artificial Sequence
  Synthetic construct
GSIHFQY

SEQ ID NO: 9682 - protein, 7 aa, Artificial Sequence
  Synthetic construct
GSIHFDF

SEQ ID NO: 9683 - protein, 7 aa, Artificial Sequence
  Synthetic construct
GSIHFDY

SEQ ID NO: 9684 - protein, 7 aa, Artificial Sequence
  Synthetic construct
GSIHFVF

SEQ ID NO: 9685 - protein, 7 aa, Artificial Sequence
  Synthetic construct
GSIHFVY

SEQ ID NO: 9686 - protein, 7 aa, Artificial Sequence
  Synthetic construct
GSIHVFF

SEQ ID NO: 9687 - protein, 7 aa, Artificial Sequence
  Synthetic construct
GSIHVFY

SEQ ID NO: 9688 - protein, 7 aa, Artificial Sequence
  Synthetic construct
GSIHVRF

SEQ ID NO: 9689 - protein, 7 aa, Artificial Sequence
  Synthetic construct
GSIHVRY

SEQ ID NO: 9690 - protein, 7 aa, Artificial Sequence
  Synthetic construct
GSIHVCF

SEQ ID NO: 9691 - protein, 7 aa, Artificial Sequence
  Synthetic construct
GSIHVCY

SEQ ID NO: 9692 - protein, 7 aa, Artificial Sequence
  Synthetic construct
GSIHVLF

SEQ ID NO: 9693 - protein, 7 aa, Artificial Sequence
  Synthetic construct
GSIHVLY

SEQ ID NO: 9694 - protein, 7 aa, Artificial Sequence
  Synthetic construct
GSIHVAF

SEQ ID NO: 9695 - protein, 7 aa, Artificial Sequence
  Synthetic construct
GSIHVAY

SEQ ID NO: 9696 - protein, 7 aa, Artificial Sequence
  Synthetic construct
GSIHVQF

SEQ ID NO: 9697 - protein, 7 aa, Artificial Sequence
  Synthetic construct
GSIHVQY

SEQ ID NO: 9698 - protein, 7 aa, Artificial Sequence
  Synthetic construct
GSIHVDF

SEQ ID NO: 9699 - protein, 7 aa, Artificial Sequence
  Synthetic construct
GSIHVDY

SEQ ID NO: 9700 - protein, 7 aa, Artificial Sequence
  Synthetic construct
GSIHVVF

SEQ ID NO: 9701 - protein, 7 aa, Artificial Sequence
  Synthetic construct
GSIHVVY

SEQ ID NO: 9702 - protein, 7 aa, Artificial Sequence
  Synthetic construct
GSIHTFF

SEQ ID NO: 9703 - protein, 7 aa, Artificial Sequence
  Synthetic construct
GSIHTFY

SEQ ID NO: 9704 - protein, 7 aa, Artificial Sequence
  Synthetic construct
GSIHTRF

SEQ ID NO: 9705 - protein, 7 aa, Artificial Sequence
  Synthetic construct
GSIHTRY

SEQ ID NO: 9706 - protein, 7 aa, Artificial Sequence
  Synthetic construct
GSIHTCF

SEQ ID NO: 9707 - protein, 7 aa, Artificial Sequence
  Synthetic construct
GSIHTCY

SEQ ID NO: 9708 - protein, 7 aa, Artificial Sequence
  Synthetic construct
GSIHTLF

SEQ ID NO: 9709 - protein, 7 aa, Artificial Sequence
  Synthetic construct
GSIHTLY

SEQ ID NO: 9710 - protein, 7 aa, Artificial Sequence
  Synthetic construct
GSIHTAF

SEQ ID NO: 9711 - protein, 7 aa, Artificial Sequence
  Synthetic construct
GSIHTAY

SEQ ID NO: 9712 - protein, 7 aa, Artificial Sequence
  Synthetic construct
GSIHTQF

SEQ ID NO: 9713 - protein, 7 aa, Artificial Sequence
  Synthetic construct
GSIHTQY

SEQ ID NO: 9714 - protein, 7 aa, Artificial Sequence
  Synthetic construct
GSIHTDF

SEQ ID NO: 9715 - protein, 7 aa, Artificial Sequence
  Synthetic construct
GSIHTDY

SEQ ID NO: 9716 - protein, 7 aa, Artificial Sequence
  Synthetic construct
GSIHTVF

SEQ ID NO: 9717 - protein, 7 aa, Artificial Sequence
  Synthetic construct
GSIHTVY

SEQ ID NO: 9718 - protein, 7 aa, Artificial Sequence
  Synthetic construct
GSIHGFF

SEQ ID NO: 9719 - protein, 7 aa, Artificial Sequence
  Synthetic construct
GSIHGFY

SEQ ID NO: 9720 - protein, 7 aa, Artificial Sequence
  Synthetic construct
GSIHGRF

SEQ ID NO: 9721 - protein, 7 aa, Artificial Sequence
  Synthetic construct
GSIHGRY

SEQ ID NO: 9722 - protein, 7 aa, Artificial Sequence
  Synthetic construct
GSIHGCF

SEQ ID NO: 9723 - protein, 7 aa, Artificial Sequence
  Synthetic construct
GSIHGCY

SEQ ID NO: 9724 - protein, 7 aa, Artificial Sequence
  Synthetic construct
GSIHGLF

SEQ ID NO: 9725 - protein, 7 aa, Artificial Sequence
  Synthetic construct
GSIHGLY

SEQ ID NO: 9726 - protein, 7 aa, Artificial Sequence
  Synthetic construct
GSIHGAF

SEQ ID NO: 9727 - protein, 7 aa, Artificial Sequence
  Synthetic construct
GSIHGAY

SEQ ID NO: 9728 - protein, 7 aa, Artificial Sequence
  Synthetic construct
GSIHGQF

SEQ ID NO: 9729 - protein, 7 aa, Artificial Sequence
  Synthetic construct
GSIHGQY

SEQ ID NO: 9730 - protein, 7 aa, Artificial Sequence
  Synthetic construct
GSIHGDF

SEQ ID NO: 9731 - protein, 7 aa, Artificial Sequence
  Synthetic construct
GSIHGDY

SEQ ID NO: 9732 - protein, 7 aa, Artificial Sequence
  Synthetic construct
GSIHGVF

SEQ ID NO: 9733 - protein, 7 aa, Artificial Sequence
  Synthetic construct
GSIHGVY

SEQ ID NO: 9734 - protein, 7 aa, Artificial Sequence
  Synthetic construct
GSIHAFF

SEQ ID NO: 9735 - protein, 7 aa, Artificial Sequence
  Synthetic construct
GSIHAFY

SEQ ID NO: 9736 - protein, 7 aa, Artificial Sequence
  Synthetic construct
GSIHARF

SEQ ID NO: 9737 - protein, 7 aa, Artificial Sequence
  Synthetic construct
GSIHARY

SEQ ID NO: 9738 - protein, 7 aa, Artificial Sequence
  Synthetic construct
GSIHACF

SEQ ID NO: 9739 - protein, 7 aa, Artificial Sequence
  Synthetic construct
GSIHACY

SEQ ID NO: 9740 - protein, 7 aa, Artificial Sequence
  Synthetic construct
GSIHALF

SEQ ID NO: 9741 - protein, 7 aa, Artificial Sequence
  Synthetic construct
GSIHALY

SEQ ID NO: 9742 - protein, 7 aa, Artificial Sequence
  Synthetic construct
GSIHAAF

SEQ ID NO: 9743 - protein, 7 aa, Artificial Sequence
  Synthetic construct
GSIHAAY

SEQ ID NO: 9744 - protein, 7 aa, Artificial Sequence
  Synthetic construct
GSIHAQF

SEQ ID NO: 9745 - protein, 7 aa, Artificial Sequence
  Synthetic construct
GSIHAQY

SEQ ID NO: 9746 - protein, 7 aa, Artificial Sequence
  Synthetic construct
GSIHADF

SEQ ID NO: 9747 - protein, 7 aa, Artificial Sequence
  Synthetic construct
GSIHADY

SEQ ID NO: 9748 - protein, 7 aa, Artificial Sequence
  Synthetic construct
GSIHAVF

SEQ ID NO: 9749 - protein, 7 aa, Artificial Sequence
  Synthetic construct
GSIHAVY

SEQ ID NO: 9750 - protein, 7 aa, Artificial Sequence
  Synthetic construct
GSIHQFF

SEQ ID NO: 9751 - protein, 7 aa, Artificial Sequence
  Synthetic construct
GSIHQFY

SEQ ID NO: 9752 - protein, 7 aa, Artificial Sequence
  Synthetic construct
GSIHQRF

SEQ ID NO: 9753 - protein, 7 aa, Artificial Sequence
  Synthetic construct
GSIHQRY

SEQ ID NO: 9754 - protein, 7 aa, Artificial Sequence
  Synthetic construct
GSIHQCF

SEQ ID NO: 9755 - protein, 7 aa, Artificial Sequence
  Synthetic construct
GSIHQCY

SEQ ID NO: 9756 - protein, 7 aa, Artificial Sequence
  Synthetic construct
GSIHQLF

SEQ ID NO: 9757 - protein, 7 aa, Artificial Sequence
  Synthetic construct
GSIHQLY

SEQ ID NO: 9758 - protein, 7 aa, Artificial Sequence
  Synthetic construct
GSIHQAF

SEQ ID NO: 9759 - protein, 7 aa, Artificial Sequence
  Synthetic construct
GSIHQAY

SEQ ID NO: 9760 - protein, 7 aa, Artificial Sequence
  Synthetic construct
GSIHQQF

SEQ ID NO: 9761 - protein, 7 aa, Artificial Sequence
  Synthetic construct
GSIHQQY

SEQ ID NO: 9762 - protein, 7 aa, Artificial Sequence
  Synthetic construct
GSIHQDF

SEQ ID NO: 9763 - protein, 7 aa, Artificial Sequence
  Synthetic construct
GSIHQDY

SEQ ID NO: 9764 - protein, 7 aa, Artificial Sequence
  Synthetic construct
GSIHQVF

SEQ ID NO: 9765 - protein, 7 aa, Artificial Sequence
  Synthetic construct
GSIHQVY

SEQ ID NO: 9766 - protein, 7 aa, Artificial Sequence
  Synthetic construct
GSILIFF

SEQ ID NO: 9767 - protein, 7 aa, Artificial Sequence
  Synthetic construct
GSILIFY

SEQ ID NO: 9768 - protein, 7 aa, Artificial Sequence
  Synthetic construct
GSILIRF

SEQ ID NO: 9769 - protein, 7 aa, Artificial Sequence
  Synthetic construct
GSILIRY

SEQ ID NO: 9770 - protein, 7 aa, Artificial Sequence
  Synthetic construct
GSILICF

SEQ ID NO: 9771 - protein, 7 aa, Artificial Sequence
  Synthetic construct
GSILICY

SEQ ID NO: 9772 - protein, 7 aa, Artificial Sequence
  Synthetic construct
GSILILF

SEQ ID NO: 9773 - protein, 7 aa, Artificial Sequence
  Synthetic construct
GSILILY

SEQ ID NO: 9774 - protein, 7 aa, Artificial Sequence
  Synthetic construct
GSILIAF

SEQ ID NO: 9775 - protein, 7 aa, Artificial Sequence
  Synthetic construct
GSILIAY

SEQ ID NO: 9776 - protein, 7 aa, Artificial Sequence
  Synthetic construct
GSILIQF

SEQ ID NO: 9777 - protein, 7 aa, Artificial Sequence
  Synthetic construct
GSILIQY

SEQ ID NO: 9778 - protein, 7 aa, Artificial Sequence
  Synthetic construct
GSILIDF

SEQ ID NO: 9779 - protein, 7 aa, Artificial Sequence
  Synthetic construct
GSILIDY

SEQ ID NO: 9780 - protein, 7 aa, Artificial Sequence
  Synthetic construct
GSILIVF

SEQ ID NO: 9781 - protein, 7 aa, Artificial Sequence
  Synthetic construct
GSILIVY

SEQ ID NO: 9782 - protein, 7 aa, Artificial Sequence
  Synthetic construct
GSILDFF

SEQ ID NO: 9783 - protein, 7 aa, Artificial Sequence
  Synthetic construct
GSILDFY

SEQ ID NO: 9784 - protein, 7 aa, Artificial Sequence
  Synthetic construct
GSILDRF

SEQ ID NO: 9785 - protein, 7 aa, Artificial Sequence
  Synthetic construct
GSILDRY

SEQ ID NO: 9786 - protein, 7 aa, Artificial Sequence
  Synthetic construct
GSILDCF

SEQ ID NO: 9787 - protein, 7 aa, Artificial Sequence
  Synthetic construct
GSILDCY

SEQ ID NO: 9788 - protein, 7 aa, Artificial Sequence
  Synthetic construct
GSILDLF

SEQ ID NO: 9789 - protein, 7 aa, Artificial Sequence
  Synthetic construct
GSILDLY

SEQ ID NO: 9790 - protein, 7 aa, Artificial Sequence
  Synthetic construct
GSILDAF

SEQ ID NO: 9791 - protein, 7 aa, Artificial Sequence
  Synthetic construct
GSILDAY

SEQ ID NO: 9792 - protein, 7 aa, Artificial Sequence
  Synthetic construct
GSILDQF

SEQ ID NO: 9793 - protein, 7 aa, Artificial Sequence
  Synthetic construct
GSILDQY

SEQ ID NO: 9794 - protein, 7 aa, Artificial Sequence
  Synthetic construct
GSILDDF

SEQ ID NO: 9795 - protein, 7 aa, Artificial Sequence
  Synthetic construct
GSILDDY

SEQ ID NO: 9796 - protein, 7 aa, Artificial Sequence
  Synthetic construct
GSILDVF

SEQ ID NO: 9797 - protein, 7 aa, Artificial Sequence
  Synthetic construct
GSILDVY

SEQ ID NO: 9798 - protein, 7 aa, Artificial Sequence
  Synthetic construct
GSILYFF

SEQ ID NO: 9799 - protein, 7 aa, Artificial Sequence
  Synthetic construct
GSILYFY

SEQ ID NO: 9800 - protein, 7 aa, Artificial Sequence
  Synthetic construct
GSILYRF

SEQ ID NO: 9801 - protein, 7 aa, Artificial Sequence
  Synthetic construct
GSILYRY

SEQ ID NO: 9802 - protein, 7 aa, Artificial Sequence
  Synthetic construct
GSILYCF

SEQ ID NO: 9803 - protein, 7 aa, Artificial Sequence
  Synthetic construct
GSILYCY

SEQ ID NO: 9804 - protein, 7 aa, Artificial Sequence
  Synthetic construct
GSILYLF

SEQ ID NO: 9805 - protein, 7 aa, Artificial Sequence
  Synthetic construct
GSILYLY

SEQ ID NO: 9806 - protein, 7 aa, Artificial Sequence
  Synthetic construct
GSILYAF

SEQ ID NO: 9807 - protein, 7 aa, Artificial Sequence
  Synthetic construct
GSILYAY

SEQ ID NO: 9808 - protein, 7 aa, Artificial Sequence
  Synthetic construct
GSILYQF

SEQ ID NO: 9809 - protein, 7 aa, Artificial Sequence
  Synthetic construct
GSILYQY

SEQ ID NO: 9810 - protein, 7 aa, Artificial Sequence
  Synthetic construct
GSILYDF

SEQ ID NO: 9811 - protein, 7 aa, Artificial Sequence
  Synthetic construct
GSILYDY

SEQ ID NO: 9812 - protein, 7 aa, Artificial Sequence
  Synthetic construct
GSILYVF

SEQ ID NO: 9813 - protein, 7 aa, Artificial Sequence
  Synthetic construct
GSILYVY

SEQ ID NO: 9814 - protein, 7 aa, Artificial Sequence
  Synthetic construct
GSILFFF

SEQ ID NO: 9815 - protein, 7 aa, Artificial Sequence
  Synthetic construct
GSILFFY

SEQ ID NO: 9816 - protein, 7 aa, Artificial Sequence
  Synthetic construct
GSILFRF

SEQ ID NO: 9817 - protein, 7 aa, Artificial Sequence
  Synthetic construct
GSILFRY

SEQ ID NO: 9818 - protein, 7 aa, Artificial Sequence
  Synthetic construct
GSILFCF

SEQ ID NO: 9819 - protein, 7 aa, Artificial Sequence
  Synthetic construct
GSILFCY

SEQ ID NO: 9820 - protein, 7 aa, Artificial Sequence
  Synthetic construct
GSILFLF

SEQ ID NO: 9821 - protein, 7 aa, Artificial Sequence
  Synthetic construct
GSILFLY

SEQ ID NO: 9822 - protein, 7 aa, Artificial Sequence
  Synthetic construct
GSILFAF

SEQ ID NO: 9823 - protein, 7 aa, Artificial Sequence
  Synthetic construct
GSILFAY

SEQ ID NO: 9824 - protein, 7 aa, Artificial Sequence
  Synthetic construct
GSILFQF

SEQ ID NO: 9825 - protein, 7 aa, Artificial Sequence
  Synthetic construct
GSILFQY

SEQ ID NO: 9826 - protein, 7 aa, Artificial Sequence
  Synthetic construct
GSILFDF

SEQ ID NO: 9827 - protein, 7 aa, Artificial Sequence
  Synthetic construct
GSILFDY

SEQ ID NO: 9828 - protein, 7 aa, Artificial Sequence
  Synthetic construct
GSILFVF

SEQ ID NO: 9829 - protein, 7 aa, Artificial Sequence
  Synthetic construct
GSILFVY

SEQ ID NO: 9830 - protein, 7 aa, Artificial Sequence
  Synthetic construct
GSILVFF

SEQ ID NO: 9831 - protein, 7 aa, Artificial Sequence
  Synthetic construct
GSILVFY

SEQ ID NO: 9832 - protein, 7 aa, Artificial Sequence
  Synthetic construct
GSILVRF

SEQ ID NO: 9833 - protein, 7 aa, Artificial Sequence
  Synthetic construct
GSILVRY

SEQ ID NO: 9834 - protein, 7 aa, Artificial Sequence
  Synthetic construct
GSILVCF

SEQ ID NO: 9835 - protein, 7 aa, Artificial Sequence
  Synthetic construct
GSILVCY

SEQ ID NO: 9836 - protein, 7 aa, Artificial Sequence
  Synthetic construct
GSILVLF

SEQ ID NO: 9837 - protein, 7 aa, Artificial Sequence
  Synthetic construct
GSILVLY

SEQ ID NO: 9838 - protein, 7 aa, Artificial Sequence
  Synthetic construct
GSILVAF

SEQ ID NO: 9839 - protein, 7 aa, Artificial Sequence
  Synthetic construct
GSILVAY

SEQ ID NO: 9840 - protein, 7 aa, Artificial Sequence
  Synthetic construct
GSILVQF

SEQ ID NO: 9841 - protein, 7 aa, Artificial Sequence
  Synthetic construct
GSILVQY

SEQ ID NO: 9842 - protein, 7 aa, Artificial Sequence
  Synthetic construct
GSILVDF

SEQ ID NO: 9843 - protein, 7 aa, Artificial Sequence
  Synthetic construct
GSILVDY

SEQ ID NO: 9844 - protein, 7 aa, Artificial Sequence
  Synthetic construct
GSILVVF

SEQ ID NO: 9845 - protein, 7 aa, Artificial Sequence
  Synthetic construct
GSILVVY

SEQ ID NO: 9846 - protein, 7 aa, Artificial Sequence
  Synthetic construct
GSILTFF

SEQ ID NO: 9847 - protein, 7 aa, Artificial Sequence
  Synthetic construct
GSILTFY

SEQ ID NO: 9848 - protein, 7 aa, Artificial Sequence
  Synthetic construct
GSILTRF

SEQ ID NO: 9849 - protein, 7 aa, Artificial Sequence
  Synthetic construct
GSILTRY

SEQ ID NO: 9850 - protein, 7 aa, Artificial Sequence
  Synthetic construct
GSILTCF

SEQ ID NO: 9851 - protein, 7 aa, Artificial Sequence
  Synthetic construct
GSILTCY

SEQ ID NO: 9852 - protein, 7 aa, Artificial Sequence
  Synthetic construct
GSILTLF

SEQ ID NO: 9853 - protein, 7 aa, Artificial Sequence
  Synthetic construct
GSILTLY

SEQ ID NO: 9854 - protein, 7 aa, Artificial Sequence
  Synthetic construct
GSILTAF

SEQ ID NO: 9855 - protein, 7 aa, Artificial Sequence
  Synthetic construct
GSILTAY

SEQ ID NO: 9856 - protein, 7 aa, Artificial Sequence
  Synthetic construct
GSILTQF

SEQ ID NO: 9857 - protein, 7 aa, Artificial Sequence
  Synthetic construct
GSILTQY

SEQ ID NO: 9858 - protein, 7 aa, Artificial Sequence
  Synthetic construct
GSILTDF

SEQ ID NO: 9859 - protein, 7 aa, Artificial Sequence
  Synthetic construct
GSILTDY

SEQ ID NO: 9860 - protein, 7 aa, Artificial Sequence
  Synthetic construct
GSILTVF

SEQ ID NO: 9861 - protein, 7 aa, Artificial Sequence
  Synthetic construct
GSILTVY

SEQ ID NO: 9862 - protein, 7 aa, Artificial Sequence
  Synthetic construct
GSILGFF

SEQ ID NO: 9863 - protein, 7 aa, Artificial Sequence
  Synthetic construct
GSILGFY

SEQ ID NO: 9864 - protein, 7 aa, Artificial Sequence
  Synthetic construct
GSILGRF

SEQ ID NO: 9865 - protein, 7 aa, Artificial Sequence
  Synthetic construct
GSILGRY

SEQ ID NO: 9866 - protein, 7 aa, Artificial Sequence
  Synthetic construct
GSILGCF

SEQ ID NO: 9867 - protein, 7 aa, Artificial Sequence
  Synthetic construct
GSILGCY

SEQ ID NO: 9868 - protein, 7 aa, Artificial Sequence
  Synthetic construct
GSILGLF

SEQ ID NO: 9869 - protein, 7 aa, Artificial Sequence
  Synthetic construct
GSILGLY

SEQ ID NO: 9870 - protein, 7 aa, Artificial Sequence
  Synthetic construct
GSILGAF

SEQ ID NO: 9871 - protein, 7 aa, Artificial Sequence
  Synthetic construct
GSILGAY

SEQ ID NO: 9872 - protein, 7 aa, Artificial Sequence
  Synthetic construct
GSILGQF

SEQ ID NO: 9873 - protein, 7 aa, Artificial Sequence
  Synthetic construct
GSILGQY

SEQ ID NO: 9874 - protein, 7 aa, Artificial Sequence
  Synthetic construct
GSILGDF

SEQ ID NO: 9875 - protein, 7 aa, Artificial Sequence
  Synthetic construct
GSILGDY

SEQ ID NO: 9876 - protein, 7 aa, Artificial Sequence
  Synthetic construct
GSILGVF

SEQ ID NO: 9877 - protein, 7 aa, Artificial Sequence
  Synthetic construct
GSILGVY

SEQ ID NO: 9878 - protein, 7 aa, Artificial Sequence
  Synthetic construct
GSILAFF

SEQ ID NO: 9879 - protein, 7 aa, Artificial Sequence
  Synthetic construct
GSILAFY

SEQ ID NO: 9880 - protein, 7 aa, Artificial Sequence
  Synthetic construct
GSILARF

SEQ ID NO: 9881 - protein, 7 aa, Artificial Sequence
  Synthetic construct
GSILARY

SEQ ID NO: 9882 - protein, 7 aa, Artificial Sequence
  Synthetic construct
GSILACF

SEQ ID NO: 9883 - protein, 7 aa, Artificial Sequence
  Synthetic construct
GSILACY

SEQ ID NO: 9884 - protein, 7 aa, Artificial Sequence
  Synthetic construct
GSILALF

SEQ ID NO: 9885 - protein, 7 aa, Artificial Sequence
  Synthetic construct
GSILALY

SEQ ID NO: 9886 - protein, 7 aa, Artificial Sequence
  Synthetic construct
GSILAAF

SEQ ID NO: 9887 - protein, 7 aa, Artificial Sequence
  Synthetic construct
GSILAAY

SEQ ID NO: 9888 - protein, 7 aa, Artificial Sequence
  Synthetic construct
GSILAQF

SEQ ID NO: 9889 - protein, 7 aa, Artificial Sequence
  Synthetic construct
GSILAQY

SEQ ID NO: 9890 - protein, 7 aa, Artificial Sequence
  Synthetic construct
GSILADF

SEQ ID NO: 9891 - protein, 7 aa, Artificial Sequence
  Synthetic construct
GSILADY

SEQ ID NO: 9892 - protein, 7 aa, Artificial Sequence
  Synthetic construct
GSILAVF

SEQ ID NO: 9893 - protein, 7 aa, Artificial Sequence
  Synthetic construct
GSILAVY

SEQ ID NO: 9894 - protein, 7 aa, Artificial Sequence
  Synthetic construct
GSILQFF

SEQ ID NO: 9895 - protein, 7 aa, Artificial Sequence
  Synthetic construct
GSILQFY

SEQ ID NO: 9896 - protein, 7 aa, Artificial Sequence
  Synthetic construct
GSILQRF

SEQ ID NO: 9897 - protein, 7 aa, Artificial Sequence
  Synthetic construct
GSILQRY

SEQ ID NO: 9898 - protein, 7 aa, Artificial Sequence
  Synthetic construct
GSILQCF

SEQ ID NO: 9899 - protein, 7 aa, Artificial Sequence
  Synthetic construct
GSILQCY

SEQ ID NO: 9900 - protein, 7 aa, Artificial Sequence
  Synthetic construct
GSILQLF

SEQ ID NO: 9901 - protein, 7 aa, Artificial Sequence
  Synthetic construct
GSILQLY

SEQ ID NO: 9902 - protein, 7 aa, Artificial Sequence
  Synthetic construct
GSILQAF

SEQ ID NO: 9903 - protein, 7 aa, Artificial Sequence
  Synthetic construct
GSILQAY

SEQ ID NO: 9904 - protein, 7 aa, Artificial Sequence
  Synthetic construct
GSILQQF

SEQ ID NO: 9905 - protein, 7 aa, Artificial Sequence
  Synthetic construct
GSILQQY

SEQ ID NO: 9906 - protein, 7 aa, Artificial Sequence
  Synthetic construct
GSILQDF

SEQ ID NO: 9907 - protein, 7 aa, Artificial Sequence
  Synthetic construct
GSILQDY

SEQ ID NO: 9908 - protein, 7 aa, Artificial Sequence
  Synthetic construct
GSILQVF

SEQ ID NO: 9909 - protein, 7 aa, Artificial Sequence
  Synthetic construct
GSILQVY

SEQ ID NO: 9910 - protein, 7 aa, Artificial Sequence
  Synthetic construct
GSIFIFF

SEQ ID NO: 9911 - protein, 7 aa, Artificial Sequence
  Synthetic construct
GSIFIFY

SEQ ID NO: 9912 - protein, 7 aa, Artificial Sequence
  Synthetic construct
GSIFIRF

SEQ ID NO: 9913 - protein, 7 aa, Artificial Sequence
  Synthetic construct
GSIFIRY

SEQ ID NO: 9914 - protein, 7 aa, Artificial Sequence
  Synthetic construct
GSIFICF

SEQ ID NO: 9915 - protein, 7 aa, Artificial Sequence
  Synthetic construct
GSIFICY

SEQ ID NO: 9916 - protein, 7 aa, Artificial Sequence
  Synthetic construct
GSIFILF

SEQ ID NO: 9917 - protein, 7 aa, Artificial Sequence
  Synthetic construct
GSIFILY

SEQ ID NO: 9918 - protein, 7 aa, Artificial Sequence
  Synthetic construct
GSIFIAF

SEQ ID NO: 9919 - protein, 7 aa, Artificial Sequence
  Synthetic construct
GSIFIAY

SEQ ID NO: 9920 - protein, 7 aa, Artificial Sequence
  Synthetic construct
GSIFIQF

SEQ ID NO: 9921 - protein, 7 aa, Artificial Sequence
  Synthetic construct
GSIFIQY

SEQ ID NO: 9922 - protein, 7 aa, Artificial Sequence
  Synthetic construct
GSIFIDF

SEQ ID NO: 9923 - protein, 7 aa, Artificial Sequence
  Synthetic construct
GSIFIDY

SEQ ID NO: 9924 - protein, 7 aa, Artificial Sequence
  Synthetic construct
GSIFIVF

SEQ ID NO: 9925 - protein, 7 aa, Artificial Sequence
  Synthetic construct
GSIFIVY

SEQ ID NO: 9926 - protein, 7 aa, Artificial Sequence
  Synthetic construct
GSIFDFF

SEQ ID NO: 9927 - protein, 7 aa, Artificial Sequence
  Synthetic construct
GSIFDFY

SEQ ID NO: 9928 - protein, 7 aa, Artificial Sequence
  Synthetic construct
GSIFDRF

SEQ ID NO: 9929 - protein, 7 aa, Artificial Sequence
  Synthetic construct
GSIFDRY

SEQ ID NO: 9930 - protein, 7 aa, Artificial Sequence
  Synthetic construct
GSIFDCF

SEQ ID NO: 9931 - protein, 7 aa, Artificial Sequence
  Synthetic construct
GSIFDCY

SEQ ID NO: 9932 - protein, 7 aa, Artificial Sequence
  Synthetic construct
GSIFDLF

SEQ ID NO: 9933 - protein, 7 aa, Artificial Sequence
  Synthetic construct
GSIFDLY

SEQ ID NO: 9934 - protein, 7 aa, Artificial Sequence
  Synthetic construct
GSIFDAF

SEQ ID NO: 9935 - protein, 7 aa, Artificial Sequence
  Synthetic construct
GSIFDAY

SEQ ID NO: 9936 - protein, 7 aa, Artificial Sequence
  Synthetic construct
GSIFDQF

SEQ ID NO: 9937 - protein, 7 aa, Artificial Sequence
  Synthetic construct
GSIFDQY

SEQ ID NO: 9938 - protein, 7 aa, Artificial Sequence
  Synthetic construct
GSIFDDF

SEQ ID NO: 9939 - protein, 7 aa, Artificial Sequence
  Synthetic construct
GSIFDDY

SEQ ID NO: 9940 - protein, 7 aa, Artificial Sequence
  Synthetic construct
GSIFDVF

SEQ ID NO: 9941 - protein, 7 aa, Artificial Sequence
  Synthetic construct
GSIFDVY

SEQ ID NO: 9942 - protein, 7 aa, Artificial Sequence
  Synthetic construct
GSIFYFF

SEQ ID NO: 9943 - protein, 7 aa, Artificial Sequence
  Synthetic construct
GSIFYFY

SEQ ID NO: 9944 - protein, 7 aa, Artificial Sequence
  Synthetic construct
GSIFYRF

SEQ ID NO: 9945 - protein, 7 aa, Artificial Sequence
  Synthetic construct
GSIFYRY

SEQ ID NO: 9946 - protein, 7 aa, Artificial Sequence
  Synthetic construct
GSIFYCF

SEQ ID NO: 9947 - protein, 7 aa, Artificial Sequence
  Synthetic construct
GSIFYCY

SEQ ID NO: 9948 - protein, 7 aa, Artificial Sequence
  Synthetic construct
GSIFYLF

SEQ ID NO: 9949 - protein, 7 aa, Artificial Sequence
  Synthetic construct
GSIFYLY

SEQ ID NO: 9950 - protein, 7 aa, Artificial Sequence
  Synthetic construct
GSIFYAF

SEQ ID NO: 9951 - protein, 7 aa, Artificial Sequence
  Synthetic construct
GSIFYAY

SEQ ID NO: 9952 - protein, 7 aa, Artificial Sequence
  Synthetic construct
GSIFYQF

SEQ ID NO: 9953 - protein, 7 aa, Artificial Sequence
  Synthetic construct
GSIFYQY

SEQ ID NO: 9954 - protein, 7 aa, Artificial Sequence
  Synthetic construct
GSIFYDF

SEQ ID NO: 9955 - protein, 7 aa, Artificial Sequence
  Synthetic construct
GSIFYDY

SEQ ID NO: 9956 - protein, 7 aa, Artificial Sequence
  Synthetic construct
GSIFYVF

SEQ ID NO: 9957 - protein, 7 aa, Artificial Sequence
  Synthetic construct
GSIFYVY

SEQ ID NO: 9958 - protein, 7 aa, Artificial Sequence
  Synthetic construct
GSIFFFF

SEQ ID NO: 9959 - protein, 7 aa, Artificial Sequence
  Synthetic construct
GSIFFFY

SEQ ID NO: 9960 - protein, 7 aa, Artificial Sequence
  Synthetic construct
GSIFFRF

SEQ ID NO: 9961 - protein, 7 aa, Artificial Sequence
  Synthetic construct
GSIFFRY

SEQ ID NO: 9962 - protein, 7 aa, Artificial Sequence
  Synthetic construct
GSIFFCF

SEQ ID NO: 9963 - protein, 7 aa, Artificial Sequence
  Synthetic construct
GSIFFCY

SEQ ID NO: 9964 - protein, 7 aa, Artificial Sequence
  Synthetic construct
GSIFFLF

SEQ ID NO: 9965 - protein, 7 aa, Artificial Sequence
  Synthetic construct
GSIFFLY

SEQ ID NO: 9966 - protein, 7 aa, Artificial Sequence
  Synthetic construct
GSIFFAF

SEQ ID NO: 9967 - protein, 7 aa, Artificial Sequence
  Synthetic construct
GSIFFAY

SEQ ID NO: 9968 - protein, 7 aa, Artificial Sequence
  Synthetic construct
GSIFFQF

SEQ ID NO: 9969 - protein, 7 aa, Artificial Sequence
  Synthetic construct
GSIFFQY

SEQ ID NO: 9970 - protein, 7 aa, Artificial Sequence
  Synthetic construct
GSIFFDF

SEQ ID NO: 9971 - protein, 7 aa, Artificial Sequence
  Synthetic construct
GSIFFDY

SEQ ID NO: 9972 - protein, 7 aa, Artificial Sequence
  Synthetic construct
GSIFFVF

SEQ ID NO: 9973 - protein, 7 aa, Artificial Sequence
  Synthetic construct
GSIFFVY

SEQ ID NO: 9974 - protein, 7 aa, Artificial Sequence
  Synthetic construct
GSIFVFF

SEQ ID NO: 9975 - protein, 7 aa, Artificial Sequence
  Synthetic construct
GSIFVFY

SEQ ID NO: 9976 - protein, 7 aa, Artificial Sequence
  Synthetic construct
GSIFVRF

SEQ ID NO: 9977 - protein, 7 aa, Artificial Sequence
  Synthetic construct
GSIFVRY

SEQ ID NO: 9978 - protein, 7 aa, Artificial Sequence
  Synthetic construct
GSIFVCF

SEQ ID NO: 9979 - protein, 7 aa, Artificial Sequence
  Synthetic construct
GSIFVCY

SEQ ID NO: 9980 - protein, 7 aa, Artificial Sequence
  Synthetic construct
GSIFVLF

SEQ ID NO: 9981 - protein, 7 aa, Artificial Sequence
  Synthetic construct
GSIFVLY

SEQ ID NO: 9982 - protein, 7 aa, Artificial Sequence
  Synthetic construct
GSIFVAF

SEQ ID NO: 9983 - protein, 7 aa, Artificial Sequence
  Synthetic construct
GSIFVAY

SEQ ID NO: 9984 - protein, 7 aa, Artificial Sequence
  Synthetic construct
GSIFVQF

SEQ ID NO: 9985 - protein, 7 aa, Artificial Sequence
  Synthetic construct
GSIFVQY

SEQ ID NO: 9986 - protein, 7 aa, Artificial Sequence
  Synthetic construct
GSIFVDF

SEQ ID NO: 9987 - protein, 7 aa, Artificial Sequence
  Synthetic construct
GSIFVDY

SEQ ID NO: 9988 - protein, 7 aa, Artificial Sequence
  Synthetic construct
GSIFVVF

SEQ ID NO: 9989 - protein, 7 aa, Artificial Sequence
  Synthetic construct
GSIFVVY

SEQ ID NO: 9990 - protein, 7 aa, Artificial Sequence
  Synthetic construct
GSIFTFF

SEQ ID NO: 9991 - protein, 7 aa, Artificial Sequence
  Synthetic construct
GSIFTFY

SEQ ID NO: 9992 - protein, 7 aa, Artificial Sequence
  Synthetic construct
GSIFTRF

SEQ ID NO: 9993 - protein, 7 aa, Artificial Sequence
  Synthetic construct
GSIFTRY

SEQ ID NO: 9994 - protein, 7 aa, Artificial Sequence
  Synthetic construct
GSIFTCF

SEQ ID NO: 9995 - protein, 7 aa, Artificial Sequence
  Synthetic construct
GSIFTCY

SEQ ID NO: 9996 - protein, 7 aa, Artificial Sequence
  Synthetic construct
GSIFTLF

SEQ ID NO: 9997 - protein, 7 aa, Artificial Sequence
  Synthetic construct
GSIFTLY

SEQ ID NO: 9998 - protein, 7 aa, Artificial Sequence
  Synthetic construct
GSIFTAF

SEQ ID NO: 9999 - protein, 7 aa, Artificial Sequence
  Synthetic construct
GSIFTAY

SEQ ID NO: 10000 - protein, 7 aa, Artificial Sequence
  Synthetic construct
GSIFTQF

SEQ ID NO: 10001 - protein, 7 aa, Artificial Sequence
  Synthetic construct
GSIFTQY

SEQ ID NO: 10002 - protein, 7 aa, Artificial Sequence
  Synthetic construct
GSIFTDF

SEQ ID NO: 10003 - protein, 7 aa, Artificial Sequence
  Synthetic construct
GSIFTDY

SEQ ID NO: 10004 - protein, 7 aa, Artificial Sequence
  Synthetic construct
GSIFTVF

SEQ ID NO: 10005 - protein, 7 aa, Artificial Sequence
  Synthetic construct
GSIFTVY

SEQ ID NO: 10006 - protein, 7 aa, Artificial Sequence
  Synthetic construct
GSIFGFF

SEQ ID NO: 10007 - protein, 7 aa, Artificial Sequence
  Synthetic construct
GSIFGFY

SEQ ID NO: 10008 - protein, 7 aa, Artificial Sequence
  Synthetic construct
GSIFGRF

SEQ ID NO: 10009 - protein, 7 aa, Artificial Sequence
  Synthetic construct
GSIFGRY

SEQ ID NO: 10010 - protein, 7 aa, Artificial Sequence
  Synthetic construct
GSIFGCF

SEQ ID NO: 10011 - protein, 7 aa, Artificial Sequence
  Synthetic construct
GSIFGCY

SEQ ID NO: 10012 - protein, 7 aa, Artificial Sequence
  Synthetic construct
GSIFGLF

SEQ ID NO: 10013 - protein, 7 aa, Artificial Sequence
  Synthetic construct
GSIFGLY

SEQ ID NO: 10014 - protein, 7 aa, Artificial Sequence
  Synthetic construct
GSIFGAF

SEQ ID NO: 10015 - protein, 7 aa, Artificial Sequence
  Synthetic construct
GSIFGAY

SEQ ID NO: 10016 - protein, 7 aa, Artificial Sequence
  Synthetic construct
GSIFGQF

SEQ ID NO: 10017 - protein, 7 aa, Artificial Sequence
  Synthetic construct
GSIFGQY

SEQ ID NO: 10018 - protein, 7 aa, Artificial Sequence
  Synthetic construct
GSIFGDF

SEQ ID NO: 10019 - protein, 7 aa, Artificial Sequence
  Synthetic construct
GSIFGDY

SEQ ID NO: 10020 - protein, 7 aa, Artificial Sequence
  Synthetic construct
GSIFGVF

SEQ ID NO: 10021 - protein, 7 aa, Artificial Sequence
  Synthetic construct
GSIFGVY

SEQ ID NO: 10022 - protein, 7 aa, Artificial Sequence
  Synthetic construct
GSIFAFF

SEQ ID NO: 10023 - protein, 7 aa, Artificial Sequence
  Synthetic construct
GSIFAFY

SEQ ID NO: 10024 - protein, 7 aa, Artificial Sequence
  Synthetic construct
GSIFARF

SEQ ID NO: 10025 - protein, 7 aa, Artificial Sequence
  Synthetic construct
GSIFARY

SEQ ID NO: 10026 - protein, 7 aa, Artificial Sequence
  Synthetic construct
GSIFACF

SEQ ID NO: 10027 - protein, 7 aa, Artificial Sequence
  Synthetic construct
GSIFACY

SEQ ID NO: 10028 - protein, 7 aa, Artificial Sequence
  Synthetic construct
GSIFALF

SEQ ID NO: 10029 - protein, 7 aa, Artificial Sequence
  Synthetic construct
GSIFALY

SEQ ID NO: 10030 - protein, 7 aa, Artificial Sequence
  Synthetic construct
GSIFAAF

SEQ ID NO: 10031 - protein, 7 aa, Artificial Sequence
  Synthetic construct
GSIFAAY

SEQ ID NO: 10032 - protein, 7 aa, Artificial Sequence
  Synthetic construct
GSIFAQF

SEQ ID NO: 10033 - protein, 7 aa, Artificial Sequence
  Synthetic construct
GSIFAQY

SEQ ID NO: 10034 - protein, 7 aa, Artificial Sequence
  Synthetic construct
GSIFADF

SEQ ID NO: 10035 - protein, 7 aa, Artificial Sequence
  Synthetic construct
GSIFADY

SEQ ID NO: 10036 - protein, 7 aa, Artificial Sequence
  Synthetic construct
GSIFAVF

SEQ ID NO: 10037 - protein, 7 aa, Artificial Sequence
  Synthetic construct
GSIFAVY

SEQ ID NO: 10038 - protein, 7 aa, Artificial Sequence
  Synthetic construct
GSIFQFF

SEQ ID NO: 10039 - protein, 7 aa, Artificial Sequence
  Synthetic construct
GSIFQFY

SEQ ID NO: 10040 - protein, 7 aa, Artificial Sequence
  Synthetic construct
GSIFQRF

SEQ ID NO: 10041 - protein, 7 aa, Artificial Sequence
  Synthetic construct
GSIFQRY

SEQ ID NO: 10042 - protein, 7 aa, Artificial Sequence
  Synthetic construct
GSIFQCF

SEQ ID NO: 10043 - protein, 7 aa, Artificial Sequence
  Synthetic construct
GSIFQCY

SEQ ID NO: 10044 - protein, 7 aa, Artificial Sequence
  Synthetic construct
GSIFQLF

SEQ ID NO: 10045 - protein, 7 aa, Artificial Sequence
  Synthetic construct
GSIFQLY

SEQ ID NO: 10046 - protein, 7 aa, Artificial Sequence
  Synthetic construct
GSIFQAF

SEQ ID NO: 10047 - protein, 7 aa, Artificial Sequence
  Synthetic construct
GSIFQAY

SEQ ID NO: 10048 - protein, 7 aa, Artificial Sequence
  Synthetic construct
GSIFQQF

SEQ ID NO: 10049 - protein, 7 aa, Artificial Sequence
  Synthetic construct
GSIFQQY

SEQ ID NO: 10050 - protein, 7 aa, Artificial Sequence
  Synthetic construct
GSIFQDF

SEQ ID NO: 10051 - protein, 7 aa, Artificial Sequence
  Synthetic construct
GSIFQDY

SEQ ID NO: 10052 - protein, 7 aa, Artificial Sequence
  Synthetic construct
GSIFQVF

SEQ ID NO: 10053 - protein, 7 aa, Artificial Sequence
  Synthetic construct
GSIFQVY

SEQ ID NO: 10054 - protein, 7 aa, Artificial Sequence
  Synthetic construct
GSGYIFF

SEQ ID NO: 10055 - protein, 7 aa, Artificial Sequence
  Synthetic construct
GSGYIFY

SEQ ID NO: 10056 - protein, 7 aa, Artificial Sequence
  Synthetic construct
GSGYIRF

SEQ ID NO: 10057 - protein, 7 aa, Artificial Sequence
  Synthetic construct
GSGYIRY

SEQ ID NO: 10058 - protein, 7 aa, Artificial Sequence
  Synthetic construct
GSGYICF

SEQ ID NO: 10059 - protein, 7 aa, Artificial Sequence
  Synthetic construct
GSGYICY

SEQ ID NO: 10060 - protein, 7 aa, Artificial Sequence
  Synthetic construct
GSGYILF

SEQ ID NO: 10061 - protein, 7 aa, Artificial Sequence
  Synthetic construct
GSGYILY

SEQ ID NO: 10062 - protein, 7 aa, Artificial Sequence
  Synthetic construct
GSGYIAF

SEQ ID NO: 10063 - protein, 7 aa, Artificial Sequence
  Synthetic construct
GSGYIAY

SEQ ID NO: 10064 - protein, 7 aa, Artificial Sequence
  Synthetic construct
GSGYIQF

SEQ ID NO: 10065 - protein, 7 aa, Artificial Sequence
  Synthetic construct
GSGYIQY

SEQ ID NO: 10066 - protein, 7 aa, Artificial Sequence
  Synthetic construct
GSGYIDF

SEQ ID NO: 10067 - protein, 7 aa, Artificial Sequence
  Synthetic construct
GSGYIDY

SEQ ID NO: 10068 - protein, 7 aa, Artificial Sequence
  Synthetic construct
GSGYIVF

SEQ ID NO: 10069 - protein, 7 aa, Artificial Sequence
  Synthetic construct
GSGYIVY

SEQ ID NO: 10070 - protein, 7 aa, Artificial Sequence
  Synthetic construct
GSGYDFF

SEQ ID NO: 10071 - protein, 7 aa, Artificial Sequence
  Synthetic construct
GSGYDFY

SEQ ID NO: 10072 - protein, 7 aa, Artificial Sequence
  Synthetic construct
GSGYDRF

SEQ ID NO: 10073 - protein, 7 aa, Artificial Sequence
  Synthetic construct
GSGYDRY

SEQ ID NO: 10074 - protein, 7 aa, Artificial Sequence
  Synthetic construct
GSGYDCF

SEQ ID NO: 10075 - protein, 7 aa, Artificial Sequence
  Synthetic construct
GSGYDCY

SEQ ID NO: 10076 - protein, 7 aa, Artificial Sequence
  Synthetic construct
GSGYDLF

SEQ ID NO: 10077 - protein, 7 aa, Artificial Sequence
  Synthetic construct
GSGYDLY

SEQ ID NO: 10078 - protein, 7 aa, Artificial Sequence
  Synthetic construct
GSGYDAF

SEQ ID NO: 10079 - protein, 7 aa, Artificial Sequence
  Synthetic construct
GSGYDAY

SEQ ID NO: 10080 - protein, 7 aa, Artificial Sequence
  Synthetic construct
GSGYDQF

SEQ ID NO: 10081 - protein, 7 aa, Artificial Sequence
  Synthetic construct
GSGYDQY

SEQ ID NO: 10082 - protein, 7 aa, Artificial Sequence
  Synthetic construct
GSGYDDF

SEQ ID NO: 10083 - protein, 7 aa, Artificial Sequence
  Synthetic construct
GSGYDDY

SEQ ID NO: 10084 - protein, 7 aa, Artificial Sequence
  Synthetic construct
GSGYDVF

SEQ ID NO: 10085 - protein, 7 aa, Artificial Sequence
  Synthetic construct
GSGYDVY

SEQ ID NO: 10086 - protein, 7 aa, Artificial Sequence
  Synthetic construct
GSGYYFF

SEQ ID NO: 10087 - protein, 7 aa, Artificial Sequence
  Synthetic construct
GSGYYFY

SEQ ID NO: 10088 - protein, 7 aa, Artificial Sequence
  Synthetic construct
GSGYYRF

SEQ ID NO: 10089 - protein, 7 aa, Artificial Sequence
  Synthetic construct
GSGYYRY

SEQ ID NO: 10090 - protein, 7 aa, Artificial Sequence
  Synthetic construct
GSGYYCF

SEQ ID NO: 10091 - protein, 7 aa, Artificial Sequence
  Synthetic construct
GSGYYCY

SEQ ID NO: 10092 - protein, 7 aa, Artificial Sequence
  Synthetic construct
GSGYYLF

SEQ ID NO: 10093 - protein, 7 aa, Artificial Sequence
  Synthetic construct
GSGYYLY

SEQ ID NO: 10094 - protein, 7 aa, Artificial Sequence
  Synthetic construct
GSGYYAF

SEQ ID NO: 10095 - protein, 7 aa, Artificial Sequence
  Synthetic construct
GSGYYAY

SEQ ID NO: 10096 - protein, 7 aa, Artificial Sequence
  Synthetic construct
GSGYYQF

SEQ ID NO: 10097 - protein, 7 aa, Artificial Sequence
  Synthetic construct
GSGYYQY

SEQ ID NO: 10098 - protein, 7 aa, Artificial Sequence
  Synthetic construct
GSGYYDF

SEQ ID NO: 10099 - protein, 7 aa, Artificial Sequence
  Synthetic construct
GSGYYDY

SEQ ID NO: 10100 - protein, 7 aa, Artificial Sequence
  Synthetic construct
GSGYYVF

SEQ ID NO: 10101 - protein, 7 aa, Artificial Sequence
  Synthetic construct
GSGYYVY

SEQ ID NO: 10102 - protein, 7 aa, Artificial Sequence
  Synthetic construct
GSGYFFF

SEQ ID NO: 10103 - protein, 7 aa, Artificial Sequence
  Synthetic construct
GSGYFFY

SEQ ID NO: 10104 - protein, 7 aa, Artificial Sequence
  Synthetic construct
GSGYFRF

SEQ ID NO: 10105 - protein, 7 aa, Artificial Sequence
  Synthetic construct
GSGYFRY

SEQ ID NO: 10106 - protein, 7 aa, Artificial Sequence
  Synthetic construct
GSGYFCF

SEQ ID NO: 10107 - protein, 7 aa, Artificial Sequence
  Synthetic construct
GSGYFCY

SEQ ID NO: 10108 - protein, 7 aa, Artificial Sequence
  Synthetic construct
GSGYFLF

SEQ ID NO: 10109 - protein, 7 aa, Artificial Sequence
  Synthetic construct
GSGYFLY

SEQ ID NO: 10110 - protein, 7 aa, Artificial Sequence
  Synthetic construct
GSGYFAF

SEQ ID NO: 10111 - protein, 7 aa, Artificial Sequence
  Synthetic construct
GSGYFAY

SEQ ID NO: 10112 - protein, 7 aa, Artificial Sequence
  Synthetic construct
GSGYFQF

SEQ ID NO: 10113 - protein, 7 aa, Artificial Sequence
  Synthetic construct
GSGYFQY

SEQ ID NO: 10114 - protein, 7 aa, Artificial Sequence
  Synthetic construct
GSGYFDF

SEQ ID NO: 10115 - protein, 7 aa, Artificial Sequence
  Synthetic construct
GSGYFDY

SEQ ID NO: 10116 - protein, 7 aa, Artificial Sequence
  Synthetic construct
GSGYFVF

SEQ ID NO: 10117 - protein, 7 aa, Artificial Sequence
  Synthetic construct
GSGYFVY

SEQ ID NO: 10118 - protein, 7 aa, Artificial Sequence
  Synthetic construct
GSGYVFF

SEQ ID NO: 10119 - protein, 7 aa, Artificial Sequence
  Synthetic construct
GSGYVFY

SEQ ID NO: 10120 - protein, 7 aa, Artificial Sequence
  Synthetic construct
GSGYVRF

SEQ ID NO: 10121 - protein, 7 aa, Artificial Sequence
  Synthetic construct
GSGYVRY

SEQ ID NO: 10122 - protein, 7 aa, Artificial Sequence
  Synthetic construct
GSGYVCF

SEQ ID NO: 10123 - protein, 7 aa, Artificial Sequence
  Synthetic construct
GSGYVCY

SEQ ID NO: 10124 - protein, 7 aa, Artificial Sequence
  Synthetic construct
GSGYVLF

SEQ ID NO: 10125 - protein, 7 aa, Artificial Sequence
  Synthetic construct
GSGYVLY

SEQ ID NO: 10126 - protein, 7 aa, Artificial Sequence
  Synthetic construct
GSGYVAF

SEQ ID NO: 10127 - protein, 7 aa, Artificial Sequence
  Synthetic construct
GSGYVAY

SEQ ID NO: 10128 - protein, 7 aa, Artificial Sequence
  Synthetic construct
GSGYVQF

SEQ ID NO: 10129 - protein, 7 aa, Artificial Sequence
  Synthetic construct
GSGYVQY

SEQ ID NO: 10130 - protein, 7 aa, Artificial Sequence
  Synthetic construct
GSGYVDF

SEQ ID NO: 10131 - protein, 7 aa, Artificial Sequence
  Synthetic construct
GSGYVDY

SEQ ID NO: 10132 - protein, 7 aa, Artificial Sequence
  Synthetic construct
GSGYVVF

SEQ ID NO: 10133 - protein, 7 aa, Artificial Sequence
  Synthetic construct
GSGYVVY

SEQ ID NO: 10134 - protein, 7 aa, Artificial Sequence
  Synthetic construct
GSGYTFF

SEQ ID NO: 10135 - protein, 7 aa, Artificial Sequence
  Synthetic construct
GSGYTFY

SEQ ID NO: 10136 - protein, 7 aa, Artificial Sequence
  Synthetic construct
GSGYTRF

SEQ ID NO: 10137 - protein, 7 aa, Artificial Sequence
  Synthetic construct
GSGYTRY

SEQ ID NO: 10138 - protein, 7 aa, Artificial Sequence
  Synthetic construct
GSGYTCF

SEQ ID NO: 10139 - protein, 7 aa, Artificial Sequence
  Synthetic construct
GSGYTCY

SEQ ID NO: 10140 - protein, 7 aa, Artificial Sequence
  Synthetic construct
GSGYTLF

SEQ ID NO: 10141 - protein, 7 aa, Artificial Sequence
  Synthetic construct
GSGYTLY

SEQ ID NO: 10142 - protein, 7 aa, Artificial Sequence
  Synthetic construct
GSGYTAF

SEQ ID NO: 10143 - protein, 7 aa, Artificial Sequence
  Synthetic construct
GSGYTAY

SEQ ID NO: 10144 - protein, 7 aa, Artificial Sequence
  Synthetic construct
GSGYTQF

SEQ ID NO: 10145 - protein, 7 aa, Artificial Sequence
  Synthetic construct
GSGYTQY

SEQ ID NO: 10146 - protein, 7 aa, Artificial Sequence
  Synthetic construct
GSGYTDF

SEQ ID NO: 10147 - protein, 7 aa, Artificial Sequence
  Synthetic construct
GSGYTDY

SEQ ID NO: 10148 - protein, 7 aa, Artificial Sequence
  Synthetic construct
GSGYTVF

SEQ ID NO: 10149 - protein, 7 aa, Artificial Sequence
  Synthetic construct
GSGYTVY

SEQ ID NO: 10150 - protein, 7 aa, Artificial Sequence
  Synthetic construct
GSGYGFF

SEQ ID NO: 10151 - protein, 7 aa, Artificial Sequence
  Synthetic construct
GSGYGFY

SEQ ID NO: 10152 - protein, 7 aa, Artificial Sequence
  Synthetic construct
GSGYGRF

SEQ ID NO: 10153 - protein, 7 aa, Artificial Sequence
  Synthetic construct
GSGYGRY

SEQ ID NO: 10154 - protein, 7 aa, Artificial Sequence
  Synthetic construct
GSGYGCF

SEQ ID NO: 10155 - protein, 7 aa, Artificial Sequence
  Synthetic construct
GSGYGCY

SEQ ID NO: 10156 - protein, 7 aa, Artificial Sequence
  Synthetic construct
GSGYGLF

SEQ ID NO: 10157 - protein, 7 aa, Artificial Sequence
  Synthetic construct
GSGYGLY

SEQ ID NO: 10158 - protein, 7 aa, Artificial Sequence
  Synthetic construct
GSGYGAF

SEQ ID NO: 10159 - protein, 7 aa, Artificial Sequence
  Synthetic construct
GSGYGAY

SEQ ID NO: 10160 - protein, 7 aa, Artificial Sequence
  Synthetic construct
GSGYGQF

SEQ ID NO: 10161 - protein, 7 aa, Artificial Sequence
  Synthetic construct
GSGYGQY

SEQ ID NO: 10162 - protein, 7 aa, Artificial Sequence
  Synthetic construct
GSGYGDF

SEQ ID NO: 10163 - protein, 7 aa, Artificial Sequence
  Synthetic construct
GSGYGDY

SEQ ID NO: 10164 - protein, 7 aa, Artificial Sequence
  Synthetic construct
GSGYGVF

SEQ ID NO: 10165 - protein, 7 aa, Artificial Sequence
  Synthetic construct
GSGYGVY

SEQ ID NO: 10166 - protein, 7 aa, Artificial Sequence
  Synthetic construct
GSGYAFF

SEQ ID NO: 10167 - protein, 7 aa, Artificial Sequence
  Synthetic construct
GSGYAFY

SEQ ID NO: 10168 - protein, 7 aa, Artificial Sequence
  Synthetic construct
GSGYARF

SEQ ID NO: 10169 - protein, 7 aa, Artificial Sequence
  Synthetic construct
GSGYARY

SEQ ID NO: 10170 - protein, 7 aa, Artificial Sequence
  Synthetic construct
GSGYACF

SEQ ID NO: 10171 - protein, 7 aa, Artificial Sequence
  Synthetic construct
GSGYACY

SEQ ID NO: 10172 - protein, 7 aa, Artificial Sequence
  Synthetic construct
GSGYALF

SEQ ID NO: 10173 - protein, 7 aa, Artificial Sequence
  Synthetic construct
GSGYALY

SEQ ID NO: 10174 - protein, 7 aa, Artificial Sequence
  Synthetic construct
GSGYAAF

SEQ ID NO: 10175 - protein, 7 aa, Artificial Sequence
  Synthetic construct
GSGYAAY

SEQ ID NO: 10176 - protein, 7 aa, Artificial Sequence
  Synthetic construct
GSGYAQF

SEQ ID NO: 10177 - protein, 7 aa, Artificial Sequence
  Synthetic construct
GSGYAQY

SEQ ID NO: 10178 - protein, 7 aa, Artificial Sequence
  Synthetic construct
GSGYADF

SEQ ID NO: 10179 - protein, 7 aa, Artificial Sequence
  Synthetic construct
GSGYADY

SEQ ID NO: 10180 - protein, 7 aa, Artificial Sequence
  Synthetic construct
GSGYAVF

SEQ ID NO: 10181 - protein, 7 aa, Artificial Sequence
  Synthetic construct
GSGYAVY

SEQ ID NO: 10182 - protein, 7 aa, Artificial Sequence
  Synthetic construct
GSGYQFF

SEQ ID NO: 10183 - protein, 7 aa, Artificial Sequence
  Synthetic construct
GSGYQFY

SEQ ID NO: 10184 - protein, 7 aa, Artificial Sequence
  Synthetic construct
GSGYQRF

SEQ ID NO: 10185 - protein, 7 aa, Artificial Sequence
  Synthetic construct
GSGYQRY

SEQ ID NO: 10186 - protein, 7 aa, Artificial Sequence
  Synthetic construct
GSGYQCF

SEQ ID NO: 10187 - protein, 7 aa, Artificial Sequence
  Synthetic construct
GSGYQCY

SEQ ID NO: 10188 - protein, 7 aa, Artificial Sequence
  Synthetic construct
GSGYQLF

SEQ ID NO: 10189 - protein, 7 aa, Artificial Sequence
  Synthetic construct
GSGYQLY

SEQ ID NO: 10190 - protein, 7 aa, Artificial Sequence
  Synthetic construct
GSGYQAF

SEQ ID NO: 10191 - protein, 7 aa, Artificial Sequence
  Synthetic construct
GSGYQAY

SEQ ID NO: 10192 - protein, 7 aa, Artificial Sequence
  Synthetic construct
GSGYQQF

SEQ ID NO: 10193 - protein, 7 aa, Artificial Sequence
  Synthetic construct
GSGYQQY

SEQ ID NO: 10194 - protein, 7 aa, Artificial Sequence
  Synthetic construct
GSGYQDF

SEQ ID NO: 10195 - protein, 7 aa, Artificial Sequence
  Synthetic construct
GSGYQDY

SEQ ID NO: 10196 - protein, 7 aa, Artificial Sequence
  Synthetic construct
GSGYQVF

SEQ ID NO: 10197 - protein, 7 aa, Artificial Sequence
  Synthetic construct
GSGYQVY

SEQ ID NO: 10198 - protein, 7 aa, Artificial Sequence
  Synthetic construct
GSGPIFF

SEQ ID NO: 10199 - protein, 7 aa, Artificial Sequence
  Synthetic construct
GSGPIFY

SEQ ID NO: 10200 - protein, 7 aa, Artificial Sequence
  Synthetic construct
GSGPIRF

SEQ ID NO: 10201 - protein, 7 aa, Artificial Sequence
  Synthetic construct
GSGPIRY

SEQ ID NO: 10202 - protein, 7 aa, Artificial Sequence
  Synthetic construct
GSGPICF

SEQ ID NO: 10203 - protein, 7 aa, Artificial Sequence
  Synthetic construct
GSGPICY

SEQ ID NO: 10204 - protein, 7 aa, Artificial Sequence
  Synthetic construct
GSGPILF

SEQ ID NO: 10205 - protein, 7 aa, Artificial Sequence
  Synthetic construct
GSGPILY

SEQ ID NO: 10206 - protein, 7 aa, Artificial Sequence
  Synthetic construct
GSGPIAF

SEQ ID NO: 10207 - protein, 7 aa, Artificial Sequence
  Synthetic construct
GSGPIAY

SEQ ID NO: 10208 - protein, 7 aa, Artificial Sequence
  Synthetic construct
GSGPIQF

SEQ ID NO: 10209 - protein, 7 aa, Artificial Sequence
  Synthetic construct
GSGPIQY

SEQ ID NO: 10210 - protein, 7 aa, Artificial Sequence
  Synthetic construct
GSGPIDF

SEQ ID NO: 10211 - protein, 7 aa, Artificial Sequence
  Synthetic construct
GSGPIDY

SEQ ID NO: 10212 - protein, 7 aa, Artificial Sequence
  Synthetic construct
GSGPIVF

SEQ ID NO: 10213 - protein, 7 aa, Artificial Sequence
  Synthetic construct
GSGPIVY

SEQ ID NO: 10214 - protein, 7 aa, Artificial Sequence
  Synthetic construct
GSGPDFF

SEQ ID NO: 10215 - protein, 7 aa, Artificial Sequence
  Synthetic construct
GSGPDFY

SEQ ID NO: 10216 - protein, 7 aa, Artificial Sequence
  Synthetic construct
GSGPDRF

SEQ ID NO: 10217 - protein, 7 aa, Artificial Sequence
  Synthetic construct
GSGPDRY

SEQ ID NO: 10218 - protein, 7 aa, Artificial Sequence
  Synthetic construct
GSGPDCF

SEQ ID NO: 10219 - protein, 7 aa, Artificial Sequence
  Synthetic construct
GSGPDCY

SEQ ID NO: 10220 - protein, 7 aa, Artificial Sequence
  Synthetic construct
GSGPDLF

SEQ ID NO: 10221 - protein, 7 aa, Artificial Sequence
  Synthetic construct
GSGPDLY

SEQ ID NO: 10222 - protein, 7 aa, Artificial Sequence
  Synthetic construct
GSGPDAF

SEQ ID NO: 10223 - protein, 7 aa, Artificial Sequence
  Synthetic construct
GSGPDAY

SEQ ID NO: 10224 - protein, 7 aa, Artificial Sequence
  Synthetic construct
GSGPDQF

SEQ ID NO: 10225 - protein, 7 aa, Artificial Sequence
  Synthetic construct
GSGPDQY

SEQ ID NO: 10226 - protein, 7 aa, Artificial Sequence
  Synthetic construct
GSGPDDF

SEQ ID NO: 10227 - protein, 7 aa, Artificial Sequence
  Synthetic construct
GSGPDDY

SEQ ID NO: 10228 - protein, 7 aa, Artificial Sequence
  Synthetic construct
GSGPDVF

SEQ ID NO: 10229 - protein, 7 aa, Artificial Sequence
  Synthetic construct
GSGPDVY

SEQ ID NO: 10230 - protein, 7 aa, Artificial Sequence
  Synthetic construct
GSGPYFF

SEQ ID NO: 10231 - protein, 7 aa, Artificial Sequence
  Synthetic construct
GSGPYFY

SEQ ID NO: 10232 - protein, 7 aa, Artificial Sequence
  Synthetic construct
GSGPYRF

SEQ ID NO: 10233 - protein, 7 aa, Artificial Sequence
  Synthetic construct
GSGPYRY

SEQ ID NO: 10234 - protein, 7 aa, Artificial Sequence
  Synthetic construct
GSGPYCF

SEQ ID NO: 10235 - protein, 7 aa, Artificial Sequence
  Synthetic construct
GSGPYCY

SEQ ID NO: 10236 - protein, 7 aa, Artificial Sequence
  Synthetic construct
GSGPYLF

SEQ ID NO: 10237 - protein, 7 aa, Artificial Sequence
  Synthetic construct
GSGPYLY

SEQ ID NO: 10238 - protein, 7 aa, Artificial Sequence
  Synthetic construct
GSGPYAF

SEQ ID NO: 10239 - protein, 7 aa, Artificial Sequence
  Synthetic construct
GSGPYAY

SEQ ID NO: 10240 - protein, 7 aa, Artificial Sequence
  Synthetic construct
GSGPYQF

SEQ ID NO: 10241 - protein, 7 aa, Artificial Sequence
  Synthetic construct
GSGPYQY

SEQ ID NO: 10242 - protein, 7 aa, Artificial Sequence
  Synthetic construct
GSGPYDF

SEQ ID NO: 10243 - protein, 7 aa, Artificial Sequence
  Synthetic construct
GSGPYDY

SEQ ID NO: 10244 - protein, 7 aa, Artificial Sequence
  Synthetic construct
GSGPYVF

SEQ ID NO: 10245 - protein, 7 aa, Artificial Sequence
  Synthetic construct
GSGPYVY

SEQ ID NO: 10246 - protein, 7 aa, Artificial Sequence
  Synthetic construct
GSGPFFF

SEQ ID NO: 10247 - protein, 7 aa, Artificial Sequence
  Synthetic construct
GSGPFFY

SEQ ID NO: 10248 - protein, 7 aa, Artificial Sequence
  Synthetic construct
GSGPFRF

SEQ ID NO: 10249 - protein, 7 aa, Artificial Sequence
  Synthetic construct
GSGPFRY

SEQ ID NO: 10250 - protein, 7 aa, Artificial Sequence
  Synthetic construct
GSGPFCF

SEQ ID NO: 10251 - protein, 7 aa, Artificial Sequence
  Synthetic construct
GSGPFCY

SEQ ID NO: 10252 - protein, 7 aa, Artificial Sequence
  Synthetic construct
GSGPFLF

SEQ ID NO: 10253 - protein, 7 aa, Artificial Sequence
  Synthetic construct
GSGPFLY

SEQ ID NO: 10254 - protein, 7 aa, Artificial Sequence
  Synthetic construct
GSGPFAF

SEQ ID NO: 10255 - protein, 7 aa, Artificial Sequence
  Synthetic construct
GSGPFAY

SEQ ID NO: 10256 - protein, 7 aa, Artificial Sequence
  Synthetic construct
GSGPFQF

SEQ ID NO: 10257 - protein, 7 aa, Artificial Sequence
  Synthetic construct
GSGPFQY

SEQ ID NO: 10258 - protein, 7 aa, Artificial Sequence
  Synthetic construct
GSGPFDF

SEQ ID NO: 10259 - protein, 7 aa, Artificial Sequence
  Synthetic construct
GSGPFDY

SEQ ID NO: 10260 - protein, 7 aa, Artificial Sequence
  Synthetic construct
GSGPFVF

SEQ ID NO: 10261 - protein, 7 aa, Artificial Sequence
  Synthetic construct
GSGPFVY

SEQ ID NO: 10262 - protein, 7 aa, Artificial Sequence
  Synthetic construct
GSGPVFF

SEQ ID NO: 10263 - protein, 7 aa, Artificial Sequence
  Synthetic construct
GSGPVFY

SEQ ID NO: 10264 - protein, 7 aa, Artificial Sequence
  Synthetic construct
GSGPVRF

SEQ ID NO: 10265 - protein, 7 aa, Artificial Sequence
  Synthetic construct
GSGPVRY

SEQ ID NO: 10266 - protein, 7 aa, Artificial Sequence
  Synthetic construct
GSGPVCF

SEQ ID NO: 10267 - protein, 7 aa, Artificial Sequence
  Synthetic construct
GSGPVCY

SEQ ID NO: 10268 - protein, 7 aa, Artificial Sequence
  Synthetic construct
GSGPVLF

SEQ ID NO: 10269 - protein, 7 aa, Artificial Sequence
  Synthetic construct
GSGPVLY

SEQ ID NO: 10270 - protein, 7 aa, Artificial Sequence
  Synthetic construct
GSGPVAF

SEQ ID NO: 10271 - protein, 7 aa, Artificial Sequence
  Synthetic construct
GSGPVAY

SEQ ID NO: 10272 - protein, 7 aa, Artificial Sequence
  Synthetic construct
GSGPVQF

SEQ ID NO: 10273 - protein, 7 aa, Artificial Sequence
  Synthetic construct
GSGPVQY

SEQ ID NO: 10274 - protein, 7 aa, Artificial Sequence
  Synthetic construct
GSGPVDF

SEQ ID NO: 10275 - protein, 7 aa, Artificial Sequence
  Synthetic construct
GSGPVDY

SEQ ID NO: 10276 - protein, 7 aa, Artificial Sequence
  Synthetic construct
GSGPVVF

SEQ ID NO: 10277 - protein, 7 aa, Artificial Sequence
  Synthetic construct
GSGPVVY

SEQ ID NO: 10278 - protein, 7 aa, Artificial Sequence
  Synthetic construct
GSGPTFF

SEQ ID NO: 10279 - protein, 7 aa, Artificial Sequence
  Synthetic construct
GSGPTFY

SEQ ID NO: 10280 - protein, 7 aa, Artificial Sequence
  Synthetic construct
GSGPTRF

SEQ ID NO: 10281 - protein, 7 aa, Artificial Sequence
  Synthetic construct
GSGPTRY

SEQ ID NO: 10282 - protein, 7 aa, Artificial Sequence
  Synthetic construct
GSGPTCF

SEQ ID NO: 10283 - protein, 7 aa, Artificial Sequence
  Synthetic construct
GSGPTCY

SEQ ID NO: 10284 - protein, 7 aa, Artificial Sequence
  Synthetic construct
GSGPTLF

SEQ ID NO: 10285 - protein, 7 aa, Artificial Sequence
  Synthetic construct
GSGPTLY

SEQ ID NO: 10286 - protein, 7 aa, Artificial Sequence
  Synthetic construct
GSGPTAF

SEQ ID NO: 10287 - protein, 7 aa, Artificial Sequence
  Synthetic construct
GSGPTAY

SEQ ID NO: 10288 - protein, 7 aa, Artificial Sequence
  Synthetic construct
GSGPTQF

SEQ ID NO: 10289 - protein, 7 aa, Artificial Sequence
  Synthetic construct
GSGPTQY

SEQ ID NO: 10290 - protein, 7 aa, Artificial Sequence
  Synthetic construct
GSGPTDF

SEQ ID NO: 10291 - protein, 7 aa, Artificial Sequence
  Synthetic construct
GSGPTDY

SEQ ID NO: 10292 - protein, 7 aa, Artificial Sequence
  Synthetic construct
GSGPTVF

SEQ ID NO: 10293 - protein, 7 aa, Artificial Sequence
  Synthetic construct
GSGPTVY

SEQ ID NO: 10294 - protein, 7 aa, Artificial Sequence
  Synthetic construct
GSGPGFF

SEQ ID NO: 10295 - protein, 7 aa, Artificial Sequence
  Synthetic construct
GSGPGFY

SEQ ID NO: 10296 - protein, 7 aa, Artificial Sequence
  Synthetic construct
GSGPGRF

SEQ ID NO: 10297 - protein, 7 aa, Artificial Sequence
  Synthetic construct
GSGPGRY

SEQ ID NO: 10298 - protein, 7 aa, Artificial Sequence
  Synthetic construct
GSGPGCF

SEQ ID NO: 10299 - protein, 7 aa, Artificial Sequence
  Synthetic construct
GSGPGCY

SEQ ID NO: 10300 - protein, 7 aa, Artificial Sequence
  Synthetic construct
GSGPGLF

SEQ ID NO: 10301 - protein, 7 aa, Artificial Sequence
  Synthetic construct
GSGPGLY

SEQ ID NO: 10302 - protein, 7 aa, Artificial Sequence
  Synthetic construct
GSGPGAF

SEQ ID NO: 10303 - protein, 7 aa, Artificial Sequence
  Synthetic construct
GSGPGAY

SEQ ID NO: 10304 - protein, 7 aa, Artificial Sequence
  Synthetic construct
GSGPGQF

SEQ ID NO: 10305 - protein, 7 aa, Artificial Sequence
  Synthetic construct
GSGPGQY

SEQ ID NO: 10306 - protein, 7 aa, Artificial Sequence
  Synthetic construct
GSGPGDF

SEQ ID NO: 10307 - protein, 7 aa, Artificial Sequence
  Synthetic construct
GSGPGDY

SEQ ID NO: 10308 - protein, 7 aa, Artificial Sequence
  Synthetic construct
GSGPGVF

SEQ ID NO: 10309 - protein, 7 aa, Artificial Sequence
  Synthetic construct
GSGPGVY

SEQ ID NO: 10310 - protein, 7 aa, Artificial Sequence
  Synthetic construct
GSGPAFF

SEQ ID NO: 10311 - protein, 7 aa, Artificial Sequence
  Synthetic construct
GSGPAFY

SEQ ID NO: 10312 - protein, 7 aa, Artificial Sequence
  Synthetic construct
GSGPARF

SEQ ID NO: 10313 - protein, 7 aa, Artificial Sequence
  Synthetic construct
GSGPARY

SEQ ID NO: 10314 - protein, 7 aa, Artificial Sequence
  Synthetic construct
GSGPACF

SEQ ID NO: 10315 - protein, 7 aa, Artificial Sequence
  Synthetic construct
GSGPACY

SEQ ID NO: 10316 - protein, 7 aa, Artificial Sequence
  Synthetic construct
GSGPALF

SEQ ID NO: 10317 - protein, 7 aa, Artificial Sequence
  Synthetic construct
GSGPALY

SEQ ID NO: 10318 - protein, 7 aa, Artificial Sequence
  Synthetic construct
GSGPAAF

SEQ ID NO: 10319 - protein, 7 aa, Artificial Sequence
  Synthetic construct
GSGPAAY

SEQ ID NO: 10320 - protein, 7 aa, Artificial Sequence
  Synthetic construct
GSGPAQF

SEQ ID NO: 10321 - protein, 7 aa, Artificial Sequence
  Synthetic construct
GSGPAQY

SEQ ID NO: 10322 - protein, 7 aa, Artificial Sequence
  Synthetic construct
GSGPADF

SEQ ID NO: 10323 - protein, 7 aa, Artificial Sequence
  Synthetic construct
GSGPADY

SEQ ID NO: 10324 - protein, 7 aa, Artificial Sequence
  Synthetic construct
GSGPAVF

SEQ ID NO: 10325 - protein, 7 aa, Artificial Sequence
  Synthetic construct
GSGPAVY

SEQ ID NO: 10326 - protein, 7 aa, Artificial Sequence
  Synthetic construct
GSGPQFF

SEQ ID NO: 10327 - protein, 7 aa, Artificial Sequence
  Synthetic construct
GSGPQFY

SEQ ID NO: 10328 - protein, 7 aa, Artificial Sequence
  Synthetic construct
GSGPQRF

SEQ ID NO: 10329 - protein, 7 aa, Artificial Sequence
  Synthetic construct
GSGPQRY

SEQ ID NO: 10330 - protein, 7 aa, Artificial Sequence
  Synthetic construct
GSGPQCF

SEQ ID NO: 10331 - protein, 7 aa, Artificial Sequence
  Synthetic construct
GSGPQCY

SEQ ID NO: 10332 - protein, 7 aa, Artificial Sequence
  Synthetic construct
GSGPQLF

SEQ ID NO: 10333 - protein, 7 aa, Artificial Sequence
  Synthetic construct
GSGPQLY

SEQ ID NO: 10334 - protein, 7 aa, Artificial Sequence
  Synthetic construct
GSGPQAF

SEQ ID NO: 10335 - protein, 7 aa, Artificial Sequence
  Synthetic construct
GSGPQAY

SEQ ID NO: 10336 - protein, 7 aa, Artificial Sequence
  Synthetic construct
GSGPQQF

SEQ ID NO: 10337 - protein, 7 aa, Artificial Sequence
  Synthetic construct
GSGPQQY

SEQ ID NO: 10338 - protein, 7 aa, Artificial Sequence
  Synthetic construct
GSGPQDF

SEQ ID NO: 10339 - protein, 7 aa, Artificial Sequence
  Synthetic construct
GSGPQDY

SEQ ID NO: 10340 - protein, 7 aa, Artificial Sequence
  Synthetic construct
GSGPQVF

SEQ ID NO: 10341 - protein, 7 aa, Artificial Sequence
  Synthetic construct
GSGPQVY

SEQ ID NO: 10342 - protein, 7 aa, Artificial Sequence
  Synthetic construct
GSGHIFF

SEQ ID NO: 10343 - protein, 7 aa, Artificial Sequence
  Synthetic construct
GSGHIFY

SEQ ID NO: 10344 - protein, 7 aa, Artificial Sequence
  Synthetic construct
GSGHIRF

SEQ ID NO: 10345 - protein, 7 aa, Artificial Sequence
  Synthetic construct
GSGHIRY

SEQ ID NO: 10346 - protein, 7 aa, Artificial Sequence
  Synthetic construct
GSGHICF

SEQ ID NO: 10347 - protein, 7 aa, Artificial Sequence
  Synthetic construct
GSGHICY

SEQ ID NO: 10348 - protein, 7 aa, Artificial Sequence
  Synthetic construct
GSGHILF

SEQ ID NO: 10349 - protein, 7 aa, Artificial Sequence
  Synthetic construct
GSGHILY

SEQ ID NO: 10350 - protein, 7 aa, Artificial Sequence
  Synthetic construct
GSGHIAF

SEQ ID NO: 10351 - protein, 7 aa, Artificial Sequence
  Synthetic construct
GSGHIAY

SEQ ID NO: 10352 - protein, 7 aa, Artificial Sequence
  Synthetic construct
GSGHIQF

SEQ ID NO: 10353 - protein, 7 aa, Artificial Sequence
  Synthetic construct
GSGHIQY

SEQ ID NO: 10354 - protein, 7 aa, Artificial Sequence
  Synthetic construct
GSGHIDF

SEQ ID NO: 10355 - protein, 7 aa, Artificial Sequence
  Synthetic construct
GSGHIDY

SEQ ID NO: 10356 - protein, 7 aa, Artificial Sequence
  Synthetic construct
GSGHIVF

SEQ ID NO: 10357 - protein, 7 aa, Artificial Sequence
  Synthetic construct
GSGHIVY

SEQ ID NO: 10358 - protein, 7 aa, Artificial Sequence
  Synthetic construct
GSGHDFF

SEQ ID NO: 10359 - protein, 7 aa, Artificial Sequence
  Synthetic construct
GSGHDFY

SEQ ID NO: 10360 - protein, 7 aa, Artificial Sequence
  Synthetic construct
GSGHDRF

SEQ ID NO: 10361 - protein, 7 aa, Artificial Sequence
  Synthetic construct
GSGHDRY

SEQ ID NO: 10362 - protein, 7 aa, Artificial Sequence
  Synthetic construct
GSGHDCF

SEQ ID NO: 10363 - protein, 7 aa, Artificial Sequence
  Synthetic construct
GSGHDCY

SEQ ID NO: 10364 - protein, 7 aa, Artificial Sequence
  Synthetic construct
GSGHDLF

SEQ ID NO: 10365 - protein, 7 aa, Artificial Sequence
  Synthetic construct
GSGHDLY

SEQ ID NO: 10366 - protein, 7 aa, Artificial Sequence
  Synthetic construct
GSGHDAF

SEQ ID NO: 10367 - protein, 7 aa, Artificial Sequence
  Synthetic construct
GSGHDAY

SEQ ID NO: 10368 - protein, 7 aa, Artificial Sequence
  Synthetic construct
GSGHDQF

SEQ ID NO: 10369 - protein, 7 aa, Artificial Sequence
  Synthetic construct
GSGHDQY

SEQ ID NO: 10370 - protein, 7 aa, Artificial Sequence
  Synthetic construct
GSGHDDF

SEQ ID NO: 10371 - protein, 7 aa, Artificial Sequence
  Synthetic construct
GSGHDDY

SEQ ID NO: 10372 - protein, 7 aa, Artificial Sequence
  Synthetic construct
GSGHDVF

SEQ ID NO: 10373 - protein, 7 aa, Artificial Sequence
  Synthetic construct
GSGHDVY

SEQ ID NO: 10374 - protein, 7 aa, Artificial Sequence
  Synthetic construct
GSGHYFF

SEQ ID NO: 10375 - protein, 7 aa, Artificial Sequence
  Synthetic construct
GSGHYFY

SEQ ID NO: 10376 - protein, 7 aa, Artificial Sequence
  Synthetic construct
GSGHYRF

SEQ ID NO: 10377 - protein, 7 aa, Artificial Sequence
  Synthetic construct
GSGHYRY

SEQ ID NO: 10378 - protein, 7 aa, Artificial Sequence
  Synthetic construct
GSGHYCF

SEQ ID NO: 10379 - protein, 7 aa, Artificial Sequence
  Synthetic construct
GSGHYCY

SEQ ID NO: 10380 - protein, 7 aa, Artificial Sequence
  Synthetic construct
GSGHYLF

SEQ ID NO: 10381 - protein, 7 aa, Artificial Sequence
  Synthetic construct
GSGHYLY

SEQ ID NO: 10382 - protein, 7 aa, Artificial Sequence
  Synthetic construct
GSGHYAF

SEQ ID NO: 10383 - protein, 7 aa, Artificial Sequence
  Synthetic construct
GSGHYAY

SEQ ID NO: 10384 - protein, 7 aa, Artificial Sequence
  Synthetic construct
GSGHYQF

SEQ ID NO: 10385 - protein, 7 aa, Artificial Sequence
  Synthetic construct
GSGHYQY

SEQ ID NO: 10386 - protein, 7 aa, Artificial Sequence
  Synthetic construct
GSGHYDF

SEQ ID NO: 10387 - protein, 7 aa, Artificial Sequence
  Synthetic construct
GSGHYDY

SEQ ID NO: 10388 - protein, 7 aa, Artificial Sequence
  Synthetic construct
GSGHYVF

SEQ ID NO: 10389 - protein, 7 aa, Artificial Sequence
  Synthetic construct
GSGHYVY

SEQ ID NO: 10390 - protein, 7 aa, Artificial Sequence
  Synthetic construct
GSGHFFF

SEQ ID NO: 10391 - protein, 7 aa, Artificial Sequence
  Synthetic construct
GSGHFFY

SEQ ID NO: 10392 - protein, 7 aa, Artificial Sequence
  Synthetic construct
GSGHFRF

SEQ ID NO: 10393 - protein, 7 aa, Artificial Sequence
  Synthetic construct
GSGHFRY

SEQ ID NO: 10394 - protein, 7 aa, Artificial Sequence
  Synthetic construct
GSGHFCF

SEQ ID NO: 10395 - protein, 7 aa, Artificial Sequence
  Synthetic construct
GSGHFCY

SEQ ID NO: 10396 - protein, 7 aa, Artificial Sequence
  Synthetic construct
GSGHFLF

SEQ ID NO: 10397 - protein, 7 aa, Artificial Sequence
  Synthetic construct
GSGHFLY

SEQ ID NO: 10398 - protein, 7 aa, Artificial Sequence
  Synthetic construct
GSGHFAF

SEQ ID NO: 10399 - protein, 7 aa, Artificial Sequence
  Synthetic construct
GSGHFAY

SEQ ID NO: 10400 - protein, 7 aa, Artificial Sequence
  Synthetic construct
GSGHFQF

SEQ ID NO: 10401 - protein, 7 aa, Artificial Sequence
  Synthetic construct
GSGHFQY

SEQ ID NO: 10402 - protein, 7 aa, Artificial Sequence
  Synthetic construct
GSGHFDF

SEQ ID NO: 10403 - protein, 7 aa, Artificial Sequence
  Synthetic construct
GSGHFDY

SEQ ID NO: 10404 - protein, 7 aa, Artificial Sequence
  Synthetic construct
GSGHFVF

SEQ ID NO: 10405 - protein, 7 aa, Artificial Sequence
  Synthetic construct
GSGHFVY

SEQ ID NO: 10406 - protein, 7 aa, Artificial Sequence
  Synthetic construct
GSGHVFF

SEQ ID NO: 10407 - protein, 7 aa, Artificial Sequence
  Synthetic construct
GSGHVFY

SEQ ID NO: 10408 - protein, 7 aa, Artificial Sequence
  Synthetic construct
GSGHVRF

SEQ ID NO: 10409 - protein, 7 aa, Artificial Sequence
  Synthetic construct
GSGHVRY

SEQ ID NO: 10410 - protein, 7 aa, Artificial Sequence
  Synthetic construct
GSGHVCF

SEQ ID NO: 10411 - protein, 7 aa, Artificial Sequence
  Synthetic construct
GSGHVCY

SEQ ID NO: 10412 - protein, 7 aa, Artificial Sequence
  Synthetic construct
GSGHVLF

SEQ ID NO: 10413 - protein, 7 aa, Artificial Sequence
  Synthetic construct
GSGHVLY

SEQ ID NO: 10414 - protein, 7 aa, Artificial Sequence
  Synthetic construct
GSGHVAF

SEQ ID NO: 10415 - protein, 7 aa, Artificial Sequence
  Synthetic construct
GSGHVAY

SEQ ID NO: 10416 - protein, 7 aa, Artificial Sequence
  Synthetic construct
GSGHVQF

SEQ ID NO: 10417 - protein, 7 aa, Artificial Sequence
  Synthetic construct
GSGHVQY

SEQ ID NO: 10418 - protein, 7 aa, Artificial Sequence
  Synthetic construct
GSGHVDF

SEQ ID NO: 10419 - protein, 7 aa, Artificial Sequence
  Synthetic construct
GSGHVDY

SEQ ID NO: 10420 - protein, 7 aa, Artificial Sequence
  Synthetic construct
GSGHVVF

SEQ ID NO: 10421 - protein, 7 aa, Artificial Sequence
  Synthetic construct
GSGHVVY

SEQ ID NO: 10422 - protein, 7 aa, Artificial Sequence
  Synthetic construct
GSGHTFF

SEQ ID NO: 10423 - protein, 7 aa, Artificial Sequence
  Synthetic construct
GSGHTFY

SEQ ID NO: 10424 - protein, 7 aa, Artificial Sequence
  Synthetic construct
GSGHTRF

SEQ ID NO: 10425 - protein, 7 aa, Artificial Sequence
  Synthetic construct
GSGHTRY

SEQ ID NO: 10426 - protein, 7 aa, Artificial Sequence
  Synthetic construct
GSGHTCF

SEQ ID NO: 10427 - protein, 7 aa, Artificial Sequence
  Synthetic construct
GSGHTCY

SEQ ID NO: 10428 - protein, 7 aa, Artificial Sequence
  Synthetic construct
GSGHTLF

SEQ ID NO: 10429 - protein, 7 aa, Artificial Sequence
  Synthetic construct
GSGHTLY

SEQ ID NO: 10430 - protein, 7 aa, Artificial Sequence
  Synthetic construct
GSGHTAF

SEQ ID NO: 10431 - protein, 7 aa, Artificial Sequence
  Synthetic construct
GSGHTAY

SEQ ID NO: 10432 - protein, 7 aa, Artificial Sequence
  Synthetic construct
GSGHTQF

SEQ ID NO: 10433 - protein, 7 aa, Artificial Sequence
  Synthetic construct
GSGHTQY

SEQ ID NO: 10434 - protein, 7 aa, Artificial Sequence
  Synthetic construct
GSGHTDF

SEQ ID NO: 10435 - protein, 7 aa, Artificial Sequence
  Synthetic construct
GSGHTDY

SEQ ID NO: 10436 - protein, 7 aa, Artificial Sequence
  Synthetic construct
GSGHTVF

SEQ ID NO: 10437 - protein, 7 aa, Artificial Sequence
  Synthetic construct
GSGHTVY

SEQ ID NO: 10438 - protein, 7 aa, Artificial Sequence
  Synthetic construct
GSGHGFF

SEQ ID NO: 10439 - protein, 7 aa, Artificial Sequence
  Synthetic construct
GSGHGFY

SEQ ID NO: 10440 - protein, 7 aa, Artificial Sequence
  Synthetic construct
GSGHGRF

SEQ ID NO: 10441 - protein, 7 aa, Artificial Sequence
  Synthetic construct
GSGHGRY

SEQ ID NO: 10442 - protein, 7 aa, Artificial Sequence
  Synthetic construct
GSGHGCF

SEQ ID NO: 10443 - protein, 7 aa, Artificial Sequence
  Synthetic construct
GSGHGCY

SEQ ID NO: 10444 - protein, 7 aa, Artificial Sequence
  Synthetic construct
GSGHGLF

SEQ ID NO: 10445 - protein, 7 aa, Artificial Sequence
  Synthetic construct
GSGHGLY

SEQ ID NO: 10446 - protein, 7 aa, Artificial Sequence
  Synthetic construct
GSGHGAF

SEQ ID NO: 10447 - protein, 7 aa, Artificial Sequence
  Synthetic construct
GSGHGAY

SEQ ID NO: 10448 - protein, 7 aa, Artificial Sequence
  Synthetic construct
GSGHGQF

SEQ ID NO: 10449 - protein, 7 aa, Artificial Sequence
  Synthetic construct
GSGHGQY

SEQ ID NO: 10450 - protein, 7 aa, Artificial Sequence
  Synthetic construct
GSGHGDF

SEQ ID NO: 10451 - protein, 7 aa, Artificial Sequence
  Synthetic construct
GSGHGDY

SEQ ID NO: 10452 - protein, 7 aa, Artificial Sequence
  Synthetic construct
GSGHGVF

SEQ ID NO: 10453 - protein, 7 aa, Artificial Sequence
  Synthetic construct
GSGHGVY

SEQ ID NO: 10454 - protein, 7 aa, Artificial Sequence
  Synthetic construct
GSGHAFF

SEQ ID NO: 10455 - protein, 7 aa, Artificial Sequence
  Synthetic construct
GSGHAFY

SEQ ID NO: 10456 - protein, 7 aa, Artificial Sequence
  Synthetic construct
GSGHARF

SEQ ID NO: 10457 - protein, 7 aa, Artificial Sequence
  Synthetic construct
GSGHARY

SEQ ID NO: 10458 - protein, 7 aa, Artificial Sequence
  Synthetic construct
GSGHACF

SEQ ID NO: 10459 - protein, 7 aa, Artificial Sequence
  Synthetic construct
GSGHACY

SEQ ID NO: 10460 - protein, 7 aa, Artificial Sequence
  Synthetic construct
GSGHALF

SEQ ID NO: 10461 - protein, 7 aa, Artificial Sequence
  Synthetic construct
GSGHALY

SEQ ID NO: 10462 - protein, 7 aa, Artificial Sequence
  Synthetic construct
GSGHAAF

SEQ ID NO: 10463 - protein, 7 aa, Artificial Sequence
  Synthetic construct
GSGHAAY

SEQ ID NO: 10464 - protein, 7 aa, Artificial Sequence
  Synthetic construct
GSGHAQF

SEQ ID NO: 10465 - protein, 7 aa, Artificial Sequence
  Synthetic construct
GSGHAQY

SEQ ID NO: 10466 - protein, 7 aa, Artificial Sequence
  Synthetic construct
GSGHADF

SEQ ID NO: 10467 - protein, 7 aa, Artificial Sequence
  Synthetic construct
GSGHADY

SEQ ID NO: 10468 - protein, 7 aa, Artificial Sequence
  Synthetic construct
GSGHAVF

SEQ ID NO: 10469 - protein, 7 aa, Artificial Sequence
  Synthetic construct
GSGHAVY

SEQ ID NO: 10470 - protein, 7 aa, Artificial Sequence
  Synthetic construct
GSGHQFF

SEQ ID NO: 10471 - protein, 7 aa, Artificial Sequence
  Synthetic construct
GSGHQFY

SEQ ID NO: 10472 - protein, 7 aa, Artificial Sequence
  Synthetic construct
GSGHQRF

SEQ ID NO: 10473 - protein, 7 aa, Artificial Sequence
  Synthetic construct
GSGHQRY

SEQ ID NO: 10474 - protein, 7 aa, Artificial Sequence
  Synthetic construct
GSGHQCF

SEQ ID NO: 10475 - protein, 7 aa, Artificial Sequence
  Synthetic construct
GSGHQCY

SEQ ID NO: 10476 - protein, 7 aa, Artificial Sequence
  Synthetic construct
GSGHQLF

SEQ ID NO: 10477 - protein, 7 aa, Artificial Sequence
  Synthetic construct
GSGHQLY

SEQ ID NO: 10478 - protein, 7 aa, Artificial Sequence
  Synthetic construct
GSGHQAF

SEQ ID NO: 10479 - protein, 7 aa, Artificial Sequence
  Synthetic construct
GSGHQAY

SEQ ID NO: 10480 - protein, 7 aa, Artificial Sequence
  Synthetic construct
GSGHQQF

SEQ ID NO: 10481 - protein, 7 aa, Artificial Sequence
  Synthetic construct
GSGHQQY

SEQ ID NO: 10482 - protein, 7 aa, Artificial Sequence
  Synthetic construct
GSGHQDF

SEQ ID NO: 10483 - protein, 7 aa, Artificial Sequence
  Synthetic construct
GSGHQDY

SEQ ID NO: 10484 - protein, 7 aa, Artificial Sequence
  Synthetic construct
GSGHQVF

SEQ ID NO: 10485 - protein, 7 aa, Artificial Sequence
  Synthetic construct
GSGHQVY

SEQ ID NO: 10486 - protein, 7 aa, Artificial Sequence
  Synthetic construct
GSGLIFF

SEQ ID NO: 10487 - protein, 7 aa, Artificial Sequence
  Synthetic construct
GSGLIFY

SEQ ID NO: 10488 - protein, 7 aa, Artificial Sequence
  Synthetic construct
GSGLIRF

SEQ ID NO: 10489 - protein, 7 aa, Artificial Sequence
  Synthetic construct
GSGLIRY

SEQ ID NO: 10490 - protein, 7 aa, Artificial Sequence
  Synthetic construct
GSGLICF

SEQ ID NO: 10491 - protein, 7 aa, Artificial Sequence
  Synthetic construct
GSGLICY

SEQ ID NO: 10492 - protein, 7 aa, Artificial Sequence
  Synthetic construct
GSGLILF

SEQ ID NO: 10493 - protein, 7 aa, Artificial Sequence
  Synthetic construct
GSGLILY

SEQ ID NO: 10494 - protein, 7 aa, Artificial Sequence
  Synthetic construct
GSGLIAF

SEQ ID NO: 10495 - protein, 7 aa, Artificial Sequence
  Synthetic construct
GSGLIAY

SEQ ID NO: 10496 - protein, 7 aa, Artificial Sequence
  Synthetic construct
GSGLIQF

SEQ ID NO: 10497 - protein, 7 aa, Artificial Sequence
  Synthetic construct
GSGLIQY

SEQ ID NO: 10498 - protein, 7 aa, Artificial Sequence
  Synthetic construct
GSGLIDF

SEQ ID NO: 10499 - protein, 7 aa, Artificial Sequence
  Synthetic construct
GSGLIDY

SEQ ID NO: 10500 - protein, 7 aa, Artificial Sequence
  Synthetic construct
GSGLIVF

SEQ ID NO: 10501 - protein, 7 aa, Artificial Sequence
  Synthetic construct
GSGLIVY

SEQ ID NO: 10502 - protein, 7 aa, Artificial Sequence
  Synthetic construct
GSGLDFF

SEQ ID NO: 10503 - protein, 7 aa, Artificial Sequence
  Synthetic construct
GSGLDFY

SEQ ID NO: 10504 - protein, 7 aa, Artificial Sequence
  Synthetic construct
GSGLDRF

SEQ ID NO: 10505 - protein, 7 aa, Artificial Sequence
  Synthetic construct
GSGLDRY

SEQ ID NO: 10506 - protein, 7 aa, Artificial Sequence
  Synthetic construct
GSGLDCF

SEQ ID NO: 10507 - protein, 7 aa, Artificial Sequence
  Synthetic construct
GSGLDCY

SEQ ID NO: 10508 - protein, 7 aa, Artificial Sequence
  Synthetic construct
GSGLDLF

SEQ ID NO: 10509 - protein, 7 aa, Artificial Sequence
  Synthetic construct
GSGLDLY

SEQ ID NO: 10510 - protein, 7 aa, Artificial Sequence
  Synthetic construct
GSGLDAF

SEQ ID NO: 10511 - protein, 7 aa, Artificial Sequence
  Synthetic construct
GSGLDAY

SEQ ID NO: 10512 - protein, 7 aa, Artificial Sequence
  Synthetic construct
GSGLDQF

SEQ ID NO: 10513 - protein, 7 aa, Artificial Sequence
  Synthetic construct
GSGLDQY

SEQ ID NO: 10514 - protein, 7 aa, Artificial Sequence
  Synthetic construct
GSGLDDF

SEQ ID NO: 10515 - protein, 7 aa, Artificial Sequence
  Synthetic construct
GSGLDDY

SEQ ID NO: 10516 - protein, 7 aa, Artificial Sequence
  Synthetic construct
GSGLDVF

SEQ ID NO: 10517 - protein, 7 aa, Artificial Sequence
  Synthetic construct
GSGLDVY

SEQ ID NO: 10518 - protein, 7 aa, Artificial Sequence
  Synthetic construct
GSGLYFF

SEQ ID NO: 10519 - protein, 7 aa, Artificial Sequence
  Synthetic construct
GSGLYFY

SEQ ID NO: 10520 - protein, 7 aa, Artificial Sequence
  Synthetic construct
GSGLYRF

SEQ ID NO: 10521 - protein, 7 aa, Artificial Sequence
  Synthetic construct
GSGLYRY

SEQ ID NO: 10522 - protein, 7 aa, Artificial Sequence
  Synthetic construct
GSGLYCF

SEQ ID NO: 10523 - protein, 7 aa, Artificial Sequence
  Synthetic construct
GSGLYCY

SEQ ID NO: 10524 - protein, 7 aa, Artificial Sequence
  Synthetic construct
GSGLYLF

SEQ ID NO: 10525 - protein, 7 aa, Artificial Sequence
  Synthetic construct
GSGLYLY

SEQ ID NO: 10526 - protein, 7 aa, Artificial Sequence
  Synthetic construct
GSGLYAF

SEQ ID NO: 10527 - protein, 7 aa, Artificial Sequence
  Synthetic construct
GSGLYAY

SEQ ID NO: 10528 - protein, 7 aa, Artificial Sequence
  Synthetic construct
GSGLYQF

SEQ ID NO: 10529 - protein, 7 aa, Artificial Sequence
  Synthetic construct
GSGLYQY

SEQ ID NO: 10530 - protein, 7 aa, Artificial Sequence
  Synthetic construct
GSGLYDF

SEQ ID NO: 10531 - protein, 7 aa, Artificial Sequence
  Synthetic construct
GSGLYDY

SEQ ID NO: 10532 - protein, 7 aa, Artificial Sequence
  Synthetic construct
GSGLYVF

SEQ ID NO: 10533 - protein, 7 aa, Artificial Sequence
  Synthetic construct
GSGLYVY

SEQ ID NO: 10534 - protein, 7 aa, Artificial Sequence
  Synthetic construct
GSGLFFF

SEQ ID NO: 10535 - protein, 7 aa, Artificial Sequence
  Synthetic construct
GSGLFFY

SEQ ID NO: 10536 - protein, 7 aa, Artificial Sequence
  Synthetic construct
GSGLFRF

SEQ ID NO: 10537 - protein, 7 aa, Artificial Sequence
  Synthetic construct
GSGLFRY

SEQ ID NO: 10538 - protein, 7 aa, Artificial Sequence
  Synthetic construct
GSGLFCF

SEQ ID NO: 10539 - protein, 7 aa, Artificial Sequence
  Synthetic construct
GSGLFCY

SEQ ID NO: 10540 - protein, 7 aa, Artificial Sequence
  Synthetic construct
GSGLFLF

SEQ ID NO: 10541 - protein, 7 aa, Artificial Sequence
  Synthetic construct
GSGLFLY

SEQ ID NO: 10542 - protein, 7 aa, Artificial Sequence
  Synthetic construct
GSGLFAF

SEQ ID NO: 10543 - protein, 7 aa, Artificial Sequence
  Synthetic construct
GSGLFAY

SEQ ID NO: 10544 - protein, 7 aa, Artificial Sequence
  Synthetic construct
GSGLFQF

SEQ ID NO: 10545 - protein, 7 aa, Artificial Sequence
  Synthetic construct
GSGLFQY

SEQ ID NO: 10546 - protein, 7 aa, Artificial Sequence
  Synthetic construct
GSGLFDF

SEQ ID NO: 10547 - protein, 7 aa, Artificial Sequence
  Synthetic construct
GSGLFDY

SEQ ID NO: 10548 - protein, 7 aa, Artificial Sequence
  Synthetic construct
GSGLFVF

SEQ ID NO: 10549 - protein, 7 aa, Artificial Sequence
  Synthetic construct
GSGLFVY

SEQ ID NO: 10550 - protein, 7 aa, Artificial Sequence
  Synthetic construct
GSGLVFF

SEQ ID NO: 10551 - protein, 7 aa, Artificial Sequence
  Synthetic construct
GSGLVFY

SEQ ID NO: 10552 - protein, 7 aa, Artificial Sequence
  Synthetic construct
GSGLVRF

SEQ ID NO: 10553 - protein, 7 aa, Artificial Sequence
  Synthetic construct
GSGLVRY

SEQ ID NO: 10554 - protein, 7 aa, Artificial Sequence
  Synthetic construct
GSGLVCF

SEQ ID NO: 10555 - protein, 7 aa, Artificial Sequence
  Synthetic construct
GSGLVCY

SEQ ID NO: 10556 - protein, 7 aa, Artificial Sequence
  Synthetic construct
GSGLVLF

SEQ ID NO: 10557 - protein, 7 aa, Artificial Sequence
  Synthetic construct
GSGLVLY

SEQ ID NO: 10558 - protein, 7 aa, Artificial Sequence
  Synthetic construct
GSGLVAF

SEQ ID NO: 10559 - protein, 7 aa, Artificial Sequence
  Synthetic construct
GSGLVAY

SEQ ID NO: 10560 - protein, 7 aa, Artificial Sequence
  Synthetic construct
GSGLVQF

SEQ ID NO: 10561 - protein, 7 aa, Artificial Sequence
  Synthetic construct
GSGLVQY

SEQ ID NO: 10562 - protein, 7 aa, Artificial Sequence
  Synthetic construct
GSGLVDF

SEQ ID NO: 10563 - protein, 7 aa, Artificial Sequence
  Synthetic construct
GSGLVDY

SEQ ID NO: 10564 - protein, 7 aa, Artificial Sequence
  Synthetic construct
GSGLVVF

SEQ ID NO: 10565 - protein, 7 aa, Artificial Sequence
  Synthetic construct
GSGLVVY

SEQ ID NO: 10566 - protein, 7 aa, Artificial Sequence
  Synthetic construct
GSGLTFF

SEQ ID NO: 10567 - protein, 7 aa, Artificial Sequence
  Synthetic construct
GSGLTFY

SEQ ID NO: 10568 - protein, 7 aa, Artificial Sequence
  Synthetic construct
GSGLTRF

SEQ ID NO: 10569 - protein, 7 aa, Artificial Sequence
  Synthetic construct
GSGLTRY

SEQ ID NO: 10570 - protein, 7 aa, Artificial Sequence
  Synthetic construct
GSGLTCF

SEQ ID NO: 10571 - protein, 7 aa, Artificial Sequence
  Synthetic construct
GSGLTCY

SEQ ID NO: 10572 - protein, 7 aa, Artificial Sequence
  Synthetic construct
GSGLTLF

SEQ ID NO: 10573 - protein, 7 aa, Artificial Sequence
  Synthetic construct
GSGLTLY

SEQ ID NO: 10574 - protein, 7 aa, Artificial Sequence
  Synthetic construct
GSGLTAF

SEQ ID NO: 10575 - protein, 7 aa, Artificial Sequence
  Synthetic construct
GSGLTAY

SEQ ID NO: 10576 - protein, 7 aa, Artificial Sequence
  Synthetic construct
GSGLTQF

SEQ ID NO: 10577 - protein, 7 aa, Artificial Sequence
  Synthetic construct
GSGLTQY

SEQ ID NO: 10578 - protein, 7 aa, Artificial Sequence
  Synthetic construct
GSGLTDF

SEQ ID NO: 10579 - protein, 7 aa, Artificial Sequence
  Synthetic construct
GSGLTDY

SEQ ID NO: 10580 - protein, 7 aa, Artificial Sequence
  Synthetic construct
GSGLTVF

SEQ ID NO: 10581 - protein, 7 aa, Artificial Sequence
  Synthetic construct
GSGLTVY

SEQ ID NO: 10582 - protein, 7 aa, Artificial Sequence
  Synthetic construct
GSGLGFF

SEQ ID NO: 10583 - protein, 7 aa, Artificial Sequence
  Synthetic construct
GSGLGFY

SEQ ID NO: 10584 - protein, 7 aa, Artificial Sequence
  Synthetic construct
GSGLGRF

SEQ ID NO: 10585 - protein, 7 aa, Artificial Sequence
  Synthetic construct
GSGLGRY

SEQ ID NO: 10586 - protein, 7 aa, Artificial Sequence
  Synthetic construct
GSGLGCF

SEQ ID NO: 10587 - protein, 7 aa, Artificial Sequence
  Synthetic construct
GSGLGCY

SEQ ID NO: 10588 - protein, 7 aa, Artificial Sequence
  Synthetic construct
GSGLGLF

SEQ ID NO: 10589 - protein, 7 aa, Artificial Sequence
  Synthetic construct
GSGLGLY

SEQ ID NO: 10590 - protein, 7 aa, Artificial Sequence
  Synthetic construct
GSGLGAF

SEQ ID NO: 10591 - protein, 7 aa, Artificial Sequence
  Synthetic construct
GSGLGAY

SEQ ID NO: 10592 - protein, 7 aa, Artificial Sequence
  Synthetic construct
GSGLGQF

SEQ ID NO: 10593 - protein, 7 aa, Artificial Sequence
  Synthetic construct
GSGLGQY

SEQ ID NO: 10594 - protein, 7 aa, Artificial Sequence
  Synthetic construct
GSGLGDF

SEQ ID NO: 10595 - protein, 7 aa, Artificial Sequence
  Synthetic construct
GSGLGDY

SEQ ID NO: 10596 - protein, 7 aa, Artificial Sequence
  Synthetic construct
GSGLGVF

SEQ ID NO: 10597 - protein, 7 aa, Artificial Sequence
  Synthetic construct
GSGLGVY

SEQ ID NO: 10598 - protein, 7 aa, Artificial Sequence
  Synthetic construct
GSGLAFF

SEQ ID NO: 10599 - protein, 7 aa, Artificial Sequence
  Synthetic construct
GSGLAFY

SEQ ID NO: 10600 - protein, 7 aa, Artificial Sequence
  Synthetic construct
GSGLARF

SEQ ID NO: 10601 - protein, 7 aa, Artificial Sequence
  Synthetic construct
GSGLARY

SEQ ID NO: 10602 - protein, 7 aa, Artificial Sequence
  Synthetic construct
GSGLACF

SEQ ID NO: 10603 - protein, 7 aa, Artificial Sequence
  Synthetic construct
GSGLACY

SEQ ID NO: 10604 - protein, 7 aa, Artificial Sequence
  Synthetic construct
GSGLALF

SEQ ID NO: 10605 - protein, 7 aa, Artificial Sequence
  Synthetic construct
GSGLALY

SEQ ID NO: 10606 - protein, 7 aa, Artificial Sequence
  Synthetic construct
GSGLAAF

SEQ ID NO: 10607 - protein, 7 aa, Artificial Sequence
  Synthetic construct
GSGLAAY

SEQ ID NO: 10608 - protein, 7 aa, Artificial Sequence
  Synthetic construct
GSGLAQF

SEQ ID NO: 10609 - protein, 7 aa, Artificial Sequence
  Synthetic construct
GSGLAQY

SEQ ID NO: 10610 - protein, 7 aa, Artificial Sequence
  Synthetic construct
GSGLADF

SEQ ID NO: 10611 - protein, 7 aa, Artificial Sequence
  Synthetic construct
GSGLADY

SEQ ID NO: 10612 - protein, 7 aa, Artificial Sequence
  Synthetic construct
GSGLAVF

SEQ ID NO: 10613 - protein, 7 aa, Artificial Sequence
  Synthetic construct
GSGLAVY

SEQ ID NO: 10614 - protein, 7 aa, Artificial Sequence
  Synthetic construct
GSGLQFF

SEQ ID NO: 10615 - protein, 7 aa, Artificial Sequence
  Synthetic construct
GSGLQFY

SEQ ID NO: 10616 - protein, 7 aa, Artificial Sequence
  Synthetic construct
GSGLQRF

SEQ ID NO: 10617 - protein, 7 aa, Artificial Sequence
  Synthetic construct
GSGLQRY

SEQ ID NO: 10618 - protein, 7 aa, Artificial Sequence
  Synthetic construct
GSGLQCF

SEQ ID NO: 10619 - protein, 7 aa, Artificial Sequence
  Synthetic construct
GSGLQCY

SEQ ID NO: 10620 - protein, 7 aa, Artificial Sequence
  Synthetic construct
GSGLQLF

SEQ ID NO: 10621 - protein, 7 aa, Artificial Sequence
  Synthetic construct
GSGLQLY

SEQ ID NO: 10622 - protein, 7 aa, Artificial Sequence
  Synthetic construct
GSGLQAF

SEQ ID NO: 10623 - protein, 7 aa, Artificial Sequence
  Synthetic construct
GSGLQAY

SEQ ID NO: 10624 - protein, 7 aa, Artificial Sequence
  Synthetic construct
GSGLQQF

SEQ ID NO: 10625 - protein, 7 aa, Artificial Sequence
  Synthetic construct
GSGLQQY

SEQ ID NO: 10626 - protein, 7 aa, Artificial Sequence
  Synthetic construct
GSGLQDF

SEQ ID NO: 10627 - protein, 7 aa, Artificial Sequence
  Synthetic construct
GSGLQDY

SEQ ID NO: 10628 - protein, 7 aa, Artificial Sequence
  Synthetic construct
GSGLQVF

SEQ ID NO: 10629 - protein, 7 aa, Artificial Sequence
  Synthetic construct
GSGLQVY

SEQ ID NO: 10630 - protein, 7 aa, Artificial Sequence
  Synthetic construct
GSGFIFF

SEQ ID NO: 10631 - protein, 7 aa, Artificial Sequence
  Synthetic construct
GSGFIFY

SEQ ID NO: 10632 - protein, 7 aa, Artificial Sequence
  Synthetic construct
GSGFIRF

SEQ ID NO: 10633 - protein, 7 aa, Artificial Sequence
  Synthetic construct
GSGFIRY

SEQ ID NO: 10634 - protein, 7 aa, Artificial Sequence
  Synthetic construct
GSGFICF

SEQ ID NO: 10635 - protein, 7 aa, Artificial Sequence
  Synthetic construct
GSGFICY

SEQ ID NO: 10636 - protein, 7 aa, Artificial Sequence
  Synthetic construct
GSGFILF

SEQ ID NO: 10637 - protein, 7 aa, Artificial Sequence
  Synthetic construct
GSGFILY

SEQ ID NO: 10638 - protein, 7 aa, Artificial Sequence
  Synthetic construct
GSGFIAF

SEQ ID NO: 10639 - protein, 7 aa, Artificial Sequence
  Synthetic construct
GSGFIAY

SEQ ID NO: 10640 - protein, 7 aa, Artificial Sequence
  Synthetic construct
GSGFIQF

SEQ ID NO: 10641 - protein, 7 aa, Artificial Sequence
  Synthetic construct
GSGFIQY

SEQ ID NO: 10642 - protein, 7 aa, Artificial Sequence
  Synthetic construct
GSGFIDF

SEQ ID NO: 10643 - protein, 7 aa, Artificial Sequence
  Synthetic construct
GSGFIDY

SEQ ID NO: 10644 - protein, 7 aa, Artificial Sequence
  Synthetic construct
GSGFIVF

SEQ ID NO: 10645 - protein, 7 aa, Artificial Sequence
  Synthetic construct
GSGFIVY

SEQ ID NO: 10646 - protein, 7 aa, Artificial Sequence
  Synthetic construct
GSGFDFF

SEQ ID NO: 10647 - protein, 7 aa, Artificial Sequence
  Synthetic construct
GSGFDFY

SEQ ID NO: 10648 - protein, 7 aa, Artificial Sequence
  Synthetic construct
GSGFDRF

SEQ ID NO: 10649 - protein, 7 aa, Artificial Sequence
  Synthetic construct
GSGFDRY

SEQ ID NO: 10650 - protein, 7 aa, Artificial Sequence
  Synthetic construct
GSGFDCF

SEQ ID NO: 10651 - protein, 7 aa, Artificial Sequence
  Synthetic construct
GSGFDCY

SEQ ID NO: 10652 - protein, 7 aa, Artificial Sequence
  Synthetic construct
GSGFDLF

SEQ ID NO: 10653 - protein, 7 aa, Artificial Sequence
  Synthetic construct
GSGFDLY

SEQ ID NO: 10654 - protein, 7 aa, Artificial Sequence
  Synthetic construct
GSGFDAF

SEQ ID NO: 10655 - protein, 7 aa, Artificial Sequence
  Synthetic construct
GSGFDAY

SEQ ID NO: 10656 - protein, 7 aa, Artificial Sequence
  Synthetic construct
GSGFDQF

SEQ ID NO: 10657 - protein, 7 aa, Artificial Sequence
  Synthetic construct
GSGFDQY

SEQ ID NO: 10658 - protein, 7 aa, Artificial Sequence
  Synthetic construct
GSGFDDF

SEQ ID NO: 10659 - protein, 7 aa, Artificial Sequence
  Synthetic construct
GSGFDDY

SEQ ID NO: 10660 - protein, 7 aa, Artificial Sequence
  Synthetic construct
GSGFDVF

SEQ ID NO: 10661 - protein, 7 aa, Artificial Sequence
  Synthetic construct
GSGFDVY

SEQ ID NO: 10662 - protein, 7 aa, Artificial Sequence
  Synthetic construct
GSGFYFF

SEQ ID NO: 10663 - protein, 7 aa, Artificial Sequence
  Synthetic construct
GSGFYFY

SEQ ID NO: 10664 - protein, 7 aa, Artificial Sequence
  Synthetic construct
GSGFYRF

SEQ ID NO: 10665 - protein, 7 aa, Artificial Sequence
  Synthetic construct
GSGFYRY

SEQ ID NO: 10666 - protein, 7 aa, Artificial Sequence
  Synthetic construct
GSGFYCF

SEQ ID NO: 10667 - protein, 7 aa, Artificial Sequence
  Synthetic construct
GSGFYCY

SEQ ID NO: 10668 - protein, 7 aa, Artificial Sequence
  Synthetic construct
GSGFYLF

SEQ ID NO: 10669 - protein, 7 aa, Artificial Sequence
  Synthetic construct
GSGFYLY

SEQ ID NO: 10670 - protein, 7 aa, Artificial Sequence
  Synthetic construct
GSGFYAF

SEQ ID NO: 10671 - protein, 7 aa, Artificial Sequence
  Synthetic construct
GSGFYAY

SEQ ID NO: 10672 - protein, 7 aa, Artificial Sequence
  Synthetic construct
GSGFYQF

SEQ ID NO: 10673 - protein, 7 aa, Artificial Sequence
  Synthetic construct
GSGFYQY

SEQ ID NO: 10674 - protein, 7 aa, Artificial Sequence
  Synthetic construct
GSGFYDF

SEQ ID NO: 10675 - protein, 7 aa, Artificial Sequence
  Synthetic construct
GSGFYDY

SEQ ID NO: 10676 - protein, 7 aa, Artificial Sequence
  Synthetic construct
GSGFYVF

SEQ ID NO: 10677 - protein, 7 aa, Artificial Sequence
  Synthetic construct
GSGFYVY

SEQ ID NO: 10678 - protein, 7 aa, Artificial Sequence
  Synthetic construct
GSGFFFF

SEQ ID NO: 10679 - protein, 7 aa, Artificial Sequence
  Synthetic construct
GSGFFFY

SEQ ID NO: 10680 - protein, 7 aa, Artificial Sequence
  Synthetic construct
GSGFFRF

SEQ ID NO: 10681 - protein, 7 aa, Artificial Sequence
  Synthetic construct
GSGFFRY

SEQ ID NO: 10682 - protein, 7 aa, Artificial Sequence
  Synthetic construct
GSGFFCF

SEQ ID NO: 10683 - protein, 7 aa, Artificial Sequence
  Synthetic construct
GSGFFCY

SEQ ID NO: 10684 - protein, 7 aa, Artificial Sequence
  Synthetic construct
GSGFFLF

SEQ ID NO: 10685 - protein, 7 aa, Artificial Sequence
  Synthetic construct
GSGFFLY

SEQ ID NO: 10686 - protein, 7 aa, Artificial Sequence
  Synthetic construct
GSGFFAF

SEQ ID NO: 10687 - protein, 7 aa, Artificial Sequence
  Synthetic construct
GSGFFAY

SEQ ID NO: 10688 - protein, 7 aa, Artificial Sequence
  Synthetic construct
GSGFFQF

SEQ ID NO: 10689 - protein, 7 aa, Artificial Sequence
  Synthetic construct
GSGFFQY

SEQ ID NO: 10690 - protein, 7 aa, Artificial Sequence
  Synthetic construct
GSGFFDF

SEQ ID NO: 10691 - protein, 7 aa, Artificial Sequence
  Synthetic construct
GSGFFDY

SEQ ID NO: 10692 - protein, 7 aa, Artificial Sequence
  Synthetic construct
GSGFFVF

SEQ ID NO: 10693 - protein, 7 aa, Artificial Sequence
  Synthetic construct
GSGFFVY

SEQ ID NO: 10694 - protein, 7 aa, Artificial Sequence
  Synthetic construct
GSGFVFF

SEQ ID NO: 10695 - protein, 7 aa, Artificial Sequence
  Synthetic construct
GSGFVFY

SEQ ID NO: 10696 - protein, 7 aa, Artificial Sequence
  Synthetic construct
GSGFVRF

SEQ ID NO: 10697 - protein, 7 aa, Artificial Sequence
  Synthetic construct
GSGFVRY

SEQ ID NO: 10698 - protein, 7 aa, Artificial Sequence
  Synthetic construct
GSGFVCF

SEQ ID NO: 10699 - protein, 7 aa, Artificial Sequence
  Synthetic construct
GSGFVCY

SEQ ID NO: 10700 - protein, 7 aa, Artificial Sequence
  Synthetic construct
GSGFVLF

SEQ ID NO: 10701 - protein, 7 aa, Artificial Sequence
  Synthetic construct
GSGFVLY

SEQ ID NO: 10702 - protein, 7 aa, Artificial Sequence
  Synthetic construct
GSGFVAF

SEQ ID NO: 10703 - protein, 7 aa, Artificial Sequence
  Synthetic construct
GSGFVAY

SEQ ID NO: 10704 - protein, 7 aa, Artificial Sequence
  Synthetic construct
GSGFVQF

SEQ ID NO: 10705 - protein, 7 aa, Artificial Sequence
  Synthetic construct
GSGFVQY

SEQ ID NO: 10706 - protein, 7 aa, Artificial Sequence
  Synthetic construct
GSGFVDF

SEQ ID NO: 10707 - protein, 7 aa, Artificial Sequence
  Synthetic construct
GSGFVDY

SEQ ID NO: 10708 - protein, 7 aa, Artificial Sequence
  Synthetic construct
GSGFVVF

SEQ ID NO: 10709 - protein, 7 aa, Artificial Sequence
  Synthetic construct
GSGFVVY

SEQ ID NO: 10710 - protein, 7 aa, Artificial Sequence
  Synthetic construct
GSGFTFF

SEQ ID NO: 10711 - protein, 7 aa, Artificial Sequence
  Synthetic construct
GSGFTFY

SEQ ID NO: 10712 - protein, 7 aa, Artificial Sequence
  Synthetic construct
GSGFTRF

SEQ ID NO: 10713 - protein, 7 aa, Artificial Sequence
  Synthetic construct
GSGFTRY

SEQ ID NO: 10714 - protein, 7 aa, Artificial Sequence
  Synthetic construct
GSGFTCF

SEQ ID NO: 10715 - protein, 7 aa, Artificial Sequence
  Synthetic construct
GSGFTCY

SEQ ID NO: 10716 - protein, 7 aa, Artificial Sequence
  Synthetic construct
GSGFTLF

SEQ ID NO: 10717 - protein, 7 aa, Artificial Sequence
  Synthetic construct
GSGFTLY

SEQ ID NO: 10718 - protein, 7 aa, Artificial Sequence
  Synthetic construct
GSGFTAF

SEQ ID NO: 10719 - protein, 7 aa, Artificial Sequence
  Synthetic construct
GSGFTAY

SEQ ID NO: 10720 - protein, 7 aa, Artificial Sequence
  Synthetic construct
GSGFTQF

SEQ ID NO: 10721 - protein, 7 aa, Artificial Sequence
  Synthetic construct
GSGFTQY

SEQ ID NO: 10722 - protein, 7 aa, Artificial Sequence
  Synthetic construct
GSGFTDF

SEQ ID NO: 10723 - protein, 7 aa, Artificial Sequence
  Synthetic construct
GSGFTDY

SEQ ID NO: 10724 - protein, 7 aa, Artificial Sequence
  Synthetic construct
GSGFTVF

SEQ ID NO: 10725 - protein, 7 aa, Artificial Sequence
  Synthetic construct
GSGFTVY

SEQ ID NO: 10726 - protein, 7 aa, Artificial Sequence
  Synthetic construct
GSGFGFF

SEQ ID NO: 10727 - protein, 7 aa, Artificial Sequence
  Synthetic construct
GSGFGFY

SEQ ID NO: 10728 - protein, 7 aa, Artificial Sequence
  Synthetic construct
GSGFGRF

SEQ ID NO: 10729 - protein, 7 aa, Artificial Sequence
  Synthetic construct
GSGFGRY

SEQ ID NO: 10730 - protein, 7 aa, Artificial Sequence
  Synthetic construct
GSGFGCF

SEQ ID NO: 10731 - protein, 7 aa, Artificial Sequence
  Synthetic construct
GSGFGCY

SEQ ID NO: 10732 - protein, 7 aa, Artificial Sequence
  Synthetic construct
GSGFGLF

SEQ ID NO: 10733 - protein, 7 aa, Artificial Sequence
  Synthetic construct
GSGFGLY

SEQ ID NO: 10734 - protein, 7 aa, Artificial Sequence
  Synthetic construct
GSGFGAF

SEQ ID NO: 10735 - protein, 7 aa, Artificial Sequence
  Synthetic construct
GSGFGAY

SEQ ID NO: 10736 - protein, 7 aa, Artificial Sequence
  Synthetic construct
GSGFGQF

SEQ ID NO: 10737 - protein, 7 aa, Artificial Sequence
  Synthetic construct
GSGFGQY

SEQ ID NO: 10738 - protein, 7 aa, Artificial Sequence
  Synthetic construct
GSGFGDF

SEQ ID NO: 10739 - protein, 7 aa, Artificial Sequence
  Synthetic construct
GSGFGDY

SEQ ID NO: 10740 - protein, 7 aa, Artificial Sequence
  Synthetic construct
GSGFGVF

SEQ ID NO: 10741 - protein, 7 aa, Artificial Sequence
  Synthetic construct
GSGFGVY

SEQ ID NO: 10742 - protein, 7 aa, Artificial Sequence
  Synthetic construct
GSGFAFF

SEQ ID NO: 10743 - protein, 7 aa, Artificial Sequence
  Synthetic construct
GSGFAFY

SEQ ID NO: 10744 - protein, 7 aa, Artificial Sequence
  Synthetic construct
GSGFARF

SEQ ID NO: 10745 - protein, 7 aa, Artificial Sequence
  Synthetic construct
GSGFARY

SEQ ID NO: 10746 - protein, 7 aa, Artificial Sequence
  Synthetic construct
GSGFACF

SEQ ID NO: 10747 - protein, 7 aa, Artificial Sequence
  Synthetic construct
GSGFACY

SEQ ID NO: 10748 - protein, 7 aa, Artificial Sequence
  Synthetic construct
GSGFALF

SEQ ID NO: 10749 - protein, 7 aa, Artificial Sequence
  Synthetic construct
GSGFALY

SEQ ID NO: 10750 - protein, 7 aa, Artificial Sequence
  Synthetic construct
GSGFAAF

SEQ ID NO: 10751 - protein, 7 aa, Artificial Sequence
  Synthetic construct
GSGFAAY

SEQ ID NO: 10752 - protein, 7 aa, Artificial Sequence
  Synthetic construct
GSGFAQF

SEQ ID NO: 10753 - protein, 7 aa, Artificial Sequence
  Synthetic construct
GSGFAQY

SEQ ID NO: 10754 - protein, 7 aa, Artificial Sequence
  Synthetic construct
GSGFADF

SEQ ID NO: 10755 - protein, 7 aa, Artificial Sequence
  Synthetic construct
GSGFADY

SEQ ID NO: 10756 - protein, 7 aa, Artificial Sequence
  Synthetic construct
GSGFAVF

SEQ ID NO: 10757 - protein, 7 aa, Artificial Sequence
  Synthetic construct
GSGFAVY

SEQ ID NO: 10758 - protein, 7 aa, Artificial Sequence
  Synthetic construct
GSGFQFF

SEQ ID NO: 10759 - protein, 7 aa, Artificial Sequence
  Synthetic construct
GSGFQFY

SEQ ID NO: 10760 - protein, 7 aa, Artificial Sequence
  Synthetic construct
GSGFQRF

SEQ ID NO: 10761 - protein, 7 aa, Artificial Sequence
  Synthetic construct
GSGFQRY

SEQ ID NO: 10762 - protein, 7 aa, Artificial Sequence
  Synthetic construct
GSGFQCF

SEQ ID NO: 10763 - protein, 7 aa, Artificial Sequence
  Synthetic construct
GSGFQCY

SEQ ID NO: 10764 - protein, 7 aa, Artificial Sequence
  Synthetic construct
GSGFQLF

SEQ ID NO: 10765 - protein, 7 aa, Artificial Sequence
  Synthetic construct
GSGFQLY

SEQ ID NO: 10766 - protein, 7 aa, Artificial Sequence
  Synthetic construct
GSGFQAF

SEQ ID NO: 10767 - protein, 7 aa, Artificial Sequence
  Synthetic construct
GSGFQAY

SEQ ID NO: 10768 - protein, 7 aa, Artificial Sequence
  Synthetic construct
GSGFQQF

SEQ ID NO: 10769 - protein, 7 aa, Artificial Sequence
  Synthetic construct
GSGFQQY

SEQ ID NO: 10770 - protein, 7 aa, Artificial Sequence
  Synthetic construct
GSGFQDF

SEQ ID NO: 10771 - protein, 7 aa, Artificial Sequence
  Synthetic construct
GSGFQDY

SEQ ID NO: 10772 - protein, 7 aa, Artificial Sequence
  Synthetic construct
GSGFQVF

SEQ ID NO: 10773 - protein, 7 aa, Artificial Sequence
  Synthetic construct
GSGFQVY

SEQ ID NO: 10774 - protein, 7 aa, Artificial Sequence
  Synthetic construct
GLIYIFF

SEQ ID NO: 10775 - protein, 7 aa, Artificial Sequence
  Synthetic construct
GLIYIFY

SEQ ID NO: 10776 - protein, 7 aa, Artificial Sequence
  Synthetic construct
GLIYIRF

SEQ ID NO: 10777 - protein, 7 aa, Artificial Sequence
  Synthetic construct
GLIYIRY

SEQ ID NO: 10778 - protein, 7 aa, Artificial Sequence
  Synthetic construct
GLIYICF

SEQ ID NO: 10779 - protein, 7 aa, Artificial Sequence
  Synthetic construct
GLIYICY

SEQ ID NO: 10780 - protein, 7 aa, Artificial Sequence
  Synthetic construct
GLIYILF

SEQ ID NO: 10781 - protein, 7 aa, Artificial Sequence
  Synthetic construct
GLIYILY

SEQ ID NO: 10782 - protein, 7 aa, Artificial Sequence
  Synthetic construct
GLIYIAF

SEQ ID NO: 10783 - protein, 7 aa, Artificial Sequence
  Synthetic construct
GLIYIAY

SEQ ID NO: 10784 - protein, 7 aa, Artificial Sequence
  Synthetic construct
GLIYIQF

SEQ ID NO: 10785 - protein, 7 aa, Artificial Sequence
  Synthetic construct
GLIYIQY

SEQ ID NO: 10786 - protein, 7 aa, Artificial Sequence
  Synthetic construct
GLIYIDF

SEQ ID NO: 10787 - protein, 7 aa, Artificial Sequence
  Synthetic construct
GLIYIDY

SEQ ID NO: 10788 - protein, 7 aa, Artificial Sequence
  Synthetic construct
GLIYIVF

SEQ ID NO: 10789 - protein, 7 aa, Artificial Sequence
  Synthetic construct
GLIYIVY

SEQ ID NO: 10790 - protein, 7 aa, Artificial Sequence
  Synthetic construct
GLIYDFF

SEQ ID NO: 10791 - protein, 7 aa, Artificial Sequence
  Synthetic construct
GLIYDFY

SEQ ID NO: 10792 - protein, 7 aa, Artificial Sequence
  Synthetic construct
GLIYDRF

SEQ ID NO: 10793 - protein, 7 aa, Artificial Sequence
  Synthetic construct
GLIYDRY

SEQ ID NO: 10794 - protein, 7 aa, Artificial Sequence
  Synthetic construct
GLIYDCF

SEQ ID NO: 10795 - protein, 7 aa, Artificial Sequence
  Synthetic construct
GLIYDCY

SEQ ID NO: 10796 - protein, 7 aa, Artificial Sequence
  Synthetic construct
GLIYDLF

SEQ ID NO: 10797 - protein, 7 aa, Artificial Sequence
  Synthetic construct
GLIYDLY

SEQ ID NO: 10798 - protein, 7 aa, Artificial Sequence
  Synthetic construct
GLIYDAF

SEQ ID NO: 10799 - protein, 7 aa, Artificial Sequence
  Synthetic construct
GLIYDAY

SEQ ID NO: 10800 - protein, 7 aa, Artificial Sequence
  Synthetic construct
GLIYDQF

SEQ ID NO: 10801 - protein, 7 aa, Artificial Sequence
  Synthetic construct
GLIYDQY

SEQ ID NO: 10802 - protein, 7 aa, Artificial Sequence
  Synthetic construct
GLIYDDF

SEQ ID NO: 10803 - protein, 7 aa, Artificial Sequence
  Synthetic construct
GLIYDDY

SEQ ID NO: 10804 - protein, 7 aa, Artificial Sequence
  Synthetic construct
GLIYDVF

SEQ ID NO: 10805 - protein, 7 aa, Artificial Sequence
  Synthetic construct
GLIYDVY

SEQ ID NO: 10806 - protein, 7 aa, Artificial Sequence
  Synthetic construct
GLIYYFF

SEQ ID NO: 10807 - protein, 7 aa, Artificial Sequence
  Synthetic construct
GLIYYFY

SEQ ID NO: 10808 - protein, 7 aa, Artificial Sequence
  Synthetic construct
GLIYYRF

SEQ ID NO: 10809 - protein, 7 aa, Artificial Sequence
  Synthetic construct
GLIYYRY

SEQ ID NO: 10810 - protein, 7 aa, Artificial Sequence
  Synthetic construct
GLIYYCF

SEQ ID NO: 10811 - protein, 7 aa, Artificial Sequence
  Synthetic construct
GLIYYCY

SEQ ID NO: 10812 - protein, 7 aa, Artificial Sequence
  Synthetic construct
GLIYYLF

SEQ ID NO: 10813 - protein, 7 aa, Artificial Sequence
  Synthetic construct
GLIYYLY

SEQ ID NO: 10814 - protein, 7 aa, Artificial Sequence
  Synthetic construct
GLIYYAF

SEQ ID NO: 10815 - protein, 7 aa, Artificial Sequence
  Synthetic construct
GLIYYAY

SEQ ID NO: 10816 - protein, 7 aa, Artificial Sequence
  Synthetic construct
GLIYYQF

SEQ ID NO: 10817 - protein, 7 aa, Artificial Sequence
  Synthetic construct
GLIYYQY

SEQ ID NO: 10818 - protein, 7 aa, Artificial Sequence
  Synthetic construct
GLIYYDF

SEQ ID NO: 10819 - protein, 7 aa, Artificial Sequence
  Synthetic construct
GLIYYDY

SEQ ID NO: 10820 - protein, 7 aa, Artificial Sequence
  Synthetic construct
GLIYYVF

SEQ ID NO: 10821 - protein, 7 aa, Artificial Sequence
  Synthetic construct
GLIYYVY

SEQ ID NO: 10822 - protein, 7 aa, Artificial Sequence
  Synthetic construct
GLIYFFF

SEQ ID NO: 10823 - protein, 7 aa, Artificial Sequence
  Synthetic construct
GLIYFFY

SEQ ID NO: 10824 - protein, 7 aa, Artificial Sequence
  Synthetic construct
GLIYFRF

SEQ ID NO: 10825 - protein, 7 aa, Artificial Sequence
  Synthetic construct
GLIYFRY

SEQ ID NO: 10826 - protein, 7 aa, Artificial Sequence
  Synthetic construct
GLIYFCF

SEQ ID NO: 10827 - protein, 7 aa, Artificial Sequence
  Synthetic construct
GLIYFCY

SEQ ID NO: 10828 - protein, 7 aa, Artificial Sequence
  Synthetic construct
GLIYFLF

SEQ ID NO: 10829 - protein, 7 aa, Artificial Sequence
  Synthetic construct
GLIYFLY

SEQ ID NO: 10830 - protein, 7 aa, Artificial Sequence
  Synthetic construct
GLIYFAF

SEQ ID NO: 10831 - protein, 7 aa, Artificial Sequence
  Synthetic construct
GLIYFAY

SEQ ID NO: 10832 - protein, 7 aa, Artificial Sequence
  Synthetic construct
GLIYFQF

SEQ ID NO: 10833 - protein, 7 aa, Artificial Sequence
  Synthetic construct
GLIYFQY

SEQ ID NO: 10834 - protein, 7 aa, Artificial Sequence
  Synthetic construct
GLIYFDF

SEQ ID NO: 10835 - protein, 7 aa, Artificial Sequence
  Synthetic construct
GLIYFDY

SEQ ID NO: 10836 - protein, 7 aa, Artificial Sequence
  Synthetic construct
GLIYFVF

SEQ ID NO: 10837 - protein, 7 aa, Artificial Sequence
  Synthetic construct
GLIYFVY

SEQ ID NO: 10838 - protein, 7 aa, Artificial Sequence
  Synthetic construct
GLIYVFF

SEQ ID NO: 10839 - protein, 7 aa, Artificial Sequence
  Synthetic construct
GLIYVFY

SEQ ID NO: 10840 - protein, 7 aa, Artificial Sequence
  Synthetic construct
GLIYVRF

SEQ ID NO: 10841 - protein, 7 aa, Artificial Sequence
  Synthetic construct
GLIYVRY

SEQ ID NO: 10842 - protein, 7 aa, Artificial Sequence
  Synthetic construct
GLIYVCF

SEQ ID NO: 10843 - protein, 7 aa, Artificial Sequence
  Synthetic construct
GLIYVCY

SEQ ID NO: 10844 - protein, 7 aa, Artificial Sequence
  Synthetic construct
GLIYVLF

SEQ ID NO: 10845 - protein, 7 aa, Artificial Sequence
  Synthetic construct
GLIYVLY

SEQ ID NO: 10846 - protein, 7 aa, Artificial Sequence
  Synthetic construct
GLIYVAF

SEQ ID NO: 10847 - protein, 7 aa, Artificial Sequence
  Synthetic construct
GLIYVAY

SEQ ID NO: 10848 - protein, 7 aa, Artificial Sequence
  Synthetic construct
GLIYVQF

SEQ ID NO: 10849 - protein, 7 aa, Artificial Sequence
  Synthetic construct
GLIYVQY

SEQ ID NO: 10850 - protein, 7 aa, Artificial Sequence
  Synthetic construct
GLIYVDF

SEQ ID NO: 10851 - protein, 7 aa, Artificial Sequence
  Synthetic construct
GLIYVDY

SEQ ID NO: 10852 - protein, 7 aa, Artificial Sequence
  Synthetic construct
GLIYVVF

SEQ ID NO: 10853 - protein, 7 aa, Artificial Sequence
  Synthetic construct
GLIYVVY

SEQ ID NO: 10854 - protein, 7 aa, Artificial Sequence
  Synthetic construct
GLIYTFF

SEQ ID NO: 10855 - protein, 7 aa, Artificial Sequence
  Synthetic construct
GLIYTFY

SEQ ID NO: 10856 - protein, 7 aa, Artificial Sequence
  Synthetic construct
GLIYTRF

SEQ ID NO: 10857 - protein, 7 aa, Artificial Sequence
  Synthetic construct
GLIYTRY

SEQ ID NO: 10858 - protein, 7 aa, Artificial Sequence
  Synthetic construct
GLIYTCF

SEQ ID NO: 10859 - protein, 7 aa, Artificial Sequence
  Synthetic construct
GLIYTCY

SEQ ID NO: 10860 - protein, 7 aa, Artificial Sequence
  Synthetic construct
GLIYTLF

SEQ ID NO: 10861 - protein, 7 aa, Artificial Sequence
  Synthetic construct
GLIYTLY

SEQ ID NO: 10862 - protein, 7 aa, Artificial Sequence
  Synthetic construct
GLIYTAF

SEQ ID NO: 10863 - protein, 7 aa, Artificial Sequence
  Synthetic construct
GLIYTAY

SEQ ID NO: 10864 - protein, 7 aa, Artificial Sequence
  Synthetic construct
GLIYTQF

SEQ ID NO: 10865 - protein, 7 aa, Artificial Sequence
  Synthetic construct
GLIYTQY

SEQ ID NO: 10866 - protein, 7 aa, Artificial Sequence
  Synthetic construct
GLIYTDF

SEQ ID NO: 10867 - protein, 7 aa, Artificial Sequence
  Synthetic construct
GLIYTDY

SEQ ID NO: 10868 - protein, 7 aa, Artificial Sequence
  Synthetic construct
GLIYTVF

SEQ ID NO: 10869 - protein, 7 aa, Artificial Sequence
  Synthetic construct
GLIYTVY

SEQ ID NO: 10870 - protein, 7 aa, Artificial Sequence
  Synthetic construct
GLIYGFF

SEQ ID NO: 10871 - protein, 7 aa, Artificial Sequence
  Synthetic construct
GLIYGFY

SEQ ID NO: 10872 - protein, 7 aa, Artificial Sequence
  Synthetic construct
GLIYGRF

SEQ ID NO: 10873 - protein, 7 aa, Artificial Sequence
  Synthetic construct
GLIYGRY

SEQ ID NO: 10874 - protein, 7 aa, Artificial Sequence
  Synthetic construct
GLIYGCF

SEQ ID NO: 10875 - protein, 7 aa, Artificial Sequence
  Synthetic construct
GLIYGCY

SEQ ID NO: 10876 - protein, 7 aa, Artificial Sequence
  Synthetic construct
GLIYGLF

SEQ ID NO: 10877 - protein, 7 aa, Artificial Sequence
  Synthetic construct
GLIYGLY

SEQ ID NO: 10878 - protein, 7 aa, Artificial Sequence
  Synthetic construct
GLIYGAF

SEQ ID NO: 10879 - protein, 7 aa, Artificial Sequence
  Synthetic construct
GLIYGAY

SEQ ID NO: 10880 - protein, 7 aa, Artificial Sequence
  Synthetic construct
GLIYGQF

SEQ ID NO: 10881 - protein, 7 aa, Artificial Sequence
  Synthetic construct
GLIYGQY

SEQ ID NO: 10882 - protein, 7 aa, Artificial Sequence
  Synthetic construct
GLIYGDF

SEQ ID NO: 10883 - protein, 7 aa, Artificial Sequence
  Synthetic construct
GLIYGDY

SEQ ID NO: 10884 - protein, 7 aa, Artificial Sequence
  Synthetic construct
GLIYGVF

SEQ ID NO: 10885 - protein, 7 aa, Artificial Sequence
  Synthetic construct
GLIYGVY

SEQ ID NO: 10886 - protein, 7 aa, Artificial Sequence
  Synthetic construct
GLIYAFF

SEQ ID NO: 10887 - protein, 7 aa, Artificial Sequence
  Synthetic construct
GLIYAFY

SEQ ID NO: 10888 - protein, 7 aa, Artificial Sequence
  Synthetic construct
GLIYARF

SEQ ID NO: 10889 - protein, 7 aa, Artificial Sequence
  Synthetic construct
GLIYARY

SEQ ID NO: 10890 - protein, 7 aa, Artificial Sequence
  Synthetic construct
GLIYACF

SEQ ID NO: 10891 - protein, 7 aa, Artificial Sequence
  Synthetic construct
GLIYACY

SEQ ID NO: 10892 - protein, 7 aa, Artificial Sequence
  Synthetic construct
GLIYALF

SEQ ID NO: 10893 - protein, 7 aa, Artificial Sequence
  Synthetic construct
GLIYALY

SEQ ID NO: 10894 - protein, 7 aa, Artificial Sequence
  Synthetic construct
GLIYAAF

SEQ ID NO: 10895 - protein, 7 aa, Artificial Sequence
  Synthetic construct
GLIYAAY

SEQ ID NO: 10896 - protein, 7 aa, Artificial Sequence
  Synthetic construct
GLIYAQF

SEQ ID NO: 10897 - protein, 7 aa, Artificial Sequence
  Synthetic construct
GLIYAQY

SEQ ID NO: 10898 - protein, 7 aa, Artificial Sequence
  Synthetic construct
GLIYADF

SEQ ID NO: 10899 - protein, 7 aa, Artificial Sequence
  Synthetic construct
GLIYADY

SEQ ID NO: 10900 - protein, 7 aa, Artificial Sequence
  Synthetic construct
GLIYAVF

SEQ ID NO: 10901 - protein, 7 aa, Artificial Sequence
  Synthetic construct
GLIYAVY

SEQ ID NO: 10902 - protein, 7 aa, Artificial Sequence
  Synthetic construct
GLIYQFF

SEQ ID NO: 10903 - protein, 7 aa, Artificial Sequence
  Synthetic construct
GLIYQFY

SEQ ID NO: 10904 - protein, 7 aa, Artificial Sequence
  Synthetic construct
GLIYQRF

SEQ ID NO: 10905 - protein, 7 aa, Artificial Sequence
  Synthetic construct
GLIYQRY

SEQ ID NO: 10906 - protein, 7 aa, Artificial Sequence
  Synthetic construct
GLIYQCF

SEQ ID NO: 10907 - protein, 7 aa, Artificial Sequence
  Synthetic construct
GLIYQCY

SEQ ID NO: 10908 - protein, 7 aa, Artificial Sequence
  Synthetic construct
GLIYQLF

SEQ ID NO: 10909 - protein, 7 aa, Artificial Sequence
  Synthetic construct
GLIYQLY

SEQ ID NO: 10910 - protein, 7 aa, Artificial Sequence
  Synthetic construct
GLIYQAF

SEQ ID NO: 10911 - protein, 7 aa, Artificial Sequence
  Synthetic construct
GLIYQAY

SEQ ID NO: 10912 - protein, 7 aa, Artificial Sequence
  Synthetic construct
GLIYQQF

SEQ ID NO: 10913 - protein, 7 aa, Artificial Sequence
  Synthetic construct
GLIYQQY

SEQ ID NO: 10914 - protein, 7 aa, Artificial Sequence
  Synthetic construct
GLIYQDF

SEQ ID NO: 10915 - protein, 7 aa, Artificial Sequence
  Synthetic construct
GLIYQDY

SEQ ID NO: 10916 - protein, 7 aa, Artificial Sequence
  Synthetic construct
GLIYQVF

SEQ ID NO: 10917 - protein, 7 aa, Artificial Sequence
  Synthetic construct
GLIYQVY

SEQ ID NO: 10918 - protein, 7 aa, Artificial Sequence
  Synthetic construct
GLIPIFF

SEQ ID NO: 10919 - protein, 7 aa, Artificial Sequence
  Synthetic construct
GLIPIFY

SEQ ID NO: 10920 - protein, 7 aa, Artificial Sequence
  Synthetic construct
GLIPIRF

SEQ ID NO: 10921 - protein, 7 aa, Artificial Sequence
  Synthetic construct
GLIPIRY

SEQ ID NO: 10922 - protein, 7 aa, Artificial Sequence
  Synthetic construct
GLIPICF

SEQ ID NO: 10923 - protein, 7 aa, Artificial Sequence
  Synthetic construct
GLIPICY

SEQ ID NO: 10924 - protein, 7 aa, Artificial Sequence
  Synthetic construct
GLIPILF

SEQ ID NO: 10925 - protein, 7 aa, Artificial Sequence
  Synthetic construct
GLIPILY

SEQ ID NO: 10926 - protein, 7 aa, Artificial Sequence
  Synthetic construct
GLIPIAF

SEQ ID NO: 10927 - protein, 7 aa, Artificial Sequence
  Synthetic construct
GLIPIAY

SEQ ID NO: 10928 - protein, 7 aa, Artificial Sequence
  Synthetic construct
GLIPIQF

SEQ ID NO: 10929 - protein, 7 aa, Artificial Sequence
  Synthetic construct
GLIPIQY

SEQ ID NO: 10930 - protein, 7 aa, Artificial Sequence
  Synthetic construct
GLIPIDF

SEQ ID NO: 10931 - protein, 7 aa, Artificial Sequence
  Synthetic construct
GLIPIDY

SEQ ID NO: 10932 - protein, 7 aa, Artificial Sequence
  Synthetic construct
GLIPIVF

SEQ ID NO: 10933 - protein, 7 aa, Artificial Sequence
  Synthetic construct
GLIPIVY

SEQ ID NO: 10934 - protein, 7 aa, Artificial Sequence
  Synthetic construct
GLIPDFF

SEQ ID NO: 10935 - protein, 7 aa, Artificial Sequence
  Synthetic construct
GLIPDFY

SEQ ID NO: 10936 - protein, 7 aa, Artificial Sequence
  Synthetic construct
GLIPDRF

SEQ ID NO: 10937 - protein, 7 aa, Artificial Sequence
  Synthetic construct
GLIPDRY

SEQ ID NO: 10938 - protein, 7 aa, Artificial Sequence
  Synthetic construct
GLIPDCF

SEQ ID NO: 10939 - protein, 7 aa, Artificial Sequence
  Synthetic construct
GLIPDCY

SEQ ID NO: 10940 - protein, 7 aa, Artificial Sequence
  Synthetic construct
GLIPDLF

SEQ ID NO: 10941 - protein, 7 aa, Artificial Sequence
  Synthetic construct
GLIPDLY

SEQ ID NO: 10942 - protein, 7 aa, Artificial Sequence
  Synthetic construct
GLIPDAF

SEQ ID NO: 10943 - protein, 7 aa, Artificial Sequence
  Synthetic construct
GLIPDAY

SEQ ID NO: 10944 - protein, 7 aa, Artificial Sequence
  Synthetic construct
GLIPDQF

SEQ ID NO: 10945 - protein, 7 aa, Artificial Sequence
  Synthetic construct
GLIPDQY

SEQ ID NO: 10946 - protein, 7 aa, Artificial Sequence
  Synthetic construct
GLIPDDF

SEQ ID NO: 10947 - protein, 7 aa, Artificial Sequence
  Synthetic construct
GLIPDDY

SEQ ID NO: 10948 - protein, 7 aa, Artificial Sequence
  Synthetic construct
GLIPDVF

SEQ ID NO: 10949 - protein, 7 aa, Artificial Sequence
  Synthetic construct
GLIPDVY

SEQ ID NO: 10950 - protein, 7 aa, Artificial Sequence
  Synthetic construct
GLIPYFF

SEQ ID NO: 10951 - protein, 7 aa, Artificial Sequence
  Synthetic construct
GLIPYFY

SEQ ID NO: 10952 - protein, 7 aa, Artificial Sequence
  Synthetic construct
GLIPYRF

SEQ ID NO: 10953 - protein, 7 aa, Artificial Sequence
  Synthetic construct
GLIPYRY

SEQ ID NO: 10954 - protein, 7 aa, Artificial Sequence
  Synthetic construct
GLIPYCF

SEQ ID NO: 10955 - protein, 7 aa, Artificial Sequence
  Synthetic construct
GLIPYCY

SEQ ID NO: 10956 - protein, 7 aa, Artificial Sequence
  Synthetic construct
GLIPYLF

SEQ ID NO: 10957 - protein, 7 aa, Artificial Sequence
  Synthetic construct
GLIPYLY

SEQ ID NO: 10958 - protein, 7 aa, Artificial Sequence
  Synthetic construct
GLIPYAF

SEQ ID NO: 10959 - protein, 7 aa, Artificial Sequence
  Synthetic construct
GLIPYAY

SEQ ID NO: 10960 - protein, 7 aa, Artificial Sequence
  Synthetic construct
GLIPYQF

SEQ ID NO: 10961 - protein, 7 aa, Artificial Sequence
  Synthetic construct
GLIPYQY

SEQ ID NO: 10962 - protein, 7 aa, Artificial Sequence
  Synthetic construct
GLIPYDF

SEQ ID NO: 10963 - protein, 7 aa, Artificial Sequence
  Synthetic construct
GLIPYDY

SEQ ID NO: 10964 - protein, 7 aa, Artificial Sequence
  Synthetic construct
GLIPYVF

SEQ ID NO: 10965 - protein, 7 aa, Artificial Sequence
  Synthetic construct
GLIPYVY

SEQ ID NO: 10966 - protein, 7 aa, Artificial Sequence
  Synthetic construct
GLIPFFF

SEQ ID NO: 10967 - protein, 7 aa, Artificial Sequence
  Synthetic construct
GLIPFFY

SEQ ID NO: 10968 - protein, 7 aa, Artificial Sequence
  Synthetic construct
GLIPFRF

SEQ ID NO: 10969 - protein, 7 aa, Artificial Sequence
  Synthetic construct
GLIPFRY

SEQ ID NO: 10970 - protein, 7 aa, Artificial Sequence
  Synthetic construct
GLIPFCF

SEQ ID NO: 10971 - protein, 7 aa, Artificial Sequence
  Synthetic construct
GLIPFCY

SEQ ID NO: 10972 - protein, 7 aa, Artificial Sequence
  Synthetic construct
GLIPFLF

SEQ ID NO: 10973 - protein, 7 aa, Artificial Sequence
  Synthetic construct
GLIPFLY

SEQ ID NO: 10974 - protein, 7 aa, Artificial Sequence
  Synthetic construct
GLIPFAF

SEQ ID NO: 10975 - protein, 7 aa, Artificial Sequence
  Synthetic construct
GLIPFAY

SEQ ID NO: 10976 - protein, 7 aa, Artificial Sequence
  Synthetic construct
GLIPFQF

SEQ ID NO: 10977 - protein, 7 aa, Artificial Sequence
  Synthetic construct
GLIPFQY

SEQ ID NO: 10978 - protein, 7 aa, Artificial Sequence
  Synthetic construct
GLIPFDF

SEQ ID NO: 10979 - protein, 7 aa, Artificial Sequence
  Synthetic construct
GLIPFDY

SEQ ID NO: 10980 - protein, 7 aa, Artificial Sequence
  Synthetic construct
GLIPFVF

SEQ ID NO: 10981 - protein, 7 aa, Artificial Sequence
  Synthetic construct
GLIPFVY

SEQ ID NO: 10982 - protein, 7 aa, Artificial Sequence
  Synthetic construct
GLIPVFF

SEQ ID NO: 10983 - protein, 7 aa, Artificial Sequence
  Synthetic construct
GLIPVFY

SEQ ID NO: 10984 - protein, 7 aa, Artificial Sequence
  Synthetic construct
GLIPVRF

SEQ ID NO: 10985 - protein, 7 aa, Artificial Sequence
  Synthetic construct
GLIPVRY

SEQ ID NO: 10986 - protein, 7 aa, Artificial Sequence
  Synthetic construct
GLIPVCF

SEQ ID NO: 10987 - protein, 7 aa, Artificial Sequence
  Synthetic construct
GLIPVCY

SEQ ID NO: 10988 - protein, 7 aa, Artificial Sequence
  Synthetic construct
GLIPVLF

SEQ ID NO: 10989 - protein, 7 aa, Artificial Sequence
  Synthetic construct
GLIPVLY

SEQ ID NO: 10990 - protein, 7 aa, Artificial Sequence
  Synthetic construct
GLIPVAF

SEQ ID NO: 10991 - protein, 7 aa, Artificial Sequence
  Synthetic construct
GLIPVAY

SEQ ID NO: 10992 - protein, 7 aa, Artificial Sequence
  Synthetic construct
GLIPVQF

SEQ ID NO: 10993 - protein, 7 aa, Artificial Sequence
  Synthetic construct
GLIPVQY

SEQ ID NO: 10994 - protein, 7 aa, Artificial Sequence
  Synthetic construct
GLIPVDF

SEQ ID NO: 10995 - protein, 7 aa, Artificial Sequence
  Synthetic construct
GLIPVDY

SEQ ID NO: 10996 - protein, 7 aa, Artificial Sequence
  Synthetic construct
GLIPVVF

SEQ ID NO: 10997 - protein, 7 aa, Artificial Sequence
  Synthetic construct
GLIPVVY

SEQ ID NO: 10998 - protein, 7 aa, Artificial Sequence
  Synthetic construct
GLIPTFF

SEQ ID NO: 10999 - protein, 7 aa, Artificial Sequence
  Synthetic construct
GLIPTFY

SEQ ID NO: 11000 - protein, 7 aa, Artificial Sequence
  Synthetic construct
GLIPTRF

SEQ ID NO: 11001 - protein, 7 aa, Artificial Sequence
  Synthetic construct
GLIPTRY

SEQ ID NO: 11002 - protein, 7 aa, Artificial Sequence
  Synthetic construct
GLIPTCF

SEQ ID NO: 11003 - protein, 7 aa, Artificial Sequence
  Synthetic construct
GLIPTCY

SEQ ID NO: 11004 - protein, 7 aa, Artificial Sequence
  Synthetic construct
GLIPTLF

SEQ ID NO: 11005 - protein, 7 aa, Artificial Sequence
  Synthetic construct
GLIPTLY

SEQ ID NO: 11006 - protein, 7 aa, Artificial Sequence
  Synthetic construct
GLIPTAF

SEQ ID NO: 11007 - protein, 7 aa, Artificial Sequence
  Synthetic construct
GLIPTAY

SEQ ID NO: 11008 - protein, 7 aa, Artificial Sequence
  Synthetic construct
GLIPTQF

SEQ ID NO: 11009 - protein, 7 aa, Artificial Sequence
  Synthetic construct
GLIPTQY

SEQ ID NO: 11010 - protein, 7 aa, Artificial Sequence
  Synthetic construct
GLIPTDF

SEQ ID NO: 11011 - protein, 7 aa, Artificial Sequence
  Synthetic construct
GLIPTDY

SEQ ID NO: 11012 - protein, 7 aa, Artificial Sequence
  Synthetic construct
GLIPTVF

SEQ ID NO: 11013 - protein, 7 aa, Artificial Sequence
  Synthetic construct
GLIPTVY

SEQ ID NO: 11014 - protein, 7 aa, Artificial Sequence
  Synthetic construct
GLIPGFF

SEQ ID NO: 11015 - protein, 7 aa, Artificial Sequence
  Synthetic construct
GLIPGFY

SEQ ID NO: 11016 - protein, 7 aa, Artificial Sequence
  Synthetic construct
GLIPGRF

SEQ ID NO: 11017 - protein, 7 aa, Artificial Sequence
  Synthetic construct
GLIPGRY

SEQ ID NO: 11018 - protein, 7 aa, Artificial Sequence
  Synthetic construct
GLIPGCF

SEQ ID NO: 11019 - protein, 7 aa, Artificial Sequence
  Synthetic construct
GLIPGCY

SEQ ID NO: 11020 - protein, 7 aa, Artificial Sequence
  Synthetic construct
GLIPGLF

SEQ ID NO: 11021 - protein, 7 aa, Artificial Sequence
  Synthetic construct
GLIPGLY

SEQ ID NO: 11022 - protein, 7 aa, Artificial Sequence
  Synthetic construct
GLIPGAF

SEQ ID NO: 11023 - protein, 7 aa, Artificial Sequence
  Synthetic construct
GLIPGAY

SEQ ID NO: 11024 - protein, 7 aa, Artificial Sequence
  Synthetic construct
GLIPGQF

SEQ ID NO: 11025 - protein, 7 aa, Artificial Sequence
  Synthetic construct
GLIPGQY

SEQ ID NO: 11026 - protein, 7 aa, Artificial Sequence
  Synthetic construct
GLIPGDF

SEQ ID NO: 11027 - protein, 7 aa, Artificial Sequence
  Synthetic construct
GLIPGDY

SEQ ID NO: 11028 - protein, 7 aa, Artificial Sequence
  Synthetic construct
GLIPGVF

SEQ ID NO: 11029 - protein, 7 aa, Artificial Sequence
  Synthetic construct
GLIPGVY

SEQ ID NO: 11030 - protein, 7 aa, Artificial Sequence
  Synthetic construct
GLIPAFF

SEQ ID NO: 11031 - protein, 7 aa, Artificial Sequence
  Synthetic construct
GLIPAFY

SEQ ID NO: 11032 - protein, 7 aa, Artificial Sequence
  Synthetic construct
GLIPARF

SEQ ID NO: 11033 - protein, 7 aa, Artificial Sequence
  Synthetic construct
GLIPARY

SEQ ID NO: 11034 - protein, 7 aa, Artificial Sequence
  Synthetic construct
GLIPACF

SEQ ID NO: 11035 - protein, 7 aa, Artificial Sequence
  Synthetic construct
GLIPACY

SEQ ID NO: 11036 - protein, 7 aa, Artificial Sequence
  Synthetic construct
GLIPALF

SEQ ID NO: 11037 - protein, 7 aa, Artificial Sequence
  Synthetic construct
GLIPALY

SEQ ID NO: 11038 - protein, 7 aa, Artificial Sequence
  Synthetic construct
GLIPAAF

SEQ ID NO: 11039 - protein, 7 aa, Artificial Sequence
  Synthetic construct
GLIPAAY

SEQ ID NO: 11040 - protein, 7 aa, Artificial Sequence
  Synthetic construct
GLIPAQF

SEQ ID NO: 11041 - protein, 7 aa, Artificial Sequence
  Synthetic construct
GLIPAQY

SEQ ID NO: 11042 - protein, 7 aa, Artificial Sequence
  Synthetic construct
GLIPADF

SEQ ID NO: 11043 - protein, 7 aa, Artificial Sequence
  Synthetic construct
GLIPADY

SEQ ID NO: 11044 - protein, 7 aa, Artificial Sequence
  Synthetic construct
GLIPAVF

SEQ ID NO: 11045 - protein, 7 aa, Artificial Sequence
  Synthetic construct
GLIPAVY

SEQ ID NO: 11046 - protein, 7 aa, Artificial Sequence
  Synthetic construct
GLIPQFF

SEQ ID NO: 11047 - protein, 7 aa, Artificial Sequence
  Synthetic construct
GLIPQFY

SEQ ID NO: 11048 - protein, 7 aa, Artificial Sequence
  Synthetic construct
GLIPQRF

SEQ ID NO: 11049 - protein, 7 aa, Artificial Sequence
  Synthetic construct
GLIPQRY

SEQ ID NO: 11050 - protein, 7 aa, Artificial Sequence
  Synthetic construct
GLIPQCF

SEQ ID NO: 11051 - protein, 7 aa, Artificial Sequence
  Synthetic construct
GLIPQCY

SEQ ID NO: 11052 - protein, 7 aa, Artificial Sequence
  Synthetic construct
GLIPQLF

SEQ ID NO: 11053 - protein, 7 aa, Artificial Sequence
  Synthetic construct
GLIPQLY

SEQ ID NO: 11054 - protein, 7 aa, Artificial Sequence
  Synthetic construct
GLIPQAF

SEQ ID NO: 11055 - protein, 7 aa, Artificial Sequence
  Synthetic construct
GLIPQAY

SEQ ID NO: 11056 - protein, 7 aa, Artificial Sequence
  Synthetic construct
GLIPQQF

SEQ ID NO: 11057 - protein, 7 aa, Artificial Sequence
  Synthetic construct
GLIPQQY

SEQ ID NO: 11058 - protein, 7 aa, Artificial Sequence
  Synthetic construct
GLIPQDF

SEQ ID NO: 11059 - protein, 7 aa, Artificial Sequence
  Synthetic construct
GLIPQDY

SEQ ID NO: 11060 - protein, 7 aa, Artificial Sequence
  Synthetic construct
GLIPQVF

SEQ ID NO: 11061 - protein, 7 aa, Artificial Sequence
  Synthetic construct
GLIPQVY

SEQ ID NO: 11062 - protein, 7 aa, Artificial Sequence
  Synthetic construct
GLIHIFF

SEQ ID NO: 11063 - protein, 7 aa, Artificial Sequence
  Synthetic construct
GLIHIFY

SEQ ID NO: 11064 - protein, 7 aa, Artificial Sequence
  Synthetic construct
GLIHIRF

SEQ ID NO: 11065 - protein, 7 aa, Artificial Sequence
  Synthetic construct
GLIHIRY

SEQ ID NO: 11066 - protein, 7 aa, Artificial Sequence
  Synthetic construct
GLIHICF

SEQ ID NO: 11067 - protein, 7 aa, Artificial Sequence
  Synthetic construct
GLIHICY

SEQ ID NO: 11068 - protein, 7 aa, Artificial Sequence
  Synthetic construct
GLIHILF

SEQ ID NO: 11069 - protein, 7 aa, Artificial Sequence
  Synthetic construct
GLIHILY

SEQ ID NO: 11070 - protein, 7 aa, Artificial Sequence
  Synthetic construct
GLIHIAF

SEQ ID NO: 11071 - protein, 7 aa, Artificial Sequence
  Synthetic construct
GLIHIAY

SEQ ID NO: 11072 - protein, 7 aa, Artificial Sequence
  Synthetic construct
GLIHIQF

SEQ ID NO: 11073 - protein, 7 aa, Artificial Sequence
  Synthetic construct
GLIHIQY

SEQ ID NO: 11074 - protein, 7 aa, Artificial Sequence
  Synthetic construct
GLIHIDF

SEQ ID NO: 11075 - protein, 7 aa, Artificial Sequence
  Synthetic construct
GLIHIDY

SEQ ID NO: 11076 - protein, 7 aa, Artificial Sequence
  Synthetic construct
GLIHIVF

SEQ ID NO: 11077 - protein, 7 aa, Artificial Sequence
  Synthetic construct
GLIHIVY

SEQ ID NO: 11078 - protein, 7 aa, Artificial Sequence
  Synthetic construct
GLIHDFF

SEQ ID NO: 11079 - protein, 7 aa, Artificial Sequence
  Synthetic construct
GLIHDFY

SEQ ID NO: 11080 - protein, 7 aa, Artificial Sequence
  Synthetic construct
GLIHDRF

SEQ ID NO: 11081 - protein, 7 aa, Artificial Sequence
  Synthetic construct
GLIHDRY

SEQ ID NO: 11082 - protein, 7 aa, Artificial Sequence
  Synthetic construct
GLIHDCF

SEQ ID NO: 11083 - protein, 7 aa, Artificial Sequence
  Synthetic construct
GLIHDCY

SEQ ID NO: 11084 - protein, 7 aa, Artificial Sequence
  Synthetic construct
GLIHDLF

SEQ ID NO: 11085 - protein, 7 aa, Artificial Sequence
  Synthetic construct
GLIHDLY

SEQ ID NO: 11086 - protein, 7 aa, Artificial Sequence
  Synthetic construct
GLIHDAF

SEQ ID NO: 11087 - protein, 7 aa, Artificial Sequence
  Synthetic construct
GLIHDAY

SEQ ID NO: 11088 - protein, 7 aa, Artificial Sequence
  Synthetic construct
GLIHDQF

SEQ ID NO: 11089 - protein, 7 aa, Artificial Sequence
  Synthetic construct
GLIHDQY

SEQ ID NO: 11090 - protein, 7 aa, Artificial Sequence
  Synthetic construct
GLIHDDF

SEQ ID NO: 11091 - protein, 7 aa, Artificial Sequence
  Synthetic construct
GLIHDDY

SEQ ID NO: 11092 - protein, 7 aa, Artificial Sequence
  Synthetic construct
GLIHDVF

SEQ ID NO: 11093 - protein, 7 aa, Artificial Sequence
  Synthetic construct
GLIHDVY

SEQ ID NO: 11094 - protein, 7 aa, Artificial Sequence
  Synthetic construct
GLIHYFF

SEQ ID NO: 11095 - protein, 7 aa, Artificial Sequence
  Synthetic construct
GLIHYFY

SEQ ID NO: 11096 - protein, 7 aa, Artificial Sequence
  Synthetic construct
GLIHYRF

SEQ ID NO: 11097 - protein, 7 aa, Artificial Sequence
  Synthetic construct
GLIHYRY

SEQ ID NO: 11098 - protein, 7 aa, Artificial Sequence
  Synthetic construct
GLIHYCF

SEQ ID NO: 11099 - protein, 7 aa, Artificial Sequence
  Synthetic construct
GLIHYCY

SEQ ID NO: 11100 - protein, 7 aa, Artificial Sequence
  Synthetic construct
GLIHYLF

SEQ ID NO: 11101 - protein, 7 aa, Artificial Sequence
  Synthetic construct
GLIHYLY

SEQ ID NO: 11102 - protein, 7 aa, Artificial Sequence
  Synthetic construct
GLIHYAF

SEQ ID NO: 11103 - protein, 7 aa, Artificial Sequence
  Synthetic construct
GLIHYAY

SEQ ID NO: 11104 - protein, 7 aa, Artificial Sequence
  Synthetic construct
GLIHYQF

SEQ ID NO: 11105 - protein, 7 aa, Artificial Sequence
  Synthetic construct
GLIHYQY

SEQ ID NO: 11106 - protein, 7 aa, Artificial Sequence
  Synthetic construct
GLIHYDF

SEQ ID NO: 11107 - protein, 7 aa, Artificial Sequence
  Synthetic construct
GLIHYDY

SEQ ID NO: 11108 - protein, 7 aa, Artificial Sequence
  Synthetic construct
GLIHYVF

SEQ ID NO: 11109 - protein, 7 aa, Artificial Sequence
  Synthetic construct
GLIHYVY

SEQ ID NO: 11110 - protein, 7 aa, Artificial Sequence
  Synthetic construct
GLIHFFF

SEQ ID NO: 11111 - protein, 7 aa, Artificial Sequence
  Synthetic construct
GLIHFFY

SEQ ID NO: 11112 - protein, 7 aa, Artificial Sequence
  Synthetic construct
GLIHFRF

SEQ ID NO: 11113 - protein, 7 aa, Artificial Sequence
  Synthetic construct
GLIHFRY

SEQ ID NO: 11114 - protein, 7 aa, Artificial Sequence
  Synthetic construct
GLIHFCF

SEQ ID NO: 11115 - protein, 7 aa, Artificial Sequence
  Synthetic construct
GLIHFCY

SEQ ID NO: 11116 - protein, 7 aa, Artificial Sequence
  Synthetic construct
GLIHFLF

SEQ ID NO: 11117 - protein, 7 aa, Artificial Sequence
  Synthetic construct
GLIHFLY

SEQ ID NO: 11118 - protein, 7 aa, Artificial Sequence
  Synthetic construct
GLIHFAF

SEQ ID NO: 11119 - protein, 7 aa, Artificial Sequence
  Synthetic construct
GLIHFAY

SEQ ID NO: 11120 - protein, 7 aa, Artificial Sequence
  Synthetic construct
GLIHFQF

SEQ ID NO: 11121 - protein, 7 aa, Artificial Sequence
  Synthetic construct
GLIHFQY

SEQ ID NO: 11122 - protein, 7 aa, Artificial Sequence
  Synthetic construct
GLIHFDF

SEQ ID NO: 11123 - protein, 7 aa, Artificial Sequence
  Synthetic construct
GLIHFDY

SEQ ID NO: 11124 - protein, 7 aa, Artificial Sequence
  Synthetic construct
GLIHFVF

SEQ ID NO: 11125 - protein, 7 aa, Artificial Sequence
  Synthetic construct
GLIHFVY

SEQ ID NO: 11126 - protein, 7 aa, Artificial Sequence
  Synthetic construct
GLIHVFF

SEQ ID NO: 11127 - protein, 7 aa, Artificial Sequence
  Synthetic construct
GLIHVFY

SEQ ID NO: 11128 - protein, 7 aa, Artificial Sequence
  Synthetic construct
GLIHVRF

SEQ ID NO: 11129 - protein, 7 aa, Artificial Sequence
  Synthetic construct
GLIHVRY

SEQ ID NO: 11130 - protein, 7 aa, Artificial Sequence
  Synthetic construct
GLIHVCF

SEQ ID NO: 11131 - protein, 7 aa, Artificial Sequence
  Synthetic construct
GLIHVCY

SEQ ID NO: 11132 - protein, 7 aa, Artificial Sequence
  Synthetic construct
GLIHVLF

SEQ ID NO: 11133 - protein, 7 aa, Artificial Sequence
  Synthetic construct
GLIHVLY

SEQ ID NO: 11134 - protein, 7 aa, Artificial Sequence
  Synthetic construct
GLIHVAF

SEQ ID NO: 11135 - protein, 7 aa, Artificial Sequence
  Synthetic construct
GLIHVAY

SEQ ID NO: 11136 - protein, 7 aa, Artificial Sequence
  Synthetic construct
GLIHVQF

SEQ ID NO: 11137 - protein, 7 aa, Artificial Sequence
  Synthetic construct
GLIHVQY

SEQ ID NO: 11138 - protein, 7 aa, Artificial Sequence
  Synthetic construct
GLIHVDF

SEQ ID NO: 11139 - protein, 7 aa, Artificial Sequence
  Synthetic construct
GLIHVDY

SEQ ID NO: 11140 - protein, 7 aa, Artificial Sequence
  Synthetic construct
GLIHVVF

SEQ ID NO: 11141 - protein, 7 aa, Artificial Sequence
  Synthetic construct
GLIHVVY

SEQ ID NO: 11142 - protein, 7 aa, Artificial Sequence
  Synthetic construct
GLIHTFF

SEQ ID NO: 11143 - protein, 7 aa, Artificial Sequence
  Synthetic construct
GLIHTFY

SEQ ID NO: 11144 - protein, 7 aa, Artificial Sequence
  Synthetic construct
GLIHTRF

SEQ ID NO: 11145 - protein, 7 aa, Artificial Sequence
  Synthetic construct
GLIHTRY

SEQ ID NO: 11146 - protein, 7 aa, Artificial Sequence
  Synthetic construct
GLIHTCF

SEQ ID NO: 11147 - protein, 7 aa, Artificial Sequence
  Synthetic construct
GLIHTCY

SEQ ID NO: 11148 - protein, 7 aa, Artificial Sequence
  Synthetic construct
GLIHTLF

SEQ ID NO: 11149 - protein, 7 aa, Artificial Sequence
  Synthetic construct
GLIHTLY

SEQ ID NO: 11150 - protein, 7 aa, Artificial Sequence
  Synthetic construct
GLIHTAF

SEQ ID NO: 11151 - protein, 7 aa, Artificial Sequence
  Synthetic construct
GLIHTAY

SEQ ID NO: 11152 - protein, 7 aa, Artificial Sequence
  Synthetic construct
GLIHTQF

SEQ ID NO: 11153 - protein, 7 aa, Artificial Sequence
  Synthetic construct
GLIHTQY

SEQ ID NO: 11154 - protein, 7 aa, Artificial Sequence
  Synthetic construct
GLIHTDF

SEQ ID NO: 11155 - protein, 7 aa, Artificial Sequence
  Synthetic construct
GLIHTDY

SEQ ID NO: 11156 - protein, 7 aa, Artificial Sequence
  Synthetic construct
GLIHTVF

SEQ ID NO: 11157 - protein, 7 aa, Artificial Sequence
  Synthetic construct
GLIHTVY

SEQ ID NO: 11158 - protein, 7 aa, Artificial Sequence
  Synthetic construct
GLIHGFF

SEQ ID NO: 11159 - protein, 7 aa, Artificial Sequence
  Synthetic construct
GLIHGFY

SEQ ID NO: 11160 - protein, 7 aa, Artificial Sequence
  Synthetic construct
GLIHGRF

SEQ ID NO: 11161 - protein, 7 aa, Artificial Sequence
  Synthetic construct
GLIHGRY

SEQ ID NO: 11162 - protein, 7 aa, Artificial Sequence
  Synthetic construct
GLIHGCF

SEQ ID NO: 11163 - protein, 7 aa, Artificial Sequence
  Synthetic construct
GLIHGCY

SEQ ID NO: 11164 - protein, 7 aa, Artificial Sequence
  Synthetic construct
GLIHGLF

SEQ ID NO: 11165 - protein, 7 aa, Artificial Sequence
  Synthetic construct
GLIHGLY

SEQ ID NO: 11166 - protein, 7 aa, Artificial Sequence
  Synthetic construct
GLIHGAF

SEQ ID NO: 11167 - protein, 7 aa, Artificial Sequence
  Synthetic construct
GLIHGAY

SEQ ID NO: 11168 - protein, 7 aa, Artificial Sequence
  Synthetic construct
GLIHGQF

SEQ ID NO: 11169 - protein, 7 aa, Artificial Sequence
  Synthetic construct
GLIHGQY

SEQ ID NO: 11170 - protein, 7 aa, Artificial Sequence
  Synthetic construct
GLIHGDF

SEQ ID NO: 11171 - protein, 7 aa, Artificial Sequence
  Synthetic construct
GLIHGDY

SEQ ID NO: 11172 - protein, 7 aa, Artificial Sequence
  Synthetic construct
GLIHGVF

SEQ ID NO: 11173 - protein, 7 aa, Artificial Sequence
  Synthetic construct
GLIHGVY

SEQ ID NO: 11174 - protein, 7 aa, Artificial Sequence
  Synthetic construct
GLIHAFF

SEQ ID NO: 11175 - protein, 7 aa, Artificial Sequence
  Synthetic construct
GLIHAFY

SEQ ID NO: 11176 - protein, 7 aa, Artificial Sequence
  Synthetic construct
GLIHARF

SEQ ID NO: 11177 - protein, 7 aa, Artificial Sequence
  Synthetic construct
GLIHARY

SEQ ID NO: 11178 - protein, 7 aa, Artificial Sequence
  Synthetic construct
GLIHACF

SEQ ID NO: 11179 - protein, 7 aa, Artificial Sequence
  Synthetic construct
GLIHACY

SEQ ID NO: 11180 - protein, 7 aa, Artificial Sequence
  Synthetic construct
GLIHALF

SEQ ID NO: 11181 - protein, 7 aa, Artificial Sequence
  Synthetic construct
GLIHALY

SEQ ID NO: 11182 - protein, 7 aa, Artificial Sequence
  Synthetic construct
GLIHAAF

SEQ ID NO: 11183 - protein, 7 aa, Artificial Sequence
  Synthetic construct
GLIHAAY

SEQ ID NO: 11184 - protein, 7 aa, Artificial Sequence
  Synthetic construct
GLIHAQF

SEQ ID NO: 11185 - protein, 7 aa, Artificial Sequence
  Synthetic construct
GLIHAQY

SEQ ID NO: 11186 - protein, 7 aa, Artificial Sequence
  Synthetic construct
GLIHADF

SEQ ID NO: 11187 - protein, 7 aa, Artificial Sequence
  Synthetic construct
GLIHADY

SEQ ID NO: 11188 - protein, 7 aa, Artificial Sequence
  Synthetic construct
GLIHAVF

SEQ ID NO: 11189 - protein, 7 aa, Artificial Sequence
  Synthetic construct
GLIHAVY

SEQ ID NO: 11190 - protein, 7 aa, Artificial Sequence
  Synthetic construct
GLIHQFF

SEQ ID NO: 11191 - protein, 7 aa, Artificial Sequence
  Synthetic construct
GLIHQFY

SEQ ID NO: 11192 - protein, 7 aa, Artificial Sequence
  Synthetic construct
GLIHQRF

SEQ ID NO: 11193 - protein, 7 aa, Artificial Sequence
  Synthetic construct
GLIHQRY

SEQ ID NO: 11194 - protein, 7 aa, Artificial Sequence
  Synthetic construct
GLIHQCF

SEQ ID NO: 11195 - protein, 7 aa, Artificial Sequence
  Synthetic construct
GLIHQCY

SEQ ID NO: 11196 - protein, 7 aa, Artificial Sequence
  Synthetic construct
GLIHQLF

SEQ ID NO: 11197 - protein, 7 aa, Artificial Sequence
  Synthetic construct
GLIHQLY

SEQ ID NO: 11198 - protein, 7 aa, Artificial Sequence
  Synthetic construct
GLIHQAF

SEQ ID NO: 11199 - protein, 7 aa, Artificial Sequence
  Synthetic construct
GLIHQAY

SEQ ID NO: 11200 - protein, 7 aa, Artificial Sequence
  Synthetic construct
GLIHQQF

SEQ ID NO: 11201 - protein, 7 aa, Artificial Sequence
  Synthetic construct
GLIHQQY

SEQ ID NO: 11202 - protein, 7 aa, Artificial Sequence
  Synthetic construct
GLIHQDF

SEQ ID NO: 11203 - protein, 7 aa, Artificial Sequence
  Synthetic construct
GLIHQDY

SEQ ID NO: 11204 - protein, 7 aa, Artificial Sequence
  Synthetic construct
GLIHQVF

SEQ ID NO: 11205 - protein, 7 aa, Artificial Sequence
  Synthetic construct
GLIHQVY

SEQ ID NO: 11206 - protein, 7 aa, Artificial Sequence
  Synthetic construct
GLILIFF

SEQ ID NO: 11207 - protein, 7 aa, Artificial Sequence
  Synthetic construct
GLILIFY

SEQ ID NO: 11208 - protein, 7 aa, Artificial Sequence
  Synthetic construct
GLILIRF

SEQ ID NO: 11209 - protein, 7 aa, Artificial Sequence
  Synthetic construct
GLILIRY

SEQ ID NO: 11210 - protein, 7 aa, Artificial Sequence
  Synthetic construct
GLILICF

SEQ ID NO: 11211 - protein, 7 aa, Artificial Sequence
  Synthetic construct
GLILICY

SEQ ID NO: 11212 - protein, 7 aa, Artificial Sequence
  Synthetic construct
GLILILF

SEQ ID NO: 11213 - protein, 7 aa, Artificial Sequence
  Synthetic construct
GLILILY

SEQ ID NO: 11214 - protein, 7 aa, Artificial Sequence
  Synthetic construct
GLILIAF

SEQ ID NO: 11215 - protein, 7 aa, Artificial Sequence
  Synthetic construct
GLILIAY

SEQ ID NO: 11216 - protein, 7 aa, Artificial Sequence
  Synthetic construct
GLILIQF

SEQ ID NO: 11217 - protein, 7 aa, Artificial Sequence
  Synthetic construct
GLILIQY

SEQ ID NO: 11218 - protein, 7 aa, Artificial Sequence
  Synthetic construct
GLILIDF

SEQ ID NO: 11219 - protein, 7 aa, Artificial Sequence
  Synthetic construct
GLILIDY

SEQ ID NO: 11220 - protein, 7 aa, Artificial Sequence
  Synthetic construct
GLILIVF

SEQ ID NO: 11221 - protein, 7 aa, Artificial Sequence
  Synthetic construct
GLILIVY

SEQ ID NO: 11222 - protein, 7 aa, Artificial Sequence
  Synthetic construct
GLILDFF

SEQ ID NO: 11223 - protein, 7 aa, Artificial Sequence
  Synthetic construct
GLILDFY

SEQ ID NO: 11224 - protein, 7 aa, Artificial Sequence
  Synthetic construct
GLILDRF

SEQ ID NO: 11225 - protein, 7 aa, Artificial Sequence
  Synthetic construct
GLILDRY

SEQ ID NO: 11226 - protein, 7 aa, Artificial Sequence
  Synthetic construct
GLILDCF

SEQ ID NO: 11227 - protein, 7 aa, Artificial Sequence
  Synthetic construct
GLILDCY

SEQ ID NO: 11228 - protein, 7 aa, Artificial Sequence
  Synthetic construct
GLILDLF

SEQ ID NO: 11229 - protein, 7 aa, Artificial Sequence
  Synthetic construct
GLILDLY

SEQ ID NO: 11230 - protein, 7 aa, Artificial Sequence
  Synthetic construct
GLILDAF

SEQ ID NO: 11231 - protein, 7 aa, Artificial Sequence
  Synthetic construct
GLILDAY

SEQ ID NO: 11232 - protein, 7 aa, Artificial Sequence
  Synthetic construct
GLILDQF

SEQ ID NO: 11233 - protein, 7 aa, Artificial Sequence
  Synthetic construct
GLILDQY

SEQ ID NO: 11234 - protein, 7 aa, Artificial Sequence
  Synthetic construct
GLILDDF

SEQ ID NO: 11235 - protein, 7 aa, Artificial Sequence
  Synthetic construct
GLILDDY

SEQ ID NO: 11236 - protein, 7 aa, Artificial Sequence
  Synthetic construct
GLILDVF

SEQ ID NO: 11237 - protein, 7 aa, Artificial Sequence
  Synthetic construct
GLILDVY

SEQ ID NO: 11238 - protein, 7 aa, Artificial Sequence
  Synthetic construct
GLILYFF

SEQ ID NO: 11239 - protein, 7 aa, Artificial Sequence
  Synthetic construct
GLILYFY

SEQ ID NO: 11240 - protein, 7 aa, Artificial Sequence
  Synthetic construct
GLILYRF

SEQ ID NO: 11241 - protein, 7 aa, Artificial Sequence
  Synthetic construct
GLILYRY

SEQ ID NO: 11242 - protein, 7 aa, Artificial Sequence
  Synthetic construct
GLILYCF

SEQ ID NO: 11243 - protein, 7 aa, Artificial Sequence
  Synthetic construct
GLILYCY

SEQ ID NO: 11244 - protein, 7 aa, Artificial Sequence
  Synthetic construct
GLILYLF

SEQ ID NO: 11245 - protein, 7 aa, Artificial Sequence
  Synthetic construct
GLILYLY

SEQ ID NO: 11246 - protein, 7 aa, Artificial Sequence
  Synthetic construct
GLILYAF

SEQ ID NO: 11247 - protein, 7 aa, Artificial Sequence
  Synthetic construct
GLILYAY

SEQ ID NO: 11248 - protein, 7 aa, Artificial Sequence
  Synthetic construct
GLILYQF

SEQ ID NO: 11249 - protein, 7 aa, Artificial Sequence
  Synthetic construct
GLILYQY

SEQ ID NO: 11250 - protein, 7 aa, Artificial Sequence
  Synthetic construct
GLILYDF

SEQ ID NO: 11251 - protein, 7 aa, Artificial Sequence
  Synthetic construct
GLILYDY

SEQ ID NO: 11252 - protein, 7 aa, Artificial Sequence
  Synthetic construct
GLILYVF

SEQ ID NO: 11253 - protein, 7 aa, Artificial Sequence
  Synthetic construct
GLILYVY

SEQ ID NO: 11254 - protein, 7 aa, Artificial Sequence
  Synthetic construct
GLILFFF

SEQ ID NO: 11255 - protein, 7 aa, Artificial Sequence
  Synthetic construct
GLILFFY

SEQ ID NO: 11256 - protein, 7 aa, Artificial Sequence
  Synthetic construct
GLILFRF

SEQ ID NO: 11257 - protein, 7 aa, Artificial Sequence
  Synthetic construct
GLILFRY

SEQ ID NO: 11258 - protein, 7 aa, Artificial Sequence
  Synthetic construct
GLILFCF

SEQ ID NO: 11259 - protein, 7 aa, Artificial Sequence
  Synthetic construct
GLILFCY

SEQ ID NO: 11260 - protein, 7 aa, Artificial Sequence
  Synthetic construct
GLILFLF

SEQ ID NO: 11261 - protein, 7 aa, Artificial Sequence
  Synthetic construct
GLILFLY

SEQ ID NO: 11262 - protein, 7 aa, Artificial Sequence
  Synthetic construct
GLILFAF

SEQ ID NO: 11263 - protein, 7 aa, Artificial Sequence
  Synthetic construct
GLILFAY

SEQ ID NO: 11264 - protein, 7 aa, Artificial Sequence
  Synthetic construct
GLILFQF

SEQ ID NO: 11265 - protein, 7 aa, Artificial Sequence
  Synthetic construct
GLILFQY

SEQ ID NO: 11266 - protein, 7 aa, Artificial Sequence
  Synthetic construct
GLILFDF

SEQ ID NO: 11267 - protein, 7 aa, Artificial Sequence
  Synthetic construct
GLILFDY

SEQ ID NO: 11268 - protein, 7 aa, Artificial Sequence
  Synthetic construct
GLILFVF

SEQ ID NO: 11269 - protein, 7 aa, Artificial Sequence
  Synthetic construct
GLILFVY

SEQ ID NO: 11270 - protein, 7 aa, Artificial Sequence
  Synthetic construct
GLILVFF

SEQ ID NO: 11271 - protein, 7 aa, Artificial Sequence
  Synthetic construct
GLILVFY

SEQ ID NO: 11272 - protein, 7 aa, Artificial Sequence
  Synthetic construct
GLILVRF

SEQ ID NO: 11273 - protein, 7 aa, Artificial Sequence
  Synthetic construct
GLILVRY

SEQ ID NO: 11274 - protein, 7 aa, Artificial Sequence
  Synthetic construct
GLILVCF

SEQ ID NO: 11275 - protein, 7 aa, Artificial Sequence
  Synthetic construct
GLILVCY

SEQ ID NO: 11276 - protein, 7 aa, Artificial Sequence
  Synthetic construct
GLILVLF

SEQ ID NO: 11277 - protein, 7 aa, Artificial Sequence
  Synthetic construct
GLILVLY

SEQ ID NO: 11278 - protein, 7 aa, Artificial Sequence
  Synthetic construct
GLILVAF

SEQ ID NO: 11279 - protein, 7 aa, Artificial Sequence
  Synthetic construct
GLILVAY

SEQ ID NO: 11280 - protein, 7 aa, Artificial Sequence
  Synthetic construct
GLILVQF

SEQ ID NO: 11281 - protein, 7 aa, Artificial Sequence
  Synthetic construct
GLILVQY

SEQ ID NO: 11282 - protein, 7 aa, Artificial Sequence
  Synthetic construct
GLILVDF

SEQ ID NO: 11283 - protein, 7 aa, Artificial Sequence
  Synthetic construct
GLILVDY

SEQ ID NO: 11284 - protein, 7 aa, Artificial Sequence
  Synthetic construct
GLILVVF

SEQ ID NO: 11285 - protein, 7 aa, Artificial Sequence
  Synthetic construct
GLILVVY

SEQ ID NO: 11286 - protein, 7 aa, Artificial Sequence
  Synthetic construct
GLILTFF

SEQ ID NO: 11287 - protein, 7 aa, Artificial Sequence
  Synthetic construct
GLILTFY

SEQ ID NO: 11288 - protein, 7 aa, Artificial Sequence
  Synthetic construct
GLILTRF

SEQ ID NO: 11289 - protein, 7 aa, Artificial Sequence
  Synthetic construct
GLILTRY

SEQ ID NO: 11290 - protein, 7 aa, Artificial Sequence
  Synthetic construct
GLILTCF

SEQ ID NO: 11291 - protein, 7 aa, Artificial Sequence
  Synthetic construct
GLILTCY

SEQ ID NO: 11292 - protein, 7 aa, Artificial Sequence
  Synthetic construct
GLILTLF

SEQ ID NO: 11293 - protein, 7 aa, Artificial Sequence
  Synthetic construct
GLILTLY

SEQ ID NO: 11294 - protein, 7 aa, Artificial Sequence
  Synthetic construct
GLILTAF

SEQ ID NO: 11295 - protein, 7 aa, Artificial Sequence
  Synthetic construct
GLILTAY

SEQ ID NO: 11296 - protein, 7 aa, Artificial Sequence
  Synthetic construct
GLILTQF

SEQ ID NO: 11297 - protein, 7 aa, Artificial Sequence
  Synthetic construct
GLILTQY

SEQ ID NO: 11298 - protein, 7 aa, Artificial Sequence
  Synthetic construct
GLILTDF

SEQ ID NO: 11299 - protein, 7 aa, Artificial Sequence
  Synthetic construct
GLILTDY

SEQ ID NO: 11300 - protein, 7 aa, Artificial Sequence
  Synthetic construct
GLILTVF

SEQ ID NO: 11301 - protein, 7 aa, Artificial Sequence
  Synthetic construct
GLILTVY

SEQ ID NO: 11302 - protein, 7 aa, Artificial Sequence
  Synthetic construct
GLILGFF

SEQ ID NO: 11303 - protein, 7 aa, Artificial Sequence
  Synthetic construct
GLILGFY

SEQ ID NO: 11304 - protein, 7 aa, Artificial Sequence
  Synthetic construct
GLILGRF

SEQ ID NO: 11305 - protein, 7 aa, Artificial Sequence
  Synthetic construct
GLILGRY

SEQ ID NO: 11306 - protein, 7 aa, Artificial Sequence
  Synthetic construct
GLILGCF

SEQ ID NO: 11307 - protein, 7 aa, Artificial Sequence
  Synthetic construct
GLILGCY

SEQ ID NO: 11308 - protein, 7 aa, Artificial Sequence
  Synthetic construct
GLILGLF

SEQ ID NO: 11309 - protein, 7 aa, Artificial Sequence
  Synthetic construct
GLILGLY

SEQ ID NO: 11310 - protein, 7 aa, Artificial Sequence
  Synthetic construct
GLILGAF

SEQ ID NO: 11311 - protein, 7 aa, Artificial Sequence
  Synthetic construct
GLILGAY

SEQ ID NO: 11312 - protein, 7 aa, Artificial Sequence
  Synthetic construct
GLILGQF

SEQ ID NO: 11313 - protein, 7 aa, Artificial Sequence
  Synthetic construct
GLILGQY

SEQ ID NO: 11314 - protein, 7 aa, Artificial Sequence
  Synthetic construct
GLILGDF

SEQ ID NO: 11315 - protein, 7 aa, Artificial Sequence
  Synthetic construct
GLILGDY

SEQ ID NO: 11316 - protein, 7 aa, Artificial Sequence
  Synthetic construct
GLILGVF

SEQ ID NO: 11317 - protein, 7 aa, Artificial Sequence
  Synthetic construct
GLILGVY

SEQ ID NO: 11318 - protein, 7 aa, Artificial Sequence
  Synthetic construct
GLILAFF

SEQ ID NO: 11319 - protein, 7 aa, Artificial Sequence
  Synthetic construct
GLILAFY

SEQ ID NO: 11320 - protein, 7 aa, Artificial Sequence
  Synthetic construct
GLILARF

SEQ ID NO: 11321 - protein, 7 aa, Artificial Sequence
  Synthetic construct
GLILARY

SEQ ID NO: 11322 - protein, 7 aa, Artificial Sequence
  Synthetic construct
GLILACF

SEQ ID NO: 11323 - protein, 7 aa, Artificial Sequence
  Synthetic construct
GLILACY

SEQ ID NO: 11324 - protein, 7 aa, Artificial Sequence
  Synthetic construct
GLILALF

SEQ ID NO: 11325 - protein, 7 aa, Artificial Sequence
  Synthetic construct
GLILALY

SEQ ID NO: 11326 - protein, 7 aa, Artificial Sequence
  Synthetic construct
GLILAAF

SEQ ID NO: 11327 - protein, 7 aa, Artificial Sequence
  Synthetic construct
GLILAAY

SEQ ID NO: 11328 - protein, 7 aa, Artificial Sequence
  Synthetic construct
GLILAQF

SEQ ID NO: 11329 - protein, 7 aa, Artificial Sequence
  Synthetic construct
GLILAQY

SEQ ID NO: 11330 - protein, 7 aa, Artificial Sequence
  Synthetic construct
GLILADF

SEQ ID NO: 11331 - protein, 7 aa, Artificial Sequence
  Synthetic construct
GLILADY

SEQ ID NO: 11332 - protein, 7 aa, Artificial Sequence
  Synthetic construct
GLILAVF

SEQ ID NO: 11333 - protein, 7 aa, Artificial Sequence
  Synthetic construct
GLILAVY

SEQ ID NO: 11334 - protein, 7 aa, Artificial Sequence
  Synthetic construct
GLILQFF

SEQ ID NO: 11335 - protein, 7 aa, Artificial Sequence
  Synthetic construct
GLILQFY

SEQ ID NO: 11336 - protein, 7 aa, Artificial Sequence
  Synthetic construct
GLILQRF

SEQ ID NO: 11337 - protein, 7 aa, Artificial Sequence
  Synthetic construct
GLILQRY

SEQ ID NO: 11338 - protein, 7 aa, Artificial Sequence
  Synthetic construct
GLILQCF

SEQ ID NO: 11339 - protein, 7 aa, Artificial Sequence
  Synthetic construct
GLILQCY

SEQ ID NO: 11340 - protein, 7 aa, Artificial Sequence
  Synthetic construct
GLILQLF

SEQ ID NO: 11341 - protein, 7 aa, Artificial Sequence
  Synthetic construct
GLILQLY

SEQ ID NO: 11342 - protein, 7 aa, Artificial Sequence
  Synthetic construct
GLILQAF

SEQ ID NO: 11343 - protein, 7 aa, Artificial Sequence
  Synthetic construct
GLILQAY

SEQ ID NO: 11344 - protein, 7 aa, Artificial Sequence
  Synthetic construct
GLILQQF

SEQ ID NO: 11345 - protein, 7 aa, Artificial Sequence
  Synthetic construct
GLILQQY

SEQ ID NO: 11346 - protein, 7 aa, Artificial Sequence
  Synthetic construct
GLILQDF

SEQ ID NO: 11347 - protein, 7 aa, Artificial Sequence
  Synthetic construct
GLILQDY

SEQ ID NO: 11348 - protein, 7 aa, Artificial Sequence
  Synthetic construct
GLILQVF

SEQ ID NO: 11349 - protein, 7 aa, Artificial Sequence
  Synthetic construct
GLILQVY

SEQ ID NO: 11350 - protein, 7 aa, Artificial Sequence
  Synthetic construct
GLIFIFF

SEQ ID NO: 11351 - protein, 7 aa, Artificial Sequence
  Synthetic construct
GLIFIFY

SEQ ID NO: 11352 - protein, 7 aa, Artificial Sequence
  Synthetic construct
GLIFIRF

SEQ ID NO: 11353 - protein, 7 aa, Artificial Sequence
  Synthetic construct
GLIFIRY

SEQ ID NO: 11354 - protein, 7 aa, Artificial Sequence
  Synthetic construct
GLIFICF

SEQ ID NO: 11355 - protein, 7 aa, Artificial Sequence
  Synthetic construct
GLIFICY

SEQ ID NO: 11356 - protein, 7 aa, Artificial Sequence
  Synthetic construct
GLIFILF

SEQ ID NO: 11357 - protein, 7 aa, Artificial Sequence
  Synthetic construct
GLIFILY

SEQ ID NO: 11358 - protein, 7 aa, Artificial Sequence
  Synthetic construct
GLIFIAF

SEQ ID NO: 11359 - protein, 7 aa, Artificial Sequence
  Synthetic construct
GLIFIAY

SEQ ID NO: 11360 - protein, 7 aa, Artificial Sequence
  Synthetic construct
GLIFIQF

SEQ ID NO: 11361 - protein, 7 aa, Artificial Sequence
  Synthetic construct
GLIFIQY

SEQ ID NO: 11362 - protein, 7 aa, Artificial Sequence
  Synthetic construct
GLIFIDF

SEQ ID NO: 11363 - protein, 7 aa, Artificial Sequence
  Synthetic construct
GLIFIDY

SEQ ID NO: 11364 - protein, 7 aa, Artificial Sequence
  Synthetic construct
GLIFIVF

SEQ ID NO: 11365 - protein, 7 aa, Artificial Sequence
  Synthetic construct
GLIFIVY

SEQ ID NO: 11366 - protein, 7 aa, Artificial Sequence
  Synthetic construct
GLIFDFF

SEQ ID NO: 11367 - protein, 7 aa, Artificial Sequence
  Synthetic construct
GLIFDFY

SEQ ID NO: 11368 - protein, 7 aa, Artificial Sequence
  Synthetic construct
GLIFDRF

SEQ ID NO: 11369 - protein, 7 aa, Artificial Sequence
  Synthetic construct
GLIFDRY

SEQ ID NO: 11370 - protein, 7 aa, Artificial Sequence
  Synthetic construct
GLIFDCF

SEQ ID NO: 11371 - protein, 7 aa, Artificial Sequence
  Synthetic construct
GLIFDCY

SEQ ID NO: 11372 - protein, 7 aa, Artificial Sequence
  Synthetic construct
GLIFDLF

SEQ ID NO: 11373 - protein, 7 aa, Artificial Sequence
  Synthetic construct
GLIFDLY

SEQ ID NO: 11374 - protein, 7 aa, Artificial Sequence
  Synthetic construct
GLIFDAF

SEQ ID NO: 11375 - protein, 7 aa, Artificial Sequence
  Synthetic construct
GLIFDAY

SEQ ID NO: 11376 - protein, 7 aa, Artificial Sequence
  Synthetic construct
GLIFDQF

SEQ ID NO: 11377 - protein, 7 aa, Artificial Sequence
  Synthetic construct
GLIFDQY

SEQ ID NO: 11378 - protein, 7 aa, Artificial Sequence
  Synthetic construct
GLIFDDF

SEQ ID NO: 11379 - protein, 7 aa, Artificial Sequence
  Synthetic construct
GLIFDDY

SEQ ID NO: 11380 - protein, 7 aa, Artificial Sequence
  Synthetic construct
GLIFDVF

SEQ ID NO: 11381 - protein, 7 aa, Artificial Sequence
  Synthetic construct
GLIFDVY

SEQ ID NO: 11382 - protein, 7 aa, Artificial Sequence
  Synthetic construct
GLIFYFF

SEQ ID NO: 11383 - protein, 7 aa, Artificial Sequence
  Synthetic construct
GLIFYFY

SEQ ID NO: 11384 - protein, 7 aa, Artificial Sequence
  Synthetic construct
GLIFYRF

SEQ ID NO: 11385 - protein, 7 aa, Artificial Sequence
  Synthetic construct
GLIFYRY

SEQ ID NO: 11386 - protein, 7 aa, Artificial Sequence
  Synthetic construct
GLIFYCF

SEQ ID NO: 11387 - protein, 7 aa, Artificial Sequence
  Synthetic construct
GLIFYCY

SEQ ID NO: 11388 - protein, 7 aa, Artificial Sequence
  Synthetic construct
GLIFYLF

SEQ ID NO: 11389 - protein, 7 aa, Artificial Sequence
  Synthetic construct
GLIFYLY

SEQ ID NO: 11390 - protein, 7 aa, Artificial Sequence
  Synthetic construct
GLIFYAF

SEQ ID NO: 11391 - protein, 7 aa, Artificial Sequence
  Synthetic construct
GLIFYAY

SEQ ID NO: 11392 - protein, 7 aa, Artificial Sequence
  Synthetic construct
GLIFYQF

SEQ ID NO: 11393 - protein, 7 aa, Artificial Sequence
  Synthetic construct
GLIFYQY

SEQ ID NO: 11394 - protein, 7 aa, Artificial Sequence
  Synthetic construct
GLIFYDF

SEQ ID NO: 11395 - protein, 7 aa, Artificial Sequence
  Synthetic construct
GLIFYDY

SEQ ID NO: 11396 - protein, 7 aa, Artificial Sequence
  Synthetic construct
GLIFYVF

SEQ ID NO: 11397 - protein, 7 aa, Artificial Sequence
  Synthetic construct
GLIFYVY

SEQ ID NO: 11398 - protein, 7 aa, Artificial Sequence
  Synthetic construct
GLIFFFF

SEQ ID NO: 11399 - protein, 7 aa, Artificial Sequence
  Synthetic construct
GLIFFFY

SEQ ID NO: 11400 - protein, 7 aa, Artificial Sequence
  Synthetic construct
GLIFFRF

SEQ ID NO: 11401 - protein, 7 aa, Artificial Sequence
  Synthetic construct
GLIFFRY

SEQ ID NO: 11402 - protein, 7 aa, Artificial Sequence
  Synthetic construct
GLIFFCF

SEQ ID NO: 11403 - protein, 7 aa, Artificial Sequence
  Synthetic construct
GLIFFCY

SEQ ID NO: 11404 - protein, 7 aa, Artificial Sequence
  Synthetic construct
GLIFFLF

SEQ ID NO: 11405 - protein, 7 aa, Artificial Sequence
  Synthetic construct
GLIFFLY

SEQ ID NO: 11406 - protein, 7 aa, Artificial Sequence
  Synthetic construct
GLIFFAF

SEQ ID NO: 11407 - protein, 7 aa, Artificial Sequence
  Synthetic construct
GLIFFAY

SEQ ID NO: 11408 - protein, 7 aa, Artificial Sequence
  Synthetic construct
GLIFFQF

SEQ ID NO: 11409 - protein, 7 aa, Artificial Sequence
  Synthetic construct
GLIFFQY

SEQ ID NO: 11410 - protein, 7 aa, Artificial Sequence
  Synthetic construct
GLIFFDF

SEQ ID NO: 11411 - protein, 7 aa, Artificial Sequence
  Synthetic construct
GLIFFDY

SEQ ID NO: 11412 - protein, 7 aa, Artificial Sequence
  Synthetic construct
GLIFFVF

SEQ ID NO: 11413 - protein, 7 aa, Artificial Sequence
  Synthetic construct
GLIFFVY

SEQ ID NO: 11414 - protein, 7 aa, Artificial Sequence
  Synthetic construct
GLIFVFF

SEQ ID NO: 11415 - protein, 7 aa, Artificial Sequence
  Synthetic construct
GLIFVFY

SEQ ID NO: 11416 - protein, 7 aa, Artificial Sequence
  Synthetic construct
GLIFVRF

SEQ ID NO: 11417 - protein, 7 aa, Artificial Sequence
  Synthetic construct
GLIFVRY

SEQ ID NO: 11418 - protein, 7 aa, Artificial Sequence
  Synthetic construct
GLIFVCF

SEQ ID NO: 11419 - protein, 7 aa, Artificial Sequence
  Synthetic construct
GLIFVCY

SEQ ID NO: 11420 - protein, 7 aa, Artificial Sequence
  Synthetic construct
GLIFVLF

SEQ ID NO: 11421 - protein, 7 aa, Artificial Sequence
  Synthetic construct
GLIFVLY

SEQ ID NO: 11422 - protein, 7 aa, Artificial Sequence
  Synthetic construct
GLIFVAF

SEQ ID NO: 11423 - protein, 7 aa, Artificial Sequence
  Synthetic construct
GLIFVAY

SEQ ID NO: 11424 - protein, 7 aa, Artificial Sequence
  Synthetic construct
GLIFVQF

SEQ ID NO: 11425 - protein, 7 aa, Artificial Sequence
  Synthetic construct
GLIFVQY

SEQ ID NO: 11426 - protein, 7 aa, Artificial Sequence
  Synthetic construct
GLIFVDF

SEQ ID NO: 11427 - protein, 7 aa, Artificial Sequence
  Synthetic construct
GLIFVDY

SEQ ID NO: 11428 - protein, 7 aa, Artificial Sequence
  Synthetic construct
GLIFVVF

SEQ ID NO: 11429 - protein, 7 aa, Artificial Sequence
  Synthetic construct
GLIFVVY

SEQ ID NO: 11430 - protein, 7 aa, Artificial Sequence
  Synthetic construct
GLIFTFF

SEQ ID NO: 11431 - protein, 7 aa, Artificial Sequence
  Synthetic construct
GLIFTFY

SEQ ID NO: 11432 - protein, 7 aa, Artificial Sequence
  Synthetic construct
GLIFTRF

SEQ ID NO: 11433 - protein, 7 aa, Artificial Sequence
  Synthetic construct
GLIFTRY

SEQ ID NO: 11434 - protein, 7 aa, Artificial Sequence
  Synthetic construct
GLIFTCF

SEQ ID NO: 11435 - protein, 7 aa, Artificial Sequence
  Synthetic construct
GLIFTCY

SEQ ID NO: 11436 - protein, 7 aa, Artificial Sequence
  Synthetic construct
GLIFTLF

SEQ ID NO: 11437 - protein, 7 aa, Artificial Sequence
  Synthetic construct
GLIFTLY

SEQ ID NO: 11438 - protein, 7 aa, Artificial Sequence
  Synthetic construct
GLIFTAF

SEQ ID NO: 11439 - protein, 7 aa, Artificial Sequence
  Synthetic construct
GLIFTAY

SEQ ID NO: 11440 - protein, 7 aa, Artificial Sequence
  Synthetic construct
GLIFTQF

SEQ ID NO: 11441 - protein, 7 aa, Artificial Sequence
  Synthetic construct
GLIFTQY

SEQ ID NO: 11442 - protein, 7 aa, Artificial Sequence
  Synthetic construct
GLIFTDF

SEQ ID NO: 11443 - protein, 7 aa, Artificial Sequence
  Synthetic construct
GLIFTDY

SEQ ID NO: 11444 - protein, 7 aa, Artificial Sequence
  Synthetic construct
GLIFTVF

SEQ ID NO: 11445 - protein, 7 aa, Artificial Sequence
  Synthetic construct
GLIFTVY

SEQ ID NO: 11446 - protein, 7 aa, Artificial Sequence
  Synthetic construct
GLIFGFF

SEQ ID NO: 11447 - protein, 7 aa, Artificial Sequence
  Synthetic construct
GLIFGFY

SEQ ID NO: 11448 - protein, 7 aa, Artificial Sequence
  Synthetic construct
GLIFGRF

SEQ ID NO: 11449 - protein, 7 aa, Artificial Sequence
  Synthetic construct
GLIFGRY

SEQ ID NO: 11450 - protein, 7 aa, Artificial Sequence
  Synthetic construct
GLIFGCF

SEQ ID NO: 11451 - protein, 7 aa, Artificial Sequence
  Synthetic construct
GLIFGCY

SEQ ID NO: 11452 - protein, 7 aa, Artificial Sequence
  Synthetic construct
GLIFGLF

SEQ ID NO: 11453 - protein, 7 aa, Artificial Sequence
  Synthetic construct
GLIFGLY

SEQ ID NO: 11454 - protein, 7 aa, Artificial Sequence
  Synthetic construct
GLIFGAF

SEQ ID NO: 11455 - protein, 7 aa, Artificial Sequence
  Synthetic construct
GLIFGAY

SEQ ID NO: 11456 - protein, 7 aa, Artificial Sequence
  Synthetic construct
GLIFGQF

SEQ ID NO: 11457 - protein, 7 aa, Artificial Sequence
  Synthetic construct
GLIFGQY

SEQ ID NO: 11458 - protein, 7 aa, Artificial Sequence
  Synthetic construct
GLIFGDF

SEQ ID NO: 11459 - protein, 7 aa, Artificial Sequence
  Synthetic construct
GLIFGDY

SEQ ID NO: 11460 - protein, 7 aa, Artificial Sequence
  Synthetic construct
GLIFGVF

SEQ ID NO: 11461 - protein, 7 aa, Artificial Sequence
  Synthetic construct
GLIFGVY

SEQ ID NO: 11462 - protein, 7 aa, Artificial Sequence
  Synthetic construct
GLIFAFF

SEQ ID NO: 11463 - protein, 7 aa, Artificial Sequence
  Synthetic construct
GLIFAFY

SEQ ID NO: 11464 - protein, 7 aa, Artificial Sequence
  Synthetic construct
GLIFARF

SEQ ID NO: 11465 - protein, 7 aa, Artificial Sequence
  Synthetic construct
GLIFARY

SEQ ID NO: 11466 - protein, 7 aa, Artificial Sequence
  Synthetic construct
GLIFACF

SEQ ID NO: 11467 - protein, 7 aa, Artificial Sequence
  Synthetic construct
GLIFACY

SEQ ID NO: 11468 - protein, 7 aa, Artificial Sequence
  Synthetic construct
GLIFALF

SEQ ID NO: 11469 - protein, 7 aa, Artificial Sequence
  Synthetic construct
GLIFALY

SEQ ID NO: 11470 - protein, 7 aa, Artificial Sequence
  Synthetic construct
GLIFAAF

SEQ ID NO: 11471 - protein, 7 aa, Artificial Sequence
  Synthetic construct
GLIFAAY

SEQ ID NO: 11472 - protein, 7 aa, Artificial Sequence
  Synthetic construct
GLIFAQF

SEQ ID NO: 11473 - protein, 7 aa, Artificial Sequence
  Synthetic construct
GLIFAQY

SEQ ID NO: 11474 - protein, 7 aa, Artificial Sequence
  Synthetic construct
GLIFADF

SEQ ID NO: 11475 - protein, 7 aa, Artificial Sequence
  Synthetic construct
GLIFADY

SEQ ID NO: 11476 - protein, 7 aa, Artificial Sequence
  Synthetic construct
GLIFAVF

SEQ ID NO: 11477 - protein, 7 aa, Artificial Sequence
  Synthetic construct
GLIFAVY

SEQ ID NO: 11478 - protein, 7 aa, Artificial Sequence
  Synthetic construct
GLIFQFF

SEQ ID NO: 11479 - protein, 7 aa, Artificial Sequence
  Synthetic construct
GLIFQFY

SEQ ID NO: 11480 - protein, 7 aa, Artificial Sequence
  Synthetic construct
GLIFQRF

SEQ ID NO: 11481 - protein, 7 aa, Artificial Sequence
  Synthetic construct
GLIFQRY

SEQ ID NO: 11482 - protein, 7 aa, Artificial Sequence
  Synthetic construct
GLIFQCF

SEQ ID NO: 11483 - protein, 7 aa, Artificial Sequence
  Synthetic construct
GLIFQCY

SEQ ID NO: 11484 - protein, 7 aa, Artificial Sequence
  Synthetic construct
GLIFQLF

SEQ ID NO: 11485 - protein, 7 aa, Artificial Sequence
  Synthetic construct
GLIFQLY

SEQ ID NO: 11486 - protein, 7 aa, Artificial Sequence
  Synthetic construct
GLIFQAF

SEQ ID NO: 11487 - protein, 7 aa, Artificial Sequence
  Synthetic construct
GLIFQAY

SEQ ID NO: 11488 - protein, 7 aa, Artificial Sequence
  Synthetic construct
GLIFQQF

SEQ ID NO: 11489 - protein, 7 aa, Artificial Sequence
  Synthetic construct
GLIFQQY

SEQ ID NO: 11490 - protein, 7 aa, Artificial Sequence
  Synthetic construct
GLIFQDF

SEQ ID NO: 11491 - protein, 7 aa, Artificial Sequence
  Synthetic construct
GLIFQDY

SEQ ID NO: 11492 - protein, 7 aa, Artificial Sequence
  Synthetic construct
GLIFQVF

SEQ ID NO: 11493 - protein, 7 aa, Artificial Sequence
  Synthetic construct
GLIFQVY

SEQ ID NO: 11494 - protein, 7 aa, Artificial Sequence
  Synthetic construct
GLGYIFF

SEQ ID NO: 11495 - protein, 7 aa, Artificial Sequence
  Synthetic construct
GLGYIFY

SEQ ID NO: 11496 - protein, 7 aa, Artificial Sequence
  Synthetic construct
GLGYIRF

SEQ ID NO: 11497 - protein, 7 aa, Artificial Sequence
  Synthetic construct
GLGYIRY

SEQ ID NO: 11498 - protein, 7 aa, Artificial Sequence
  Synthetic construct
GLGYICF

SEQ ID NO: 11499 - protein, 7 aa, Artificial Sequence
  Synthetic construct
GLGYICY

SEQ ID NO: 11500 - protein, 7 aa, Artificial Sequence
  Synthetic construct
GLGYILF

SEQ ID NO: 11501 - protein, 7 aa, Artificial Sequence
  Synthetic construct
GLGYILY

SEQ ID NO: 11502 - protein, 7 aa, Artificial Sequence
  Synthetic construct
GLGYIAF

SEQ ID NO: 11503 - protein, 7 aa, Artificial Sequence
  Synthetic construct
GLGYIAY

SEQ ID NO: 11504 - protein, 7 aa, Artificial Sequence
  Synthetic construct
GLGYIQF

SEQ ID NO: 11505 - protein, 7 aa, Artificial Sequence
  Synthetic construct
GLGYIQY

SEQ ID NO: 11506 - protein, 7 aa, Artificial Sequence
  Synthetic construct
GLGYIDF

SEQ ID NO: 11507 - protein, 7 aa, Artificial Sequence
  Synthetic construct
GLGYIDY

SEQ ID NO: 11508 - protein, 7 aa, Artificial Sequence
  Synthetic construct
GLGYIVF

SEQ ID NO: 11509 - protein, 7 aa, Artificial Sequence
  Synthetic construct
GLGYIVY

SEQ ID NO: 11510 - protein, 7 aa, Artificial Sequence
  Synthetic construct
GLGYDFF

SEQ ID NO: 11511 - protein, 7 aa, Artificial Sequence
  Synthetic construct
GLGYDFY

SEQ ID NO: 11512 - protein, 7 aa, Artificial Sequence
  Synthetic construct
GLGYDRF

SEQ ID NO: 11513 - protein, 7 aa, Artificial Sequence
  Synthetic construct
GLGYDRY

SEQ ID NO: 11514 - protein, 7 aa, Artificial Sequence
  Synthetic construct
GLGYDCF

SEQ ID NO: 11515 - protein, 7 aa, Artificial Sequence
  Synthetic construct
GLGYDCY

SEQ ID NO: 11516 - protein, 7 aa, Artificial Sequence
  Synthetic construct
GLGYDLF

SEQ ID NO: 11517 - protein, 7 aa, Artificial Sequence
  Synthetic construct
GLGYDLY

SEQ ID NO: 11518 - protein, 7 aa, Artificial Sequence
  Synthetic construct
GLGYDAF

SEQ ID NO: 11519 - protein, 7 aa, Artificial Sequence
  Synthetic construct
GLGYDAY

SEQ ID NO: 11520 - protein, 7 aa, Artificial Sequence
  Synthetic construct
GLGYDQF

SEQ ID NO: 11521 - protein, 7 aa, Artificial Sequence
  Synthetic construct
GLGYDQY

SEQ ID NO: 11522 - protein, 7 aa, Artificial Sequence
  Synthetic construct
GLGYDDF

SEQ ID NO: 11523 - protein, 7 aa, Artificial Sequence
  Synthetic construct
GLGYDDY

SEQ ID NO: 11524 - protein, 7 aa, Artificial Sequence
  Synthetic construct
GLGYDVF

SEQ ID NO: 11525 - protein, 7 aa, Artificial Sequence
  Synthetic construct
GLGYDVY

SEQ ID NO: 11526 - protein, 7 aa, Artificial Sequence
  Synthetic construct
GLGYYFF

SEQ ID NO: 11527 - protein, 7 aa, Artificial Sequence
  Synthetic construct
GLGYYFY

SEQ ID NO: 11528 - protein, 7 aa, Artificial Sequence
  Synthetic construct
GLGYYRF

SEQ ID NO: 11529 - protein, 7 aa, Artificial Sequence
  Synthetic construct
GLGYYRY

SEQ ID NO: 11530 - protein, 7 aa, Artificial Sequence
  Synthetic construct
GLGYYCF

SEQ ID NO: 11531 - protein, 7 aa, Artificial Sequence
  Synthetic construct
GLGYYCY

SEQ ID NO: 11532 - protein, 7 aa, Artificial Sequence
  Synthetic construct
GLGYYLF

SEQ ID NO: 11533 - protein, 7 aa, Artificial Sequence
  Synthetic construct
GLGYYLY

SEQ ID NO: 11534 - protein, 7 aa, Artificial Sequence
  Synthetic construct
GLGYYAF

SEQ ID NO: 11535 - protein, 7 aa, Artificial Sequence
  Synthetic construct
GLGYYAY

SEQ ID NO: 11536 - protein, 7 aa, Artificial Sequence
  Synthetic construct
GLGYYQF

SEQ ID NO: 11537 - protein, 7 aa, Artificial Sequence
  Synthetic construct
GLGYYQY

SEQ ID NO: 11538 - protein, 7 aa, Artificial Sequence
  Synthetic construct
GLGYYDF

SEQ ID NO: 11539 - protein, 7 aa, Artificial Sequence
  Synthetic construct
GLGYYDY

SEQ ID NO: 11540 - protein, 7 aa, Artificial Sequence
  Synthetic construct
GLGYYVF

SEQ ID NO: 11541 - protein, 7 aa, Artificial Sequence
  Synthetic construct
GLGYYVY

SEQ ID NO: 11542 - protein, 7 aa, Artificial Sequence
  Synthetic construct
GLGYFFF

SEQ ID NO: 11543 - protein, 7 aa, Artificial Sequence
  Synthetic construct
GLGYFFY

SEQ ID NO: 11544 - protein, 7 aa, Artificial Sequence
  Synthetic construct
GLGYFRF

SEQ ID NO: 11545 - protein, 7 aa, Artificial Sequence
  Synthetic construct
GLGYFRY

SEQ ID NO: 11546 - protein, 7 aa, Artificial Sequence
  Synthetic construct
GLGYFCF

SEQ ID NO: 11547 - protein, 7 aa, Artificial Sequence
  Synthetic construct
GLGYFCY

SEQ ID NO: 11548 - protein, 7 aa, Artificial Sequence
  Synthetic construct
GLGYFLF

SEQ ID NO: 11549 - protein, 7 aa, Artificial Sequence
  Synthetic construct
GLGYFLY

SEQ ID NO: 11550 - protein, 7 aa, Artificial Sequence
  Synthetic construct
GLGYFAF

SEQ ID NO: 11551 - protein, 7 aa, Artificial Sequence
  Synthetic construct
GLGYFAY

SEQ ID NO: 11552 - protein, 7 aa, Artificial Sequence
  Synthetic construct
GLGYFQF

SEQ ID NO: 11553 - protein, 7 aa, Artificial Sequence
  Synthetic construct
GLGYFQY

SEQ ID NO: 11554 - protein, 7 aa, Artificial Sequence
  Synthetic construct
GLGYFDF

SEQ ID NO: 11555 - protein, 7 aa, Artificial Sequence
  Synthetic construct
GLGYFDY

SEQ ID NO: 11556 - protein, 7 aa, Artificial Sequence
  Synthetic construct
GLGYFVF

SEQ ID NO: 11557 - protein, 7 aa, Artificial Sequence
  Synthetic construct
GLGYFVY

SEQ ID NO: 11558 - protein, 7 aa, Artificial Sequence
  Synthetic construct
GLGYVFF

SEQ ID NO: 11559 - protein, 7 aa, Artificial Sequence
  Synthetic construct
GLGYVFY

SEQ ID NO: 11560 - protein, 7 aa, Artificial Sequence
  Synthetic construct
GLGYVRF

SEQ ID NO: 11561 - protein, 7 aa, Artificial Sequence
  Synthetic construct
GLGYVRY

SEQ ID NO: 11562 - protein, 7 aa, Artificial Sequence
  Synthetic construct
GLGYVCF

SEQ ID NO: 11563 - protein, 7 aa, Artificial Sequence
  Synthetic construct
GLGYVCY

SEQ ID NO: 11564 - protein, 7 aa, Artificial Sequence
  Synthetic construct
GLGYVLF

SEQ ID NO: 11565 - protein, 7 aa, Artificial Sequence
  Synthetic construct
GLGYVLY

SEQ ID NO: 11566 - protein, 7 aa, Artificial Sequence
  Synthetic construct
GLGYVAF

SEQ ID NO: 11567 - protein, 7 aa, Artificial Sequence
  Synthetic construct
GLGYVAY

SEQ ID NO: 11568 - protein, 7 aa, Artificial Sequence
  Synthetic construct
GLGYVQF

SEQ ID NO: 11569 - protein, 7 aa, Artificial Sequence
  Synthetic construct
GLGYVQY

SEQ ID NO: 11570 - protein, 7 aa, Artificial Sequence
  Synthetic construct
GLGYVDF

SEQ ID NO: 11571 - protein, 7 aa, Artificial Sequence
  Synthetic construct
GLGYVDY

SEQ ID NO: 11572 - protein, 7 aa, Artificial Sequence
  Synthetic construct
GLGYVVF

SEQ ID NO: 11573 - protein, 7 aa, Artificial Sequence
  Synthetic construct
GLGYVVY

SEQ ID NO: 11574 - protein, 7 aa, Artificial Sequence
  Synthetic construct
GLGYTFF

SEQ ID NO: 11575 - protein, 7 aa, Artificial Sequence
  Synthetic construct
GLGYTFY

SEQ ID NO: 11576 - protein, 7 aa, Artificial Sequence
  Synthetic construct
GLGYTRF

SEQ ID NO: 11577 - protein, 7 aa, Artificial Sequence
  Synthetic construct
GLGYTRY

SEQ ID NO: 11578 - protein, 7 aa, Artificial Sequence
  Synthetic construct
GLGYTCF

SEQ ID NO: 11579 - protein, 7 aa, Artificial Sequence
  Synthetic construct
GLGYTCY

SEQ ID NO: 11580 - protein, 7 aa, Artificial Sequence
  Synthetic construct
GLGYTLF

SEQ ID NO: 11581 - protein, 7 aa, Artificial Sequence
  Synthetic construct
GLGYTLY

SEQ ID NO: 11582 - protein, 7 aa, Artificial Sequence
  Synthetic construct
GLGYTAF

SEQ ID NO: 11583 - protein, 7 aa, Artificial Sequence
  Synthetic construct
GLGYTAY

SEQ ID NO: 11584 - protein, 7 aa, Artificial Sequence
  Synthetic construct
GLGYTQF

SEQ ID NO: 11585 - protein, 7 aa, Artificial Sequence
  Synthetic construct
GLGYTQY

SEQ ID NO: 11586 - protein, 7 aa, Artificial Sequence
  Synthetic construct
GLGYTDF

SEQ ID NO: 11587 - protein, 7 aa, Artificial Sequence
  Synthetic construct
GLGYTDY

SEQ ID NO: 11588 - protein, 7 aa, Artificial Sequence
  Synthetic construct
GLGYTVF

SEQ ID NO: 11589 - protein, 7 aa, Artificial Sequence
  Synthetic construct
GLGYTVY

SEQ ID NO: 11590 - protein, 7 aa, Artificial Sequence
  Synthetic construct
GLGYGFF

SEQ ID NO: 11591 - protein, 7 aa, Artificial Sequence
  Synthetic construct
GLGYGFY

SEQ ID NO: 11592 - protein, 7 aa, Artificial Sequence
  Synthetic construct
GLGYGRF

SEQ ID NO: 11593 - protein, 7 aa, Artificial Sequence
  Synthetic construct
GLGYGRY

SEQ ID NO: 11594 - protein, 7 aa, Artificial Sequence
  Synthetic construct
GLGYGCF

SEQ ID NO: 11595 - protein, 7 aa, Artificial Sequence
  Synthetic construct
GLGYGCY

SEQ ID NO: 11596 - protein, 7 aa, Artificial Sequence
  Synthetic construct
GLGYGLF

SEQ ID NO: 11597 - protein, 7 aa, Artificial Sequence
  Synthetic construct
GLGYGLY

SEQ ID NO: 11598 - protein, 7 aa, Artificial Sequence
  Synthetic construct
GLGYGAF

SEQ ID NO: 11599 - protein, 7 aa, Artificial Sequence
  Synthetic construct
GLGYGAY

SEQ ID NO: 11600 - protein, 7 aa, Artificial Sequence
  Synthetic construct
GLGYGQF

SEQ ID NO: 11601 - protein, 7 aa, Artificial Sequence
  Synthetic construct
GLGYGQY

SEQ ID NO: 11602 - protein, 7 aa, Artificial Sequence
  Synthetic construct
GLGYGDF

SEQ ID NO: 11603 - protein, 7 aa, Artificial Sequence
  Synthetic construct
GLGYGDY

SEQ ID NO: 11604 - protein, 7 aa, Artificial Sequence
  Synthetic construct
GLGYGVF

SEQ ID NO: 11605 - protein, 7 aa, Artificial Sequence
  Synthetic construct
GLGYGVY

SEQ ID NO: 11606 - protein, 7 aa, Artificial Sequence
  Synthetic construct
GLGYAFF

SEQ ID NO: 11607 - protein, 7 aa, Artificial Sequence
  Synthetic construct
GLGYAFY

SEQ ID NO: 11608 - protein, 7 aa, Artificial Sequence
  Synthetic construct
GLGYARF

SEQ ID NO: 11609 - protein, 7 aa, Artificial Sequence
  Synthetic construct
GLGYARY

SEQ ID NO: 11610 - protein, 7 aa, Artificial Sequence
  Synthetic construct
GLGYACF

SEQ ID NO: 11611 - protein, 7 aa, Artificial Sequence
  Synthetic construct
GLGYACY

SEQ ID NO: 11612 - protein, 7 aa, Artificial Sequence
  Synthetic construct
GLGYALF

SEQ ID NO: 11613 - protein, 7 aa, Artificial Sequence
  Synthetic construct
GLGYALY

SEQ ID NO: 11614 - protein, 7 aa, Artificial Sequence
  Synthetic construct
GLGYAAF

SEQ ID NO: 11615 - protein, 7 aa, Artificial Sequence
  Synthetic construct
GLGYAAY

SEQ ID NO: 11616 - protein, 7 aa, Artificial Sequence
  Synthetic construct
GLGYAQF

SEQ ID NO: 11617 - protein, 7 aa, Artificial Sequence
  Synthetic construct
GLGYAQY

SEQ ID NO: 11618 - protein, 7 aa, Artificial Sequence
  Synthetic construct
GLGYADF

SEQ ID NO: 11619 - protein, 7 aa, Artificial Sequence
  Synthetic construct
GLGYADY

SEQ ID NO: 11620 - protein, 7 aa, Artificial Sequence
  Synthetic construct
GLGYAVF

SEQ ID NO: 11621 - protein, 7 aa, Artificial Sequence
  Synthetic construct
GLGYAVY

SEQ ID NO: 11622 - protein, 7 aa, Artificial Sequence
  Synthetic construct
GLGYQFF

SEQ ID NO: 11623 - protein, 7 aa, Artificial Sequence
  Synthetic construct
GLGYQFY

SEQ ID NO: 11624 - protein, 7 aa, Artificial Sequence
  Synthetic construct
GLGYQRF

SEQ ID NO: 11625 - protein, 7 aa, Artificial Sequence
  Synthetic construct
GLGYQRY

SEQ ID NO: 11626 - protein, 7 aa, Artificial Sequence
  Synthetic construct
GLGYQCF

SEQ ID NO: 11627 - protein, 7 aa, Artificial Sequence
  Synthetic construct
GLGYQCY

SEQ ID NO: 11628 - protein, 7 aa, Artificial Sequence
  Synthetic construct
GLGYQLF

SEQ ID NO: 11629 - protein, 7 aa, Artificial Sequence
  Synthetic construct
GLGYQLY

SEQ ID NO: 11630 - protein, 7 aa, Artificial Sequence
  Synthetic construct
GLGYQAF

SEQ ID NO: 11631 - protein, 7 aa, Artificial Sequence
  Synthetic construct
GLGYQAY

SEQ ID NO: 11632 - protein, 7 aa, Artificial Sequence
  Synthetic construct
GLGYQQF

SEQ ID NO: 11633 - protein, 7 aa, Artificial Sequence
  Synthetic construct
GLGYQQY

SEQ ID NO: 11634 - protein, 7 aa, Artificial Sequence
  Synthetic construct
GLGYQDF

SEQ ID NO: 11635 - protein, 7 aa, Artificial Sequence
  Synthetic construct
GLGYQDY

SEQ ID NO: 11636 - protein, 7 aa, Artificial Sequence
  Synthetic construct
GLGYQVF

SEQ ID NO: 11637 - protein, 7 aa, Artificial Sequence
  Synthetic construct
GLGYQVY

SEQ ID NO: 11638 - protein, 7 aa, Artificial Sequence
  Synthetic construct
GLGPIFF

SEQ ID NO: 11639 - protein, 7 aa, Artificial Sequence
  Synthetic construct
GLGPIFY

SEQ ID NO: 11640 - protein, 7 aa, Artificial Sequence
  Synthetic construct
GLGPIRF

SEQ ID NO: 11641 - protein, 7 aa, Artificial Sequence
  Synthetic construct
GLGPIRY

SEQ ID NO: 11642 - protein, 7 aa, Artificial Sequence
  Synthetic construct
GLGPICF

SEQ ID NO: 11643 - protein, 7 aa, Artificial Sequence
  Synthetic construct
GLGPICY

SEQ ID NO: 11644 - protein, 7 aa, Artificial Sequence
  Synthetic construct
GLGPILF

SEQ ID NO: 11645 - protein, 7 aa, Artificial Sequence
  Synthetic construct
GLGPILY

SEQ ID NO: 11646 - protein, 7 aa, Artificial Sequence
  Synthetic construct
GLGPIAF

SEQ ID NO: 11647 - protein, 7 aa, Artificial Sequence
  Synthetic construct
GLGPIAY

SEQ ID NO: 11648 - protein, 7 aa, Artificial Sequence
  Synthetic construct
GLGPIQF

SEQ ID NO: 11649 - protein, 7 aa, Artificial Sequence
  Synthetic construct
GLGPIQY

SEQ ID NO: 11650 - protein, 7 aa, Artificial Sequence
  Synthetic construct
GLGPIDF

SEQ ID NO: 11651 - protein, 7 aa, Artificial Sequence
  Synthetic construct
GLGPIDY

SEQ ID NO: 11652 - protein, 7 aa, Artificial Sequence
  Synthetic construct
GLGPIVF

SEQ ID NO: 11653 - protein, 7 aa, Artificial Sequence
  Synthetic construct
GLGPIVY

SEQ ID NO: 11654 - protein, 7 aa, Artificial Sequence
  Synthetic construct
GLGPDFF

SEQ ID NO: 11655 - protein, 7 aa, Artificial Sequence
  Synthetic construct
GLGPDFY

SEQ ID NO: 11656 - protein, 7 aa, Artificial Sequence
  Synthetic construct
GLGPDRF

SEQ ID NO: 11657 - protein, 7 aa, Artificial Sequence
  Synthetic construct
GLGPDRY

SEQ ID NO: 11658 - protein, 7 aa, Artificial Sequence
  Synthetic construct
GLGPDCF

SEQ ID NO: 11659 - protein, 7 aa, Artificial Sequence
  Synthetic construct
GLGPDCY

SEQ ID NO: 11660 - protein, 7 aa, Artificial Sequence
  Synthetic construct
GLGPDLF

SEQ ID NO: 11661 - protein, 7 aa, Artificial Sequence
  Synthetic construct
GLGPDLY

SEQ ID NO: 11662 - protein, 7 aa, Artificial Sequence
  Synthetic construct
GLGPDAF

SEQ ID NO: 11663 - protein, 7 aa, Artificial Sequence
  Synthetic construct
GLGPDAY

SEQ ID NO: 11664 - protein, 7 aa, Artificial Sequence
  Synthetic construct
GLGPDQF

SEQ ID NO: 11665 - protein, 7 aa, Artificial Sequence
  Synthetic construct
GLGPDQY

SEQ ID NO: 11666 - protein, 7 aa, Artificial Sequence
  Synthetic construct
GLGPDDF

SEQ ID NO: 11667 - protein, 7 aa, Artificial Sequence
  Synthetic construct
GLGPDDY

SEQ ID NO: 11668 - protein, 7 aa, Artificial Sequence
  Synthetic construct
GLGPDVF

SEQ ID NO: 11669 - protein, 7 aa, Artificial Sequence
  Synthetic construct
GLGPDVY

SEQ ID NO: 11670 - protein, 7 aa, Artificial Sequence
  Synthetic construct
GLGPYFF

SEQ ID NO: 11671 - protein, 7 aa, Artificial Sequence
  Synthetic construct
GLGPYFY

SEQ ID NO: 11672 - protein, 7 aa, Artificial Sequence
  Synthetic construct
GLGPYRF

SEQ ID NO: 11673 - protein, 7 aa, Artificial Sequence
  Synthetic construct
GLGPYRY

SEQ ID NO: 11674 - protein, 7 aa, Artificial Sequence
  Synthetic construct
GLGPYCF

SEQ ID NO: 11675 - protein, 7 aa, Artificial Sequence
  Synthetic construct
GLGPYCY

SEQ ID NO: 11676 - protein, 7 aa, Artificial Sequence
  Synthetic construct
GLGPYLF

SEQ ID NO: 11677 - protein, 7 aa, Artificial Sequence
  Synthetic construct
GLGPYLY

SEQ ID NO: 11678 - protein, 7 aa, Artificial Sequence
  Synthetic construct
GLGPYAF

SEQ ID NO: 11679 - protein, 7 aa, Artificial Sequence
  Synthetic construct
GLGPYAY

SEQ ID NO: 11680 - protein, 7 aa, Artificial Sequence
  Synthetic construct
GLGPYQF

SEQ ID NO: 11681 - protein, 7 aa, Artificial Sequence
  Synthetic construct
GLGPYQY

SEQ ID NO: 11682 - protein, 7 aa, Artificial Sequence
  Synthetic construct
GLGPYDF

SEQ ID NO: 11683 - protein, 7 aa, Artificial Sequence
  Synthetic construct
GLGPYDY

SEQ ID NO: 11684 - protein, 7 aa, Artificial Sequence
  Synthetic construct
GLGPYVF

SEQ ID NO: 11685 - protein, 7 aa, Artificial Sequence
  Synthetic construct
GLGPYVY

SEQ ID NO: 11686 - protein, 7 aa, Artificial Sequence
  Synthetic construct
GLGPFFF

SEQ ID NO: 11687 - protein, 7 aa, Artificial Sequence
  Synthetic construct
GLGPFFY

SEQ ID NO: 11688 - protein, 7 aa, Artificial Sequence
  Synthetic construct
GLGPFRF

SEQ ID NO: 11689 - protein, 7 aa, Artificial Sequence
  Synthetic construct
GLGPFRY

SEQ ID NO: 11690 - protein, 7 aa, Artificial Sequence
  Synthetic construct
GLGPFCF

SEQ ID NO: 11691 - protein, 7 aa, Artificial Sequence
  Synthetic construct
GLGPFCY

SEQ ID NO: 11692 - protein, 7 aa, Artificial Sequence
  Synthetic construct
GLGPFLF

SEQ ID NO: 11693 - protein, 7 aa, Artificial Sequence
  Synthetic construct
GLGPFLY

SEQ ID NO: 11694 - protein, 7 aa, Artificial Sequence
  Synthetic construct
GLGPFAF

SEQ ID NO: 11695 - protein, 7 aa, Artificial Sequence
  Synthetic construct
GLGPFAY

SEQ ID NO: 11696 - protein, 7 aa, Artificial Sequence
  Synthetic construct
GLGPFQF

SEQ ID NO: 11697 - protein, 7 aa, Artificial Sequence
  Synthetic construct
GLGPFQY

SEQ ID NO: 11698 - protein, 7 aa, Artificial Sequence
  Synthetic construct
GLGPFDF

SEQ ID NO: 11699 - protein, 7 aa, Artificial Sequence
  Synthetic construct
GLGPFDY

SEQ ID NO: 11700 - protein, 7 aa, Artificial Sequence
  Synthetic construct
GLGPFVF

SEQ ID NO: 11701 - protein, 7 aa, Artificial Sequence
  Synthetic construct
GLGPFVY

SEQ ID NO: 11702 - protein, 7 aa, Artificial Sequence
  Synthetic construct
GLGPVFF

SEQ ID NO: 11703 - protein, 7 aa, Artificial Sequence
  Synthetic construct
GLGPVFY

SEQ ID NO: 11704 - protein, 7 aa, Artificial Sequence
  Synthetic construct
GLGPVRF

SEQ ID NO: 11705 - protein, 7 aa, Artificial Sequence
  Synthetic construct
GLGPVRY

SEQ ID NO: 11706 - protein, 7 aa, Artificial Sequence
  Synthetic construct
GLGPVCF

SEQ ID NO: 11707 - protein, 7 aa, Artificial Sequence
  Synthetic construct
GLGPVCY

SEQ ID NO: 11708 - protein, 7 aa, Artificial Sequence
  Synthetic construct
GLGPVLF

SEQ ID NO: 11709 - protein, 7 aa, Artificial Sequence
  Synthetic construct
GLGPVLY

SEQ ID NO: 11710 - protein, 7 aa, Artificial Sequence
  Synthetic construct
GLGPVAF

SEQ ID NO: 11711 - protein, 7 aa, Artificial Sequence
  Synthetic construct
GLGPVAY

SEQ ID NO: 11712 - protein, 7 aa, Artificial Sequence
  Synthetic construct
GLGPVQF

SEQ ID NO: 11713 - protein, 7 aa, Artificial Sequence
  Synthetic construct
GLGPVQY

SEQ ID NO: 11714 - protein, 7 aa, Artificial Sequence
  Synthetic construct
GLGPVDF

SEQ ID NO: 11715 - protein, 7 aa, Artificial Sequence
  Synthetic construct
GLGPVDY

SEQ ID NO: 11716 - protein, 7 aa, Artificial Sequence
  Synthetic construct
GLGPVVF

SEQ ID NO: 11717 - protein, 7 aa, Artificial Sequence
  Synthetic construct
GLGPVVY

SEQ ID NO: 11718 - protein, 7 aa, Artificial Sequence
  Synthetic construct
GLGPTFF

SEQ ID NO: 11719 - protein, 7 aa, Artificial Sequence
  Synthetic construct
GLGPTFY

SEQ ID NO: 11720 - protein, 7 aa, Artificial Sequence
  Synthetic construct
GLGPTRF

SEQ ID NO: 11721 - protein, 7 aa, Artificial Sequence
  Synthetic construct
GLGPTRY

SEQ ID NO: 11722 - protein, 7 aa, Artificial Sequence
  Synthetic construct
GLGPTCF

SEQ ID NO: 11723 - protein, 7 aa, Artificial Sequence
  Synthetic construct
GLGPTCY

SEQ ID NO: 11724 - protein, 7 aa, Artificial Sequence
  Synthetic construct
GLGPTLF

SEQ ID NO: 11725 - protein, 7 aa, Artificial Sequence
  Synthetic construct
GLGPTLY

SEQ ID NO: 11726 - protein, 7 aa, Artificial Sequence
  Synthetic construct
GLGPTAF

SEQ ID NO: 11727 - protein, 7 aa, Artificial Sequence
  Synthetic construct
GLGPTAY

SEQ ID NO: 11728 - protein, 7 aa, Artificial Sequence
  Synthetic construct
GLGPTQF

SEQ ID NO: 11729 - protein, 7 aa, Artificial Sequence
  Synthetic construct
GLGPTQY

SEQ ID NO: 11730 - protein, 7 aa, Artificial Sequence
  Synthetic construct
GLGPTDF

SEQ ID NO: 11731 - protein, 7 aa, Artificial Sequence
  Synthetic construct
GLGPTDY

SEQ ID NO: 11732 - protein, 7 aa, Artificial Sequence
  Synthetic construct
GLGPTVF

SEQ ID NO: 11733 - protein, 7 aa, Artificial Sequence
  Synthetic construct
GLGPTVY

SEQ ID NO: 11734 - protein, 7 aa, Artificial Sequence
  Synthetic construct
GLGPGFF

SEQ ID NO: 11735 - protein, 7 aa, Artificial Sequence
  Synthetic construct
GLGPGFY

SEQ ID NO: 11736 - protein, 7 aa, Artificial Sequence
  Synthetic construct
GLGPGRF

SEQ ID NO: 11737 - protein, 7 aa, Artificial Sequence
  Synthetic construct
GLGPGRY

SEQ ID NO: 11738 - protein, 7 aa, Artificial Sequence
  Synthetic construct
GLGPGCF

SEQ ID NO: 11739 - protein, 7 aa, Artificial Sequence
  Synthetic construct
GLGPGCY

SEQ ID NO: 11740 - protein, 7 aa, Artificial Sequence
  Synthetic construct
GLGPGLF

SEQ ID NO: 11741 - protein, 7 aa, Artificial Sequence
  Synthetic construct
GLGPGLY

SEQ ID NO: 11742 - protein, 7 aa, Artificial Sequence
  Synthetic construct
GLGPGAF

SEQ ID NO: 11743 - protein, 7 aa, Artificial Sequence
  Synthetic construct
GLGPGAY

SEQ ID NO: 11744 - protein, 7 aa, Artificial Sequence
  Synthetic construct
GLGPGQF

SEQ ID NO: 11745 - protein, 7 aa, Artificial Sequence
  Synthetic construct
GLGPGQY

SEQ ID NO: 11746 - protein, 7 aa, Artificial Sequence
  Synthetic construct
GLGPGDF

SEQ ID NO: 11747 - protein, 7 aa, Artificial Sequence
  Synthetic construct
GLGPGDY

SEQ ID NO: 11748 - protein, 7 aa, Artificial Sequence
  Synthetic construct
GLGPGVF

SEQ ID NO: 11749 - protein, 7 aa, Artificial Sequence
  Synthetic construct
GLGPGVY

SEQ ID NO: 11750 - protein, 7 aa, Artificial Sequence
  Synthetic construct
GLGPAFF

SEQ ID NO: 11751 - protein, 7 aa, Artificial Sequence
  Synthetic construct
GLGPAFY

SEQ ID NO: 11752 - protein, 7 aa, Artificial Sequence
  Synthetic construct
GLGPARF

SEQ ID NO: 11753 - protein, 7 aa, Artificial Sequence
  Synthetic construct
GLGPARY

SEQ ID NO: 11754 - protein, 7 aa, Artificial Sequence
  Synthetic construct
GLGPACF

SEQ ID NO: 11755 - protein, 7 aa, Artificial Sequence
  Synthetic construct
GLGPACY

SEQ ID NO: 11756 - protein, 7 aa, Artificial Sequence
  Synthetic construct
GLGPALF

SEQ ID NO: 11757 - protein, 7 aa, Artificial Sequence
  Synthetic construct
GLGPALY

SEQ ID NO: 11758 - protein, 7 aa, Artificial Sequence
  Synthetic construct
GLGPAAF

SEQ ID NO: 11759 - protein, 7 aa, Artificial Sequence
  Synthetic construct
GLGPAAY

SEQ ID NO: 11760 - protein, 7 aa, Artificial Sequence
  Synthetic construct
GLGPAQF

SEQ ID NO: 11761 - protein, 7 aa, Artificial Sequence
  Synthetic construct
GLGPAQY

SEQ ID NO: 11762 - protein, 7 aa, Artificial Sequence
  Synthetic construct
GLGPADF

SEQ ID NO: 11763 - protein, 7 aa, Artificial Sequence
  Synthetic construct
GLGPADY

SEQ ID NO: 11764 - protein, 7 aa, Artificial Sequence
  Synthetic construct
GLGPAVF

SEQ ID NO: 11765 - protein, 7 aa, Artificial Sequence
  Synthetic construct
GLGPAVY

SEQ ID NO: 11766 - protein, 7 aa, Artificial Sequence
  Synthetic construct
GLGPQFF

SEQ ID NO: 11767 - protein, 7 aa, Artificial Sequence
  Synthetic construct
GLGPQFY

SEQ ID NO: 11768 - protein, 7 aa, Artificial Sequence
  Synthetic construct
GLGPQRF

SEQ ID NO: 11769 - protein, 7 aa, Artificial Sequence
  Synthetic construct
GLGPQRY

SEQ ID NO: 11770 - protein, 7 aa, Artificial Sequence
  Synthetic construct
GLGPQCF

SEQ ID NO: 11771 - protein, 7 aa, Artificial Sequence
  Synthetic construct
GLGPQCY

SEQ ID NO: 11772 - protein, 7 aa, Artificial Sequence
  Synthetic construct
GLGPQLF

SEQ ID NO: 11773 - protein, 7 aa, Artificial Sequence
  Synthetic construct
GLGPQLY

SEQ ID NO: 11774 - protein, 7 aa, Artificial Sequence
  Synthetic construct
GLGPQAF

SEQ ID NO: 11775 - protein, 7 aa, Artificial Sequence
  Synthetic construct
GLGPQAY

SEQ ID NO: 11776 - protein, 7 aa, Artificial Sequence
  Synthetic construct
GLGPQQF

SEQ ID NO: 11777 - protein, 7 aa, Artificial Sequence
  Synthetic construct
GLGPQQY

SEQ ID NO: 11778 - protein, 7 aa, Artificial Sequence
  Synthetic construct
GLGPQDF

SEQ ID NO: 11779 - protein, 7 aa, Artificial Sequence
  Synthetic construct
GLGPQDY

SEQ ID NO: 11780 - protein, 7 aa, Artificial Sequence
  Synthetic construct
GLGPQVF

SEQ ID NO: 11781 - protein, 7 aa, Artificial Sequence
  Synthetic construct
GLGPQVY

SEQ ID NO: 11782 - protein, 7 aa, Artificial Sequence
  Synthetic construct
GLGHIFF

SEQ ID NO: 11783 - protein, 7 aa, Artificial Sequence
  Synthetic construct
GLGHIFY

SEQ ID NO: 11784 - protein, 7 aa, Artificial Sequence
  Synthetic construct
GLGHIRF

SEQ ID NO: 11785 - protein, 7 aa, Artificial Sequence
  Synthetic construct
GLGHIRY

SEQ ID NO: 11786 - protein, 7 aa, Artificial Sequence
  Synthetic construct
GLGHICF

SEQ ID NO: 11787 - protein, 7 aa, Artificial Sequence
  Synthetic construct
GLGHICY

SEQ ID NO: 11788 - protein, 7 aa, Artificial Sequence
  Synthetic construct
GLGHILF

SEQ ID NO: 11789 - protein, 7 aa, Artificial Sequence
  Synthetic construct
GLGHILY

SEQ ID NO: 11790 - protein, 7 aa, Artificial Sequence
  Synthetic construct
GLGHIAF

SEQ ID NO: 11791 - protein, 7 aa, Artificial Sequence
  Synthetic construct
GLGHIAY

SEQ ID NO: 11792 - protein, 7 aa, Artificial Sequence
  Synthetic construct
GLGHIQF

SEQ ID NO: 11793 - protein, 7 aa, Artificial Sequence
  Synthetic construct
GLGHIQY

SEQ ID NO: 11794 - protein, 7 aa, Artificial Sequence
  Synthetic construct
GLGHIDF

SEQ ID NO: 11795 - protein, 7 aa, Artificial Sequence
  Synthetic construct
GLGHIDY

SEQ ID NO: 11796 - protein, 7 aa, Artificial Sequence
  Synthetic construct
GLGHIVF

SEQ ID NO: 11797 - protein, 7 aa, Artificial Sequence
  Synthetic construct
GLGHIVY

SEQ ID NO: 11798 - protein, 7 aa, Artificial Sequence
  Synthetic construct
GLGHDFF

SEQ ID NO: 11799 - protein, 7 aa, Artificial Sequence
  Synthetic construct
GLGHDFY

SEQ ID NO: 11800 - protein, 7 aa, Artificial Sequence
  Synthetic construct
GLGHDRF

SEQ ID NO: 11801 - protein, 7 aa, Artificial Sequence
  Synthetic construct
GLGHDRY

SEQ ID NO: 11802 - protein, 7 aa, Artificial Sequence
  Synthetic construct
GLGHDCF

SEQ ID NO: 11803 - protein, 7 aa, Artificial Sequence
  Synthetic construct
GLGHDCY

SEQ ID NO: 11804 - protein, 7 aa, Artificial Sequence
  Synthetic construct
GLGHDLF

SEQ ID NO: 11805 - protein, 7 aa, Artificial Sequence
  Synthetic construct
GLGHDLY

SEQ ID NO: 11806 - protein, 7 aa, Artificial Sequence
  Synthetic construct
GLGHDAF

SEQ ID NO: 11807 - protein, 7 aa, Artificial Sequence
  Synthetic construct
GLGHDAY

SEQ ID NO: 11808 - protein, 7 aa, Artificial Sequence
  Synthetic construct
GLGHDQF

SEQ ID NO: 11809 - protein, 7 aa, Artificial Sequence
  Synthetic construct
GLGHDQY

SEQ ID NO: 11810 - protein, 7 aa, Artificial Sequence
  Synthetic construct
GLGHDDF

SEQ ID NO: 11811 - protein, 7 aa, Artificial Sequence
  Synthetic construct
GLGHDDY

SEQ ID NO: 11812 - protein, 7 aa, Artificial Sequence
  Synthetic construct
GLGHDVF

SEQ ID NO: 11813 - protein, 7 aa, Artificial Sequence
  Synthetic construct
GLGHDVY

SEQ ID NO: 11814 - protein, 7 aa, Artificial Sequence
  Synthetic construct
GLGHYFF

SEQ ID NO: 11815 - protein, 7 aa, Artificial Sequence
  Synthetic construct
GLGHYFY

SEQ ID NO: 11816 - protein, 7 aa, Artificial Sequence
  Synthetic construct
GLGHYRF

SEQ ID NO: 11817 - protein, 7 aa, Artificial Sequence
  Synthetic construct
GLGHYRY

SEQ ID NO: 11818 - protein, 7 aa, Artificial Sequence
  Synthetic construct
GLGHYCF

SEQ ID NO: 11819 - protein, 7 aa, Artificial Sequence
  Synthetic construct
GLGHYCY

SEQ ID NO: 11820 - protein, 7 aa, Artificial Sequence
  Synthetic construct
GLGHYLF

SEQ ID NO: 11821 - protein, 7 aa, Artificial Sequence
  Synthetic construct
GLGHYLY

SEQ ID NO: 11822 - protein, 7 aa, Artificial Sequence
  Synthetic construct
GLGHYAF

SEQ ID NO: 11823 - protein, 7 aa, Artificial Sequence
  Synthetic construct
GLGHYAY

SEQ ID NO: 11824 - protein, 7 aa, Artificial Sequence
  Synthetic construct
GLGHYQF

SEQ ID NO: 11825 - protein, 7 aa, Artificial Sequence
  Synthetic construct
GLGHYQY

SEQ ID NO: 11826 - protein, 7 aa, Artificial Sequence
  Synthetic construct
GLGHYDF

SEQ ID NO: 11827 - protein, 7 aa, Artificial Sequence
  Synthetic construct
GLGHYDY

SEQ ID NO: 11828 - protein, 7 aa, Artificial Sequence
  Synthetic construct
GLGHYVF

SEQ ID NO: 11829 - protein, 7 aa, Artificial Sequence
  Synthetic construct
GLGHYVY

SEQ ID NO: 11830 - protein, 7 aa, Artificial Sequence
  Synthetic construct
GLGHFFF

SEQ ID NO: 11831 - protein, 7 aa, Artificial Sequence
  Synthetic construct
GLGHFFY

SEQ ID NO: 11832 - protein, 7 aa, Artificial Sequence
  Synthetic construct
GLGHFRF

SEQ ID NO: 11833 - protein, 7 aa, Artificial Sequence
  Synthetic construct
GLGHFRY

SEQ ID NO: 11834 - protein, 7 aa, Artificial Sequence
  Synthetic construct
GLGHFCF

SEQ ID NO: 11835 - protein, 7 aa, Artificial Sequence
  Synthetic construct
GLGHFCY

SEQ ID NO: 11836 - protein, 7 aa, Artificial Sequence
  Synthetic construct
GLGHFLF

SEQ ID NO: 11837 - protein, 7 aa, Artificial Sequence
  Synthetic construct
GLGHFLY

SEQ ID NO: 11838 - protein, 7 aa, Artificial Sequence
  Synthetic construct
GLGHFAF

SEQ ID NO: 11839 - protein, 7 aa, Artificial Sequence
  Synthetic construct
GLGHFAY

SEQ ID NO: 11840 - protein, 7 aa, Artificial Sequence
  Synthetic construct
GLGHFQF

SEQ ID NO: 11841 - protein, 7 aa, Artificial Sequence
  Synthetic construct
GLGHFQY

SEQ ID NO: 11842 - protein, 7 aa, Artificial Sequence
  Synthetic construct
GLGHFDF

SEQ ID NO: 11843 - protein, 7 aa, Artificial Sequence
  Synthetic construct
GLGHFDY

SEQ ID NO: 11844 - protein, 7 aa, Artificial Sequence
  Synthetic construct
GLGHFVF

SEQ ID NO: 11845 - protein, 7 aa, Artificial Sequence
  Synthetic construct
GLGHFVY

SEQ ID NO: 11846 - protein, 7 aa, Artificial Sequence
  Synthetic construct
GLGHVFF

SEQ ID NO: 11847 - protein, 7 aa, Artificial Sequence
  Synthetic construct
GLGHVFY

SEQ ID NO: 11848 - protein, 7 aa, Artificial Sequence
  Synthetic construct
GLGHVRF

SEQ ID NO: 11849 - protein, 7 aa, Artificial Sequence
  Synthetic construct
GLGHVRY

SEQ ID NO: 11850 - protein, 7 aa, Artificial Sequence
  Synthetic construct
GLGHVCF

SEQ ID NO: 11851 - protein, 7 aa, Artificial Sequence
  Synthetic construct
GLGHVCY

SEQ ID NO: 11852 - protein, 7 aa, Artificial Sequence
  Synthetic construct
GLGHVLF

SEQ ID NO: 11853 - protein, 7 aa, Artificial Sequence
  Synthetic construct
GLGHVLY

SEQ ID NO: 11854 - protein, 7 aa, Artificial Sequence
  Synthetic construct
GLGHVAF

SEQ ID NO: 11855 - protein, 7 aa, Artificial Sequence
  Synthetic construct
GLGHVAY

SEQ ID NO: 11856 - protein, 7 aa, Artificial Sequence
  Synthetic construct
GLGHVQF

SEQ ID NO: 11857 - protein, 7 aa, Artificial Sequence
  Synthetic construct
GLGHVQY

SEQ ID NO: 11858 - protein, 7 aa, Artificial Sequence
  Synthetic construct
GLGHVDF

SEQ ID NO: 11859 - protein, 7 aa, Artificial Sequence
  Synthetic construct
GLGHVDY

SEQ ID NO: 11860 - protein, 7 aa, Artificial Sequence
  Synthetic construct
GLGHVVF

SEQ ID NO: 11861 - protein, 7 aa, Artificial Sequence
  Synthetic construct
GLGHVVY

SEQ ID NO: 11862 - protein, 7 aa, Artificial Sequence
  Synthetic construct
GLGHTFF

SEQ ID NO: 11863 - protein, 7 aa, Artificial Sequence
  Synthetic construct
GLGHTFY

SEQ ID NO: 11864 - protein, 7 aa, Artificial Sequence
  Synthetic construct
GLGHTRF

SEQ ID NO: 11865 - protein, 7 aa, Artificial Sequence
  Synthetic construct
GLGHTRY

SEQ ID NO: 11866 - protein, 7 aa, Artificial Sequence
  Synthetic construct
GLGHTCF

SEQ ID NO: 11867 - protein, 7 aa, Artificial Sequence
  Synthetic construct
GLGHTCY

SEQ ID NO: 11868 - protein, 7 aa, Artificial Sequence
  Synthetic construct
GLGHTLF

SEQ ID NO: 11869 - protein, 7 aa, Artificial Sequence
  Synthetic construct
GLGHTLY

SEQ ID NO: 11870 - protein, 7 aa, Artificial Sequence
  Synthetic construct
GLGHTAF

SEQ ID NO: 11871 - protein, 7 aa, Artificial Sequence
  Synthetic construct
GLGHTAY

SEQ ID NO: 11872 - protein, 7 aa, Artificial Sequence
  Synthetic construct
GLGHTQF

SEQ ID NO: 11873 - protein, 7 aa, Artificial Sequence
  Synthetic construct
GLGHTQY

SEQ ID NO: 11874 - protein, 7 aa, Artificial Sequence
  Synthetic construct
GLGHTDF

SEQ ID NO: 11875 - protein, 7 aa, Artificial Sequence
  Synthetic construct
GLGHTDY

SEQ ID NO: 11876 - protein, 7 aa, Artificial Sequence
  Synthetic construct
GLGHTVF

SEQ ID NO: 11877 - protein, 7 aa, Artificial Sequence
  Synthetic construct
GLGHTVY

SEQ ID NO: 11878 - protein, 7 aa, Artificial Sequence
  Synthetic construct
GLGHGFF

SEQ ID NO: 11879 - protein, 7 aa, Artificial Sequence
  Synthetic construct
GLGHGFY

SEQ ID NO: 11880 - protein, 7 aa, Artificial Sequence
  Synthetic construct
GLGHGRF

SEQ ID NO: 11881 - protein, 7 aa, Artificial Sequence
  Synthetic construct
GLGHGRY

SEQ ID NO: 11882 - protein, 7 aa, Artificial Sequence
  Synthetic construct
GLGHGCF

SEQ ID NO: 11883 - protein, 7 aa, Artificial Sequence
  Synthetic construct
GLGHGCY

SEQ ID NO: 11884 - protein, 7 aa, Artificial Sequence
  Synthetic construct
GLGHGLF

SEQ ID NO: 11885 - protein, 7 aa, Artificial Sequence
  Synthetic construct
GLGHGLY

SEQ ID NO: 11886 - protein, 7 aa, Artificial Sequence
  Synthetic construct
GLGHGAF

SEQ ID NO: 11887 - protein, 7 aa, Artificial Sequence
  Synthetic construct
GLGHGAY

SEQ ID NO: 11888 - protein, 7 aa, Artificial Sequence
  Synthetic construct
GLGHGQF

SEQ ID NO: 11889 - protein, 7 aa, Artificial Sequence
  Synthetic construct
GLGHGQY

SEQ ID NO: 11890 - protein, 7 aa, Artificial Sequence
  Synthetic construct
GLGHGDF

SEQ ID NO: 11891 - protein, 7 aa, Artificial Sequence
  Synthetic construct
GLGHGDY

SEQ ID NO: 11892 - protein, 7 aa, Artificial Sequence
  Synthetic construct
GLGHGVF

SEQ ID NO: 11893 - protein, 7 aa, Artificial Sequence
  Synthetic construct
GLGHGVY

SEQ ID NO: 11894 - protein, 7 aa, Artificial Sequence
  Synthetic construct
GLGHAFF

SEQ ID NO: 11895 - protein, 7 aa, Artificial Sequence
  Synthetic construct
GLGHAFY

SEQ ID NO: 11896 - protein, 7 aa, Artificial Sequence
  Synthetic construct
GLGHARF

SEQ ID NO: 11897 - protein, 7 aa, Artificial Sequence
  Synthetic construct
GLGHARY

SEQ ID NO: 11898 - protein, 7 aa, Artificial Sequence
  Synthetic construct
GLGHACF

SEQ ID NO: 11899 - protein, 7 aa, Artificial Sequence
  Synthetic construct
GLGHACY

SEQ ID NO: 11900 - protein, 7 aa, Artificial Sequence
  Synthetic construct
GLGHALF

SEQ ID NO: 11901 - protein, 7 aa, Artificial Sequence
  Synthetic construct
GLGHALY

SEQ ID NO: 11902 - protein, 7 aa, Artificial Sequence
  Synthetic construct
GLGHAAF

SEQ ID NO: 11903 - protein, 7 aa, Artificial Sequence
  Synthetic construct
GLGHAAY

SEQ ID NO: 11904 - protein, 7 aa, Artificial Sequence
  Synthetic construct
GLGHAQF

SEQ ID NO: 11905 - protein, 7 aa, Artificial Sequence
  Synthetic construct
GLGHAQY

SEQ ID NO: 11906 - protein, 7 aa, Artificial Sequence
  Synthetic construct
GLGHADF

SEQ ID NO: 11907 - protein, 7 aa, Artificial Sequence
  Synthetic construct
GLGHADY

SEQ ID NO: 11908 - protein, 7 aa, Artificial Sequence
  Synthetic construct
GLGHAVF

SEQ ID NO: 11909 - protein, 7 aa, Artificial Sequence
  Synthetic construct
GLGHAVY

SEQ ID NO: 11910 - protein, 7 aa, Artificial Sequence
  Synthetic construct
GLGHQFF

SEQ ID NO: 11911 - protein, 7 aa, Artificial Sequence
  Synthetic construct
GLGHQFY

SEQ ID NO: 11912 - protein, 7 aa, Artificial Sequence
  Synthetic construct
GLGHQRF

SEQ ID NO: 11913 - protein, 7 aa, Artificial Sequence
  Synthetic construct
GLGHQRY

SEQ ID NO: 11914 - protein, 7 aa, Artificial Sequence
  Synthetic construct
GLGHQCF

SEQ ID NO: 11915 - protein, 7 aa, Artificial Sequence
  Synthetic construct
GLGHQCY

SEQ ID NO: 11916 - protein, 7 aa, Artificial Sequence
  Synthetic construct
GLGHQLF

SEQ ID NO: 11917 - protein, 7 aa, Artificial Sequence
  Synthetic construct
GLGHQLY

SEQ ID NO: 11918 - protein, 7 aa, Artificial Sequence
  Synthetic construct
GLGHQAF

SEQ ID NO: 11919 - protein, 7 aa, Artificial Sequence
  Synthetic construct
GLGHQAY

SEQ ID NO: 11920 - protein, 7 aa, Artificial Sequence
  Synthetic construct
GLGHQQF

SEQ ID NO: 11921 - protein, 7 aa, Artificial Sequence
  Synthetic construct
GLGHQQY

SEQ ID NO: 11922 - protein, 7 aa, Artificial Sequence
  Synthetic construct
GLGHQDF

SEQ ID NO: 11923 - protein, 7 aa, Artificial Sequence
  Synthetic construct
GLGHQDY

SEQ ID NO: 11924 - protein, 7 aa, Artificial Sequence
  Synthetic construct
GLGHQVF

SEQ ID NO: 11925 - protein, 7 aa, Artificial Sequence
  Synthetic construct
GLGHQVY

SEQ ID NO: 11926 - protein, 7 aa, Artificial Sequence
  Synthetic construct
GLGLIFF

SEQ ID NO: 11927 - protein, 7 aa, Artificial Sequence
  Synthetic construct
GLGLIFY

SEQ ID NO: 11928 - protein, 7 aa, Artificial Sequence
  Synthetic construct
GLGLIRF

SEQ ID NO: 11929 - protein, 7 aa, Artificial Sequence
  Synthetic construct
GLGLIRY

SEQ ID NO: 11930 - protein, 7 aa, Artificial Sequence
  Synthetic construct
GLGLICF

SEQ ID NO: 11931 - protein, 7 aa, Artificial Sequence
  Synthetic construct
GLGLICY

SEQ ID NO: 11932 - protein, 7 aa, Artificial Sequence
  Synthetic construct
GLGLILF

SEQ ID NO: 11933 - protein, 7 aa, Artificial Sequence
  Synthetic construct
GLGLILY

SEQ ID NO: 11934 - protein, 7 aa, Artificial Sequence
  Synthetic construct
GLGLIAF

SEQ ID NO: 11935 - protein, 7 aa, Artificial Sequence
  Synthetic construct
GLGLIAY

SEQ ID NO: 11936 - protein, 7 aa, Artificial Sequence
  Synthetic construct
GLGLIQF

SEQ ID NO: 11937 - protein, 7 aa, Artificial Sequence
  Synthetic construct
GLGLIQY

SEQ ID NO: 11938 - protein, 7 aa, Artificial Sequence
  Synthetic construct
GLGLIDF

SEQ ID NO: 11939 - protein, 7 aa, Artificial Sequence
  Synthetic construct
GLGLIDY

SEQ ID NO: 11940 - protein, 7 aa, Artificial Sequence
  Synthetic construct
GLGLIVF

SEQ ID NO: 11941 - protein, 7 aa, Artificial Sequence
  Synthetic construct
GLGLIVY

SEQ ID NO: 11942 - protein, 7 aa, Artificial Sequence
  Synthetic construct
GLGLDFF

SEQ ID NO: 11943 - protein, 7 aa, Artificial Sequence
  Synthetic construct
GLGLDFY

SEQ ID NO: 11944 - protein, 7 aa, Artificial Sequence
  Synthetic construct
GLGLDRF

SEQ ID NO: 11945 - protein, 7 aa, Artificial Sequence
  Synthetic construct
GLGLDRY

SEQ ID NO: 11946 - protein, 7 aa, Artificial Sequence
  Synthetic construct
GLGLDCF

SEQ ID NO: 11947 - protein, 7 aa, Artificial Sequence
  Synthetic construct
GLGLDCY

SEQ ID NO: 11948 - protein, 7 aa, Artificial Sequence
  Synthetic construct
GLGLDLF

SEQ ID NO: 11949 - protein, 7 aa, Artificial Sequence
  Synthetic construct
GLGLDLY

SEQ ID NO: 11950 - protein, 7 aa, Artificial Sequence
  Synthetic construct
GLGLDAF

SEQ ID NO: 11951 - protein, 7 aa, Artificial Sequence
  Synthetic construct
GLGLDAY

SEQ ID NO: 11952 - protein, 7 aa, Artificial Sequence
  Synthetic construct
GLGLDQF

SEQ ID NO: 11953 - protein, 7 aa, Artificial Sequence
  Synthetic construct
GLGLDQY

SEQ ID NO: 11954 - protein, 7 aa, Artificial Sequence
  Synthetic construct
GLGLDDF

SEQ ID NO: 11955 - protein, 7 aa, Artificial Sequence
  Synthetic construct
GLGLDDY

SEQ ID NO: 11956 - protein, 7 aa, Artificial Sequence
  Synthetic construct
GLGLDVF

SEQ ID NO: 11957 - protein, 7 aa, Artificial Sequence
  Synthetic construct
GLGLDVY

SEQ ID NO: 11958 - protein, 7 aa, Artificial Sequence
  Synthetic construct
GLGLYFF

SEQ ID NO: 11959 - protein, 7 aa, Artificial Sequence
  Synthetic construct
GLGLYFY

SEQ ID NO: 11960 - protein, 7 aa, Artificial Sequence
  Synthetic construct
GLGLYRF

SEQ ID NO: 11961 - protein, 7 aa, Artificial Sequence
  Synthetic construct
GLGLYRY

SEQ ID NO: 11962 - protein, 7 aa, Artificial Sequence
  Synthetic construct
GLGLYCF

SEQ ID NO: 11963 - protein, 7 aa, Artificial Sequence
  Synthetic construct
GLGLYCY

SEQ ID NO: 11964 - protein, 7 aa, Artificial Sequence
  Synthetic construct
GLGLYLF

SEQ ID NO: 11965 - protein, 7 aa, Artificial Sequence
  Synthetic construct
GLGLYLY

SEQ ID NO: 11966 - protein, 7 aa, Artificial Sequence
  Synthetic construct
GLGLYAF

SEQ ID NO: 11967 - protein, 7 aa, Artificial Sequence
  Synthetic construct
GLGLYAY

SEQ ID NO: 11968 - protein, 7 aa, Artificial Sequence
  Synthetic construct
GLGLYQF

SEQ ID NO: 11969 - protein, 7 aa, Artificial Sequence
  Synthetic construct
GLGLYQY

SEQ ID NO: 11970 - protein, 7 aa, Artificial Sequence
  Synthetic construct
GLGLYDF

SEQ ID NO: 11971 - protein, 7 aa, Artificial Sequence
  Synthetic construct
GLGLYDY

SEQ ID NO: 11972 - protein, 7 aa, Artificial Sequence
  Synthetic construct
GLGLYVF

SEQ ID NO: 11973 - protein, 7 aa, Artificial Sequence
  Synthetic construct
GLGLYVY

SEQ ID NO: 11974 - protein, 7 aa, Artificial Sequence
  Synthetic construct
GLGLFFF

SEQ ID NO: 11975 - protein, 7 aa, Artificial Sequence
  Synthetic construct
GLGLFFY

SEQ ID NO: 11976 - protein, 7 aa, Artificial Sequence
  Synthetic construct
GLGLFRF

SEQ ID NO: 11977 - protein, 7 aa, Artificial Sequence
  Synthetic construct
GLGLFRY

SEQ ID NO: 11978 - protein, 7 aa, Artificial Sequence
  Synthetic construct
GLGLFCF

SEQ ID NO: 11979 - protein, 7 aa, Artificial Sequence
  Synthetic construct
GLGLFCY

SEQ ID NO: 11980 - protein, 7 aa, Artificial Sequence
  Synthetic construct
GLGLFLF

SEQ ID NO: 11981 - protein, 7 aa, Artificial Sequence
  Synthetic construct
GLGLFLY

SEQ ID NO: 11982 - protein, 7 aa, Artificial Sequence
  Synthetic construct
GLGLFAF

SEQ ID NO: 11983 - protein, 7 aa, Artificial Sequence
  Synthetic construct
GLGLFAY

SEQ ID NO: 11984 - protein, 7 aa, Artificial Sequence
  Synthetic construct
GLGLFQF

SEQ ID NO: 11985 - protein, 7 aa, Artificial Sequence
  Synthetic construct
GLGLFQY

SEQ ID NO: 11986 - protein, 7 aa, Artificial Sequence
  Synthetic construct
GLGLFDF

SEQ ID NO: 11987 - protein, 7 aa, Artificial Sequence
  Synthetic construct
GLGLFDY

SEQ ID NO: 11988 - protein, 7 aa, Artificial Sequence
  Synthetic construct
GLGLFVF

SEQ ID NO: 11989 - protein, 7 aa, Artificial Sequence
  Synthetic construct
GLGLFVY

SEQ ID NO: 11990 - protein, 7 aa, Artificial Sequence
  Synthetic construct
GLGLVFF

SEQ ID NO: 11991 - protein, 7 aa, Artificial Sequence
  Synthetic construct
GLGLVFY

SEQ ID NO: 11992 - protein, 7 aa, Artificial Sequence
  Synthetic construct
GLGLVRF

SEQ ID NO: 11993 - protein, 7 aa, Artificial Sequence
  Synthetic construct
GLGLVRY

SEQ ID NO: 11994 - protein, 7 aa, Artificial Sequence
  Synthetic construct
GLGLVCF

SEQ ID NO: 11995 - protein, 7 aa, Artificial Sequence
  Synthetic construct
GLGLVCY

SEQ ID NO: 11996 - protein, 7 aa, Artificial Sequence
  Synthetic construct
GLGLVLF

SEQ ID NO: 11997 - protein, 7 aa, Artificial Sequence
  Synthetic construct
GLGLVLY

SEQ ID NO: 11998 - protein, 7 aa, Artificial Sequence
  Synthetic construct
GLGLVAF

SEQ ID NO: 11999 - protein, 7 aa, Artificial Sequence
  Synthetic construct
GLGLVAY

SEQ ID NO: 12000 - protein, 7 aa, Artificial Sequence
  Synthetic construct
GLGLVQF

SEQ ID NO: 12001 - protein, 7 aa, Artificial Sequence
  Synthetic construct
GLGLVQY

SEQ ID NO: 12002 - protein, 7 aa, Artificial Sequence
  Synthetic construct
GLGLVDF

SEQ ID NO: 12003 - protein, 7 aa, Artificial Sequence
  Synthetic construct
GLGLVDY

SEQ ID NO: 12004 - protein, 7 aa, Artificial Sequence
  Synthetic construct
GLGLVVF

SEQ ID NO: 12005 - protein, 7 aa, Artificial Sequence
  Synthetic construct
GLGLVVY

SEQ ID NO: 12006 - protein, 7 aa, Artificial Sequence
  Synthetic construct
GLGLTFF

SEQ ID NO: 12007 - protein, 7 aa, Artificial Sequence
  Synthetic construct
GLGLTFY

SEQ ID NO: 12008 - protein, 7 aa, Artificial Sequence
  Synthetic construct
GLGLTRF

SEQ ID NO: 12009 - protein, 7 aa, Artificial Sequence
  Synthetic construct
GLGLTRY

SEQ ID NO: 12010 - protein, 7 aa, Artificial Sequence
  Synthetic construct
GLGLTCF

SEQ ID NO: 12011 - protein, 7 aa, Artificial Sequence
  Synthetic construct
GLGLTCY

SEQ ID NO: 12012 - protein, 7 aa, Artificial Sequence
  Synthetic construct
GLGLTLF

SEQ ID NO: 12013 - protein, 7 aa, Artificial Sequence
  Synthetic construct
GLGLTLY

SEQ ID NO: 12014 - protein, 7 aa, Artificial Sequence
  Synthetic construct
GLGLTAF

SEQ ID NO: 12015 - protein, 7 aa, Artificial Sequence
  Synthetic construct
GLGLTAY

SEQ ID NO: 12016 - protein, 7 aa, Artificial Sequence
  Synthetic construct
GLGLTQF

SEQ ID NO: 12017 - protein, 7 aa, Artificial Sequence
  Synthetic construct
GLGLTQY

SEQ ID NO: 12018 - protein, 7 aa, Artificial Sequence
  Synthetic construct
GLGLTDF

SEQ ID NO: 12019 - protein, 7 aa, Artificial Sequence
  Synthetic construct
GLGLTDY

SEQ ID NO: 12020 - protein, 7 aa, Artificial Sequence
  Synthetic construct
GLGLTVF

SEQ ID NO: 12021 - protein, 7 aa, Artificial Sequence
  Synthetic construct
GLGLTVY

SEQ ID NO: 12022 - protein, 7 aa, Artificial Sequence
  Synthetic construct
GLGLGFF

SEQ ID NO: 12023 - protein, 7 aa, Artificial Sequence
  Synthetic construct
GLGLGFY

SEQ ID NO: 12024 - protein, 7 aa, Artificial Sequence
  Synthetic construct
GLGLGRF

SEQ ID NO: 12025 - protein, 7 aa, Artificial Sequence
  Synthetic construct
GLGLGRY

SEQ ID NO: 12026 - protein, 7 aa, Artificial Sequence
  Synthetic construct
GLGLGCF

SEQ ID NO: 12027 - protein, 7 aa, Artificial Sequence
  Synthetic construct
GLGLGCY

SEQ ID NO: 12028 - protein, 7 aa, Artificial Sequence
  Synthetic construct
GLGLGLF

SEQ ID NO: 12029 - protein, 7 aa, Artificial Sequence
  Synthetic construct
GLGLGLY

SEQ ID NO: 12030 - protein, 7 aa, Artificial Sequence
  Synthetic construct
GLGLGAF

SEQ ID NO: 12031 - protein, 7 aa, Artificial Sequence
  Synthetic construct
GLGLGAY

SEQ ID NO: 12032 - protein, 7 aa, Artificial Sequence
  Synthetic construct
GLGLGQF

SEQ ID NO: 12033 - protein, 7 aa, Artificial Sequence
  Synthetic construct
GLGLGQY

SEQ ID NO: 12034 - protein, 7 aa, Artificial Sequence
  Synthetic construct
GLGLGDF

SEQ ID NO: 12035 - protein, 7 aa, Artificial Sequence
  Synthetic construct
GLGLGDY

SEQ ID NO: 12036 - protein, 7 aa, Artificial Sequence
  Synthetic construct
GLGLGVF

SEQ ID NO: 12037 - protein, 7 aa, Artificial Sequence
  Synthetic construct
GLGLGVY

SEQ ID NO: 12038 - protein, 7 aa, Artificial Sequence
  Synthetic construct
GLGLAFF

SEQ ID NO: 12039 - protein, 7 aa, Artificial Sequence
  Synthetic construct
GLGLAFY

SEQ ID NO: 12040 - protein, 7 aa, Artificial Sequence
  Synthetic construct
GLGLARF

SEQ ID NO: 12041 - protein, 7 aa, Artificial Sequence
  Synthetic construct
GLGLARY

SEQ ID NO: 12042 - protein, 7 aa, Artificial Sequence
  Synthetic construct
GLGLACF

SEQ ID NO: 12043 - protein, 7 aa, Artificial Sequence
  Synthetic construct
GLGLACY

SEQ ID NO: 12044 - protein, 7 aa, Artificial Sequence
  Synthetic construct
GLGLALF

SEQ ID NO: 12045 - protein, 7 aa, Artificial Sequence
  Synthetic construct
GLGLALY

SEQ ID NO: 12046 - protein, 7 aa, Artificial Sequence
  Synthetic construct
GLGLAAF

SEQ ID NO: 12047 - protein, 7 aa, Artificial Sequence
  Synthetic construct
GLGLAAY

SEQ ID NO: 12048 - protein, 7 aa, Artificial Sequence
  Synthetic construct
GLGLAQF

SEQ ID NO: 12049 - protein, 7 aa, Artificial Sequence
  Synthetic construct
GLGLAQY

SEQ ID NO: 12050 - protein, 7 aa, Artificial Sequence
  Synthetic construct
GLGLADF

SEQ ID NO: 12051 - protein, 7 aa, Artificial Sequence
  Synthetic construct
GLGLADY

SEQ ID NO: 12052 - protein, 7 aa, Artificial Sequence
  Synthetic construct
GLGLAVF

SEQ ID NO: 12053 - protein, 7 aa, Artificial Sequence
  Synthetic construct
GLGLAVY

SEQ ID NO: 12054 - protein, 7 aa, Artificial Sequence
  Synthetic construct
GLGLQFF

SEQ ID NO: 12055 - protein, 7 aa, Artificial Sequence
  Synthetic construct
GLGLQFY

SEQ ID NO: 12056 - protein, 7 aa, Artificial Sequence
  Synthetic construct
GLGLQRF

SEQ ID NO: 12057 - protein, 7 aa, Artificial Sequence
  Synthetic construct
GLGLQRY

SEQ ID NO: 12058 - protein, 7 aa, Artificial Sequence
  Synthetic construct
GLGLQCF

SEQ ID NO: 12059 - protein, 7 aa, Artificial Sequence
  Synthetic construct
GLGLQCY

SEQ ID NO: 12060 - protein, 7 aa, Artificial Sequence
  Synthetic construct
GLGLQLF

SEQ ID NO: 12061 - protein, 7 aa, Artificial Sequence
  Synthetic construct
GLGLQLY

SEQ ID NO: 12062 - protein, 7 aa, Artificial Sequence
  Synthetic construct
GLGLQAF

SEQ ID NO: 12063 - protein, 7 aa, Artificial Sequence
  Synthetic construct
GLGLQAY

SEQ ID NO: 12064 - protein, 7 aa, Artificial Sequence
  Synthetic construct
GLGLQQF

SEQ ID NO: 12065 - protein, 7 aa, Artificial Sequence
  Synthetic construct
GLGLQQY

SEQ ID NO: 12066 - protein, 7 aa, Artificial Sequence
  Synthetic construct
GLGLQDF

SEQ ID NO: 12067 - protein, 7 aa, Artificial Sequence
  Synthetic construct
GLGLQDY

SEQ ID NO: 12068 - protein, 7 aa, Artificial Sequence
  Synthetic construct
GLGLQVF

SEQ ID NO: 12069 - protein, 7 aa, Artificial Sequence
  Synthetic construct
GLGLQVY

SEQ ID NO: 12070 - protein, 7 aa, Artificial Sequence
  Synthetic construct
GLGFIFF

SEQ ID NO: 12071 - protein, 7 aa, Artificial Sequence
  Synthetic construct
GLGFIFY

SEQ ID NO: 12072 - protein, 7 aa, Artificial Sequence
  Synthetic construct
GLGFIRF

SEQ ID NO: 12073 - protein, 7 aa, Artificial Sequence
  Synthetic construct
GLGFIRY

SEQ ID NO: 12074 - protein, 7 aa, Artificial Sequence
  Synthetic construct
GLGFICF

SEQ ID NO: 12075 - protein, 7 aa, Artificial Sequence
  Synthetic construct
GLGFICY

SEQ ID NO: 12076 - protein, 7 aa, Artificial Sequence
  Synthetic construct
GLGFILF

SEQ ID NO: 12077 - protein, 7 aa, Artificial Sequence
  Synthetic construct
GLGFILY

SEQ ID NO: 12078 - protein, 7 aa, Artificial Sequence
  Synthetic construct
GLGFIAF

SEQ ID NO: 12079 - protein, 7 aa, Artificial Sequence
  Synthetic construct
GLGFIAY

SEQ ID NO: 12080 - protein, 7 aa, Artificial Sequence
  Synthetic construct
GLGFIQF

SEQ ID NO: 12081 - protein, 7 aa, Artificial Sequence
  Synthetic construct
GLGFIQY

SEQ ID NO: 12082 - protein, 7 aa, Artificial Sequence
  Synthetic construct
GLGFIDF

SEQ ID NO: 12083 - protein, 7 aa, Artificial Sequence
  Synthetic construct
GLGFIDY

SEQ ID NO: 12084 - protein, 7 aa, Artificial Sequence
  Synthetic construct
GLGFIVF

SEQ ID NO: 12085 - protein, 7 aa, Artificial Sequence
  Synthetic construct
GLGFIVY

SEQ ID NO: 12086 - protein, 7 aa, Artificial Sequence
  Synthetic construct
GLGFDFF

SEQ ID NO: 12087 - protein, 7 aa, Artificial Sequence
  Synthetic construct
GLGFDFY

SEQ ID NO: 12088 - protein, 7 aa, Artificial Sequence
  Synthetic construct
GLGFDRF

SEQ ID NO: 12089 - protein, 7 aa, Artificial Sequence
  Synthetic construct
GLGFDRY

SEQ ID NO: 12090 - protein, 7 aa, Artificial Sequence
  Synthetic construct
GLGFDCF

SEQ ID NO: 12091 - protein, 7 aa, Artificial Sequence
  Synthetic construct
GLGFDCY

SEQ ID NO: 12092 - protein, 7 aa, Artificial Sequence
  Synthetic construct
GLGFDLF

SEQ ID NO: 12093 - protein, 7 aa, Artificial Sequence
  Synthetic construct
GLGFDLY

SEQ ID NO: 12094 - protein, 7 aa, Artificial Sequence
  Synthetic construct
GLGFDAF

SEQ ID NO: 12095 - protein, 7 aa, Artificial Sequence
  Synthetic construct
GLGFDAY

SEQ ID NO: 12096 - protein, 7 aa, Artificial Sequence
  Synthetic construct
GLGFDQF

SEQ ID NO: 12097 - protein, 7 aa, Artificial Sequence
  Synthetic construct
GLGFDQY

SEQ ID NO: 12098 - protein, 7 aa, Artificial Sequence
  Synthetic construct
GLGFDDF

SEQ ID NO: 12099 - protein, 7 aa, Artificial Sequence
  Synthetic construct
GLGFDDY

SEQ ID NO: 12100 - protein, 7 aa, Artificial Sequence
  Synthetic construct
GLGFDVF

SEQ ID NO: 12101 - protein, 7 aa, Artificial Sequence
  Synthetic construct
GLGFDVY

SEQ ID NO: 12102 - protein, 7 aa, Artificial Sequence
  Synthetic construct
GLGFYFF

SEQ ID NO: 12103 - protein, 7 aa, Artificial Sequence
  Synthetic construct
GLGFYFY

SEQ ID NO: 12104 - protein, 7 aa, Artificial Sequence
  Synthetic construct
GLGFYRF

SEQ ID NO: 12105 - protein, 7 aa, Artificial Sequence
  Synthetic construct
GLGFYRY

SEQ ID NO: 12106 - protein, 7 aa, Artificial Sequence
  Synthetic construct
GLGFYCF

SEQ ID NO: 12107 - protein, 7 aa, Artificial Sequence
  Synthetic construct
GLGFYCY

SEQ ID NO: 12108 - protein, 7 aa, Artificial Sequence
  Synthetic construct
GLGFYLF

SEQ ID NO: 12109 - protein, 7 aa, Artificial Sequence
  Synthetic construct
GLGFYLY

SEQ ID NO: 12110 - protein, 7 aa, Artificial Sequence
  Synthetic construct
GLGFYAF

SEQ ID NO: 12111 - protein, 7 aa, Artificial Sequence
  Synthetic construct
GLGFYAY

SEQ ID NO: 12112 - protein, 7 aa, Artificial Sequence
  Synthetic construct
GLGFYQF

SEQ ID NO: 12113 - protein, 7 aa, Artificial Sequence
  Synthetic construct
GLGFYQY

SEQ ID NO: 12114 - protein, 7 aa, Artificial Sequence
  Synthetic construct
GLGFYDF

SEQ ID NO: 12115 - protein, 7 aa, Artificial Sequence
  Synthetic construct
GLGFYDY

SEQ ID NO: 12116 - protein, 7 aa, Artificial Sequence
  Synthetic construct
GLGFYVF

SEQ ID NO: 12117 - protein, 7 aa, Artificial Sequence
  Synthetic construct
GLGFYVY

SEQ ID NO: 12118 - protein, 7 aa, Artificial Sequence
  Synthetic construct
GLGFFFF

SEQ ID NO: 12119 - protein, 7 aa, Artificial Sequence
  Synthetic construct
GLGFFFY

SEQ ID NO: 12120 - protein, 7 aa, Artificial Sequence
  Synthetic construct
GLGFFRF

SEQ ID NO: 12121 - protein, 7 aa, Artificial Sequence
  Synthetic construct
GLGFFRY

SEQ ID NO: 12122 - protein, 7 aa, Artificial Sequence
  Synthetic construct
GLGFFCF

SEQ ID NO: 12123 - protein, 7 aa, Artificial Sequence
  Synthetic construct
GLGFFCY

SEQ ID NO: 12124 - protein, 7 aa, Artificial Sequence
  Synthetic construct
GLGFFLF

SEQ ID NO: 12125 - protein, 7 aa, Artificial Sequence
  Synthetic construct
GLGFFLY

SEQ ID NO: 12126 - protein, 7 aa, Artificial Sequence
  Synthetic construct
GLGFFAF

SEQ ID NO: 12127 - protein, 7 aa, Artificial Sequence
  Synthetic construct
GLGFFAY

SEQ ID NO: 12128 - protein, 7 aa, Artificial Sequence
  Synthetic construct
GLGFFQF

SEQ ID NO: 12129 - protein, 7 aa, Artificial Sequence
  Synthetic construct
GLGFFQY

SEQ ID NO: 12130 - protein, 7 aa, Artificial Sequence
  Synthetic construct
GLGFFDF

SEQ ID NO: 12131 - protein, 7 aa, Artificial Sequence
  Synthetic construct
GLGFFDY

SEQ ID NO: 12132 - protein, 7 aa, Artificial Sequence
  Synthetic construct
GLGFFVF

SEQ ID NO: 12133 - protein, 7 aa, Artificial Sequence
  Synthetic construct
GLGFFVY

SEQ ID NO: 12134 - protein, 7 aa, Artificial Sequence
  Synthetic construct
GLGFVFF

SEQ ID NO: 12135 - protein, 7 aa, Artificial Sequence
  Synthetic construct
GLGFVFY

SEQ ID NO: 12136 - protein, 7 aa, Artificial Sequence
  Synthetic construct
GLGFVRF

SEQ ID NO: 12137 - protein, 7 aa, Artificial Sequence
  Synthetic construct
GLGFVRY

SEQ ID NO: 12138 - protein, 7 aa, Artificial Sequence
  Synthetic construct
GLGFVCF

SEQ ID NO: 12139 - protein, 7 aa, Artificial Sequence
  Synthetic construct
GLGFVCY

SEQ ID NO: 12140 - protein, 7 aa, Artificial Sequence
  Synthetic construct
GLGFVLF

SEQ ID NO: 12141 - protein, 7 aa, Artificial Sequence
  Synthetic construct
GLGFVLY

SEQ ID NO: 12142 - protein, 7 aa, Artificial Sequence
  Synthetic construct
GLGFVAF

SEQ ID NO: 12143 - protein, 7 aa, Artificial Sequence
  Synthetic construct
GLGFVAY

SEQ ID NO: 12144 - protein, 7 aa, Artificial Sequence
  Synthetic construct
GLGFVQF

SEQ ID NO: 12145 - protein, 7 aa, Artificial Sequence
  Synthetic construct
GLGFVQY

SEQ ID NO: 12146 - protein, 7 aa, Artificial Sequence
  Synthetic construct
GLGFVDF

SEQ ID NO: 12147 - protein, 7 aa, Artificial Sequence
  Synthetic construct
GLGFVDY

SEQ ID NO: 12148 - protein, 7 aa, Artificial Sequence
  Synthetic construct
GLGFVVF

SEQ ID NO: 12149 - protein, 7 aa, Artificial Sequence
  Synthetic construct
GLGFVVY

SEQ ID NO: 12150 - protein, 7 aa, Artificial Sequence
  Synthetic construct
GLGFTFF

SEQ ID NO: 12151 - protein, 7 aa, Artificial Sequence
  Synthetic construct
GLGFTFY

SEQ ID NO: 12152 - protein, 7 aa, Artificial Sequence
  Synthetic construct
GLGFTRF

SEQ ID NO: 12153 - protein, 7 aa, Artificial Sequence
  Synthetic construct
GLGFTRY

SEQ ID NO: 12154 - protein, 7 aa, Artificial Sequence
  Synthetic construct
GLGFTCF

SEQ ID NO: 12155 - protein, 7 aa, Artificial Sequence
  Synthetic construct
GLGFTCY

SEQ ID NO: 12156 - protein, 7 aa, Artificial Sequence
  Synthetic construct
GLGFTLF

SEQ ID NO: 12157 - protein, 7 aa, Artificial Sequence
  Synthetic construct
GLGFTLY

SEQ ID NO: 12158 - protein, 7 aa, Artificial Sequence
  Synthetic construct
GLGFTAF

SEQ ID NO: 12159 - protein, 7 aa, Artificial Sequence
  Synthetic construct
GLGFTAY

SEQ ID NO: 12160 - protein, 7 aa, Artificial Sequence
  Synthetic construct
GLGFTQF

SEQ ID NO: 12161 - protein, 7 aa, Artificial Sequence
  Synthetic construct
GLGFTQY

SEQ ID NO: 12162 - protein, 7 aa, Artificial Sequence
  Synthetic construct
GLGFTDF

SEQ ID NO: 12163 - protein, 7 aa, Artificial Sequence
  Synthetic construct
GLGFTDY

SEQ ID NO: 12164 - protein, 7 aa, Artificial Sequence
  Synthetic construct
GLGFTVF

SEQ ID NO: 12165 - protein, 7 aa, Artificial Sequence
  Synthetic construct
GLGFTVY

SEQ ID NO: 12166 - protein, 7 aa, Artificial Sequence
  Synthetic construct
GLGFGFF

SEQ ID NO: 12167 - protein, 7 aa, Artificial Sequence
  Synthetic construct
GLGFGFY

SEQ ID NO: 12168 - protein, 7 aa, Artificial Sequence
  Synthetic construct
GLGFGRF

SEQ ID NO: 12169 - protein, 7 aa, Artificial Sequence
  Synthetic construct
GLGFGRY

SEQ ID NO: 12170 - protein, 7 aa, Artificial Sequence
  Synthetic construct
GLGFGCF

SEQ ID NO: 12171 - protein, 7 aa, Artificial Sequence
  Synthetic construct
GLGFGCY

SEQ ID NO: 12172 - protein, 7 aa, Artificial Sequence
  Synthetic construct
GLGFGLF

SEQ ID NO: 12173 - protein, 7 aa, Artificial Sequence
  Synthetic construct
GLGFGLY

SEQ ID NO: 12174 - protein, 7 aa, Artificial Sequence
  Synthetic construct
GLGFGAF

SEQ ID NO: 12175 - protein, 7 aa, Artificial Sequence
  Synthetic construct
GLGFGAY

SEQ ID NO: 12176 - protein, 7 aa, Artificial Sequence
  Synthetic construct
GLGFGQF

SEQ ID NO: 12177 - protein, 7 aa, Artificial Sequence
  Synthetic construct
GLGFGQY

SEQ ID NO: 12178 - protein, 7 aa, Artificial Sequence
  Synthetic construct
GLGFGDF

SEQ ID NO: 12179 - protein, 7 aa, Artificial Sequence
  Synthetic construct
GLGFGDY

SEQ ID NO: 12180 - protein, 7 aa, Artificial Sequence
  Synthetic construct
GLGFGVF

SEQ ID NO: 12181 - protein, 7 aa, Artificial Sequence
  Synthetic construct
GLGFGVY

SEQ ID NO: 12182 - protein, 7 aa, Artificial Sequence
  Synthetic construct
GLGFAFF

SEQ ID NO: 12183 - protein, 7 aa, Artificial Sequence
  Synthetic construct
GLGFAFY

SEQ ID NO: 12184 - protein, 7 aa, Artificial Sequence
  Synthetic construct
GLGFARF

SEQ ID NO: 12185 - protein, 7 aa, Artificial Sequence
  Synthetic construct
GLGFARY

SEQ ID NO: 12186 - protein, 7 aa, Artificial Sequence
  Synthetic construct
GLGFACF

SEQ ID NO: 12187 - protein, 7 aa, Artificial Sequence
  Synthetic construct
GLGFACY

SEQ ID NO: 12188 - protein, 7 aa, Artificial Sequence
  Synthetic construct
GLGFALF

SEQ ID NO: 12189 - protein, 7 aa, Artificial Sequence
  Synthetic construct
GLGFALY

SEQ ID NO: 12190 - protein, 7 aa, Artificial Sequence
  Synthetic construct
GLGFAAF

SEQ ID NO: 12191 - protein, 7 aa, Artificial Sequence
  Synthetic construct
GLGFAAY

SEQ ID NO: 12192 - protein, 7 aa, Artificial Sequence
  Synthetic construct
GLGFAQF

SEQ ID NO: 12193 - protein, 7 aa, Artificial Sequence
  Synthetic construct
GLGFAQY

SEQ ID NO: 12194 - protein, 7 aa, Artificial Sequence
  Synthetic construct
GLGFADF

SEQ ID NO: 12195 - protein, 7 aa, Artificial Sequence
  Synthetic construct
GLGFADY

SEQ ID NO: 12196 - protein, 7 aa, Artificial Sequence
  Synthetic construct
GLGFAVF

SEQ ID NO: 12197 - protein, 7 aa, Artificial Sequence
  Synthetic construct
GLGFAVY

SEQ ID NO: 12198 - protein, 7 aa, Artificial Sequence
  Synthetic construct
GLGFQFF

SEQ ID NO: 12199 - protein, 7 aa, Artificial Sequence
  Synthetic construct
GLGFQFY

SEQ ID NO: 12200 - protein, 7 aa, Artificial Sequence
  Synthetic construct
GLGFQRF

SEQ ID NO: 12201 - protein, 7 aa, Artificial Sequence
  Synthetic construct
GLGFQRY

SEQ ID NO: 12202 - protein, 7 aa, Artificial Sequence
  Synthetic construct
GLGFQCF

SEQ ID NO: 12203 - protein, 7 aa, Artificial Sequence
  Synthetic construct
GLGFQCY

SEQ ID NO: 12204 - protein, 7 aa, Artificial Sequence
  Synthetic construct
GLGFQLF

SEQ ID NO: 12205 - protein, 7 aa, Artificial Sequence
  Synthetic construct
GLGFQLY

SEQ ID NO: 12206 - protein, 7 aa, Artificial Sequence
  Synthetic construct
GLGFQAF

SEQ ID NO: 12207 - protein, 7 aa, Artificial Sequence
  Synthetic construct
GLGFQAY

SEQ ID NO: 12208 - protein, 7 aa, Artificial Sequence
  Synthetic construct
GLGFQQF

SEQ ID NO: 12209 - protein, 7 aa, Artificial Sequence
  Synthetic construct
GLGFQQY

SEQ ID NO: 12210 - protein, 7 aa, Artificial Sequence
  Synthetic construct
GLGFQDF

SEQ ID NO: 12211 - protein, 7 aa, Artificial Sequence
  Synthetic construct
GLGFQDY

SEQ ID NO: 12212 - protein, 7 aa, Artificial Sequence
  Synthetic construct
GLGFQVF

SEQ ID NO: 12213 - protein, 7 aa, Artificial Sequence
  Synthetic construct
GLGFQVY

SEQ ID NO: 12214 - protein, 7 aa, Artificial Sequence
  Synthetic construct
YWIYIFF

SEQ ID NO: 12215 - protein, 7 aa, Artificial Sequence
  Synthetic construct
YWIYIFY

SEQ ID NO: 12216 - protein, 7 aa, Artificial Sequence
  Synthetic construct
YWIYIRF

SEQ ID NO: 12217 - protein, 7 aa, Artificial Sequence
  Synthetic construct
YWIYIRY

SEQ ID NO: 12218 - protein, 7 aa, Artificial Sequence
  Synthetic construct
YWIYICF

SEQ ID NO: 12219 - protein, 7 aa, Artificial Sequence
  Synthetic construct
YWIYICY

SEQ ID NO: 12220 - protein, 7 aa, Artificial Sequence
  Synthetic construct
YWIYILF

SEQ ID NO: 12221 - protein, 7 aa, Artificial Sequence
  Synthetic construct
YWIYILY

SEQ ID NO: 12222 - protein, 7 aa, Artificial Sequence
  Synthetic construct
YWIYIAF

SEQ ID NO: 12223 - protein, 7 aa, Artificial Sequence
  Synthetic construct
YWIYIAY

SEQ ID NO: 12224 - protein, 7 aa, Artificial Sequence
  Synthetic construct
YWIYIQF

SEQ ID NO: 12225 - protein, 7 aa, Artificial Sequence
  Synthetic construct
YWIYIQY

SEQ ID NO: 12226 - protein, 7 aa, Artificial Sequence
  Synthetic construct
YWIYIDF

SEQ ID NO: 12227 - protein, 7 aa, Artificial Sequence
  Synthetic construct
YWIYIDY

SEQ ID NO: 12228 - protein, 7 aa, Artificial Sequence
  Synthetic construct
YWIYIVF

SEQ ID NO: 12229 - protein, 7 aa, Artificial Sequence
  Synthetic construct
YWIYIVY

SEQ ID NO: 12230 - protein, 7 aa, Artificial Sequence
  Synthetic construct
YWIYDFF

SEQ ID NO: 12231 - protein, 7 aa, Artificial Sequence
  Synthetic construct
YWIYDFY

SEQ ID NO: 12232 - protein, 7 aa, Artificial Sequence
  Synthetic construct
YWIYDRF

SEQ ID NO: 12233 - protein, 7 aa, Artificial Sequence
  Synthetic construct
YWIYDRY

SEQ ID NO: 12234 - protein, 7 aa, Artificial Sequence
  Synthetic construct
YWIYDCF

SEQ ID NO: 12235 - protein, 7 aa, Artificial Sequence
  Synthetic construct
YWIYDCY

SEQ ID NO: 12236 - protein, 7 aa, Artificial Sequence
  Synthetic construct
YWIYDLF

SEQ ID NO: 12237 - protein, 7 aa, Artificial Sequence
  Synthetic construct
YWIYDLY

SEQ ID NO: 12238 - protein, 7 aa, Artificial Sequence
  Synthetic construct
YWIYDAF

SEQ ID NO: 12239 - protein, 7 aa, Artificial Sequence
  Synthetic construct
YWIYDAY

SEQ ID NO: 12240 - protein, 7 aa, Artificial Sequence
  Synthetic construct
YWIYDQF

SEQ ID NO: 12241 - protein, 7 aa, Artificial Sequence
  Synthetic construct
YWIYDQY

SEQ ID NO: 12242 - protein, 7 aa, Artificial Sequence
  Synthetic construct
YWIYDDF

SEQ ID NO: 12243 - protein, 7 aa, Artificial Sequence
  Synthetic construct
YWIYDDY

SEQ ID NO: 12244 - protein, 7 aa, Artificial Sequence
  Synthetic construct
YWIYDVF

SEQ ID NO: 12245 - protein, 7 aa, Artificial Sequence
  Synthetic construct
YWIYDVY

SEQ ID NO: 12246 - protein, 7 aa, Artificial Sequence
  Synthetic construct
YWIYYFF

SEQ ID NO: 12247 - protein, 7 aa, Artificial Sequence
  Synthetic construct
YWIYYFY

SEQ ID NO: 12248 - protein, 7 aa, Artificial Sequence
  Synthetic construct
YWIYYRF

SEQ ID NO: 12249 - protein, 7 aa, Artificial Sequence
  Synthetic construct
YWIYYRY

SEQ ID NO: 12250 - protein, 7 aa, Artificial Sequence
  Synthetic construct
YWIYYCF

SEQ ID NO: 12251 - protein, 7 aa, Artificial Sequence
  Synthetic construct
YWIYYCY

SEQ ID NO: 12252 - protein, 7 aa, Artificial Sequence
  Synthetic construct
YWIYYLF

SEQ ID NO: 12253 - protein, 7 aa, Artificial Sequence
  Synthetic construct
YWIYYLY

SEQ ID NO: 12254 - protein, 7 aa, Artificial Sequence
  Synthetic construct
YWIYYAF

SEQ ID NO: 12255 - protein, 7 aa, Artificial Sequence
  Synthetic construct
YWIYYAY

SEQ ID NO: 12256 - protein, 7 aa, Artificial Sequence
  Synthetic construct
YWIYYQF

SEQ ID NO: 12257 - protein, 7 aa, Artificial Sequence
  Synthetic construct
YWIYYQY

SEQ ID NO: 12258 - protein, 7 aa, Artificial Sequence
  Synthetic construct
YWIYYDF

SEQ ID NO: 12259 - protein, 7 aa, Artificial Sequence
  Synthetic construct
YWIYYDY

SEQ ID NO: 12260 - protein, 7 aa, Artificial Sequence
  Synthetic construct
YWIYYVF

SEQ ID NO: 12261 - protein, 7 aa, Artificial Sequence
  Synthetic construct
YWIYYVY

SEQ ID NO: 12262 - protein, 7 aa, Artificial Sequence
  Synthetic construct
YWIYFFF

SEQ ID NO: 12263 - protein, 7 aa, Artificial Sequence
  Synthetic construct
YWIYFFY

SEQ ID NO: 12264 - protein, 7 aa, Artificial Sequence
  Synthetic construct
YWIYFRF

SEQ ID NO: 12265 - protein, 7 aa, Artificial Sequence
  Synthetic construct
YWIYFRY

SEQ ID NO: 12266 - protein, 7 aa, Artificial Sequence
  Synthetic construct
YWIYFCF

SEQ ID NO: 12267 - protein, 7 aa, Artificial Sequence
  Synthetic construct
YWIYFCY

SEQ ID NO: 12268 - protein, 7 aa, Artificial Sequence
  Synthetic construct
YWIYFLF

SEQ ID NO: 12269 - protein, 7 aa, Artificial Sequence
  Synthetic construct
YWIYFLY

SEQ ID NO: 12270 - protein, 7 aa, Artificial Sequence
  Synthetic construct
YWIYFAF

SEQ ID NO: 12271 - protein, 7 aa, Artificial Sequence
  Synthetic construct
YWIYFAY

SEQ ID NO: 12272 - protein, 7 aa, Artificial Sequence
  Synthetic construct
YWIYFQF

SEQ ID NO: 12273 - protein, 7 aa, Artificial Sequence
  Synthetic construct
YWIYFQY

SEQ ID NO: 12274 - protein, 7 aa, Artificial Sequence
  Synthetic construct
YWIYFDF

SEQ ID NO: 12275 - protein, 7 aa, Artificial Sequence
  Synthetic construct
YWIYFDY

SEQ ID NO: 12276 - protein, 7 aa, Artificial Sequence
  Synthetic construct
YWIYFVF

SEQ ID NO: 12277 - protein, 7 aa, Artificial Sequence
  Synthetic construct
YWIYFVY

SEQ ID NO: 12278 - protein, 7 aa, Artificial Sequence
  Synthetic construct
YWIYVFF

SEQ ID NO: 12279 - protein, 7 aa, Artificial Sequence
  Synthetic construct
YWIYVFY

SEQ ID NO: 12280 - protein, 7 aa, Artificial Sequence
  Synthetic construct
YWIYVRF

SEQ ID NO: 12281 - protein, 7 aa, Artificial Sequence
  Synthetic construct
YWIYVRY

SEQ ID NO: 12282 - protein, 7 aa, Artificial Sequence
  Synthetic construct
YWIYVCF

SEQ ID NO: 12283 - protein, 7 aa, Artificial Sequence
  Synthetic construct
YWIYVCY

SEQ ID NO: 12284 - protein, 7 aa, Artificial Sequence
  Synthetic construct
YWIYVLF

SEQ ID NO: 12285 - protein, 7 aa, Artificial Sequence
  Synthetic construct
YWIYVLY

SEQ ID NO: 12286 - protein, 7 aa, Artificial Sequence
  Synthetic construct
YWIYVAF

SEQ ID NO: 12287 - protein, 7 aa, Artificial Sequence
  Synthetic construct
YWIYVAY

SEQ ID NO: 12288 - protein, 7 aa, Artificial Sequence
  Synthetic construct
YWIYVQF

SEQ ID NO: 12289 - protein, 7 aa, Artificial Sequence
  Synthetic construct
YWIYVQY

SEQ ID NO: 12290 - protein, 7 aa, Artificial Sequence
  Synthetic construct
YWIYVDF

SEQ ID NO: 12291 - protein, 7 aa, Artificial Sequence
  Synthetic construct
YWIYVDY

SEQ ID NO: 12292 - protein, 7 aa, Artificial Sequence
  Synthetic construct
YWIYVVF

SEQ ID NO: 12293 - protein, 7 aa, Artificial Sequence
  Synthetic construct
YWIYVVY

SEQ ID NO: 12294 - protein, 7 aa, Artificial Sequence
  Synthetic construct
YWIYTFF

SEQ ID NO: 12295 - protein, 7 aa, Artificial Sequence
  Synthetic construct
YWIYTFY

SEQ ID NO: 12296 - protein, 7 aa, Artificial Sequence
  Synthetic construct
YWIYTRF

SEQ ID NO: 12297 - protein, 7 aa, Artificial Sequence
  Synthetic construct
YWIYTRY

SEQ ID NO: 12298 - protein, 7 aa, Artificial Sequence
  Synthetic construct
YWIYTCF

SEQ ID NO: 12299 - protein, 7 aa, Artificial Sequence
  Synthetic construct
YWIYTCY

SEQ ID NO: 12300 - protein, 7 aa, Artificial Sequence
  Synthetic construct
YWIYTLF

SEQ ID NO: 12301 - protein, 7 aa, Artificial Sequence
  Synthetic construct
YWIYTLY

SEQ ID NO: 12302 - protein, 7 aa, Artificial Sequence
  Synthetic construct
YWIYTAF

SEQ ID NO: 12303 - protein, 7 aa, Artificial Sequence
  Synthetic construct
YWIYTAY

SEQ ID NO: 12304 - protein, 7 aa, Artificial Sequence
  Synthetic construct
YWIYTQF

SEQ ID NO: 12305 - protein, 7 aa, Artificial Sequence
  Synthetic construct
YWIYTQY

SEQ ID NO: 12306 - protein, 7 aa, Artificial Sequence
  Synthetic construct
YWIYTDF

SEQ ID NO: 12307 - protein, 7 aa, Artificial Sequence
  Synthetic construct
YWIYTDY

SEQ ID NO: 12308 - protein, 7 aa, Artificial Sequence
  Synthetic construct
YWIYTVF

SEQ ID NO: 12309 - protein, 7 aa, Artificial Sequence
  Synthetic construct
YWIYTVY

SEQ ID NO: 12310 - protein, 7 aa, Artificial Sequence
  Synthetic construct
YWIYGFF

SEQ ID NO: 12311 - protein, 7 aa, Artificial Sequence
  Synthetic construct
YWIYGFY

SEQ ID NO: 12312 - protein, 7 aa, Artificial Sequence
  Synthetic construct
YWIYGRF

SEQ ID NO: 12313 - protein, 7 aa, Artificial Sequence
  Synthetic construct
YWIYGRY

SEQ ID NO: 12314 - protein, 7 aa, Artificial Sequence
  Synthetic construct
YWIYGCF

SEQ ID NO: 12315 - protein, 7 aa, Artificial Sequence
  Synthetic construct
YWIYGCY

SEQ ID NO: 12316 - protein, 7 aa, Artificial Sequence
  Synthetic construct
YWIYGLF

SEQ ID NO: 12317 - protein, 7 aa, Artificial Sequence
  Synthetic construct
YWIYGLY

SEQ ID NO: 12318 - protein, 7 aa, Artificial Sequence
  Synthetic construct
YWIYGAF

SEQ ID NO: 12319 - protein, 7 aa, Artificial Sequence
  Synthetic construct
YWIYGAY

SEQ ID NO: 12320 - protein, 7 aa, Artificial Sequence
  Synthetic construct
YWIYGQF

SEQ ID NO: 12321 - protein, 7 aa, Artificial Sequence
  Synthetic construct
YWIYGQY

SEQ ID NO: 12322 - protein, 7 aa, Artificial Sequence
  Synthetic construct
YWIYGDF

SEQ ID NO: 12323 - protein, 7 aa, Artificial Sequence
  Synthetic construct
YWIYGDY

SEQ ID NO: 12324 - protein, 7 aa, Artificial Sequence
  Synthetic construct
YWIYGVF

SEQ ID NO: 12325 - protein, 7 aa, Artificial Sequence
  Synthetic construct
YWIYGVY

SEQ ID NO: 12326 - protein, 7 aa, Artificial Sequence
  Synthetic construct
YWIYAFF

SEQ ID NO: 12327 - protein, 7 aa, Artificial Sequence
  Synthetic construct
YWIYAFY

SEQ ID NO: 12328 - protein, 7 aa, Artificial Sequence
  Synthetic construct
YWIYARF

SEQ ID NO: 12329 - protein, 7 aa, Artificial Sequence
  Synthetic construct
YWIYARY

SEQ ID NO: 12330 - protein, 7 aa, Artificial Sequence
  Synthetic construct
YWIYACF

SEQ ID NO: 12331 - protein, 7 aa, Artificial Sequence
  Synthetic construct
YWIYACY

SEQ ID NO: 12332 - protein, 7 aa, Artificial Sequence
  Synthetic construct
YWIYALF

SEQ ID NO: 12333 - protein, 7 aa, Artificial Sequence
  Synthetic construct
YWIYALY

SEQ ID NO: 12334 - protein, 7 aa, Artificial Sequence
  Synthetic construct
YWIYAAF

SEQ ID NO: 12335 - protein, 7 aa, Artificial Sequence
  Synthetic construct
YWIYAAY

SEQ ID NO: 12336 - protein, 7 aa, Artificial Sequence
  Synthetic construct
YWIYAQF

SEQ ID NO: 12337 - protein, 7 aa, Artificial Sequence
  Synthetic construct
YWIYAQY

SEQ ID NO: 12338 - protein, 7 aa, Artificial Sequence
  Synthetic construct
YWIYADF

SEQ ID NO: 12339 - protein, 7 aa, Artificial Sequence
  Synthetic construct
YWIYADY

SEQ ID NO: 12340 - protein, 7 aa, Artificial Sequence
  Synthetic construct
YWIYAVF

SEQ ID NO: 12341 - protein, 7 aa, Artificial Sequence
  Synthetic construct
YWIYAVY

SEQ ID NO: 12342 - protein, 7 aa, Artificial Sequence
  Synthetic construct
YWIYQFF

SEQ ID NO: 12343 - protein, 7 aa, Artificial Sequence
  Synthetic construct
YWIYQFY

SEQ ID NO: 12344 - protein, 7 aa, Artificial Sequence
  Synthetic construct
YWIYQRF

SEQ ID NO: 12345 - protein, 7 aa, Artificial Sequence
  Synthetic construct
YWIYQRY

SEQ ID NO: 12346 - protein, 7 aa, Artificial Sequence
  Synthetic construct
YWIYQCF

SEQ ID NO: 12347 - protein, 7 aa, Artificial Sequence
  Synthetic construct
YWIYQCY

SEQ ID NO: 12348 - protein, 7 aa, Artificial Sequence
  Synthetic construct
YWIYQLF

SEQ ID NO: 12349 - protein, 7 aa, Artificial Sequence
  Synthetic construct
YWIYQLY

SEQ ID NO: 12350 - protein, 7 aa, Artificial Sequence
  Synthetic construct
YWIYQAF

SEQ ID NO: 12351 - protein, 7 aa, Artificial Sequence
  Synthetic construct
YWIYQAY

SEQ ID NO: 12352 - protein, 7 aa, Artificial Sequence
  Synthetic construct
YWIYQQF

SEQ ID NO: 12353 - protein, 7 aa, Artificial Sequence
  Synthetic construct
YWIYQQY

SEQ ID NO: 12354 - protein, 7 aa, Artificial Sequence
  Synthetic construct
YWIYQDF

SEQ ID NO: 12355 - protein, 7 aa, Artificial Sequence
  Synthetic construct
YWIYQDY

SEQ ID NO: 12356 - protein, 7 aa, Artificial Sequence
  Synthetic construct
YWIYQVF

SEQ ID NO: 12357 - protein, 7 aa, Artificial Sequence
  Synthetic construct
YWIYQVY

SEQ ID NO: 12358 - protein, 7 aa, Artificial Sequence
  Synthetic construct
YWIPIFF

SEQ ID NO: 12359 - protein, 7 aa, Artificial Sequence
  Synthetic construct
YWIPIFY

SEQ ID NO: 12360 - protein, 7 aa, Artificial Sequence
  Synthetic construct
YWIPIRF

SEQ ID NO: 12361 - protein, 7 aa, Artificial Sequence
  Synthetic construct
YWIPIRY

SEQ ID NO: 12362 - protein, 7 aa, Artificial Sequence
  Synthetic construct
YWIPICF

SEQ ID NO: 12363 - protein, 7 aa, Artificial Sequence
  Synthetic construct
YWIPICY

SEQ ID NO: 12364 - protein, 7 aa, Artificial Sequence
  Synthetic construct
YWIPILF

SEQ ID NO: 12365 - protein, 7 aa, Artificial Sequence
  Synthetic construct
YWIPILY

SEQ ID NO: 12366 - protein, 7 aa, Artificial Sequence
  Synthetic construct
YWIPIAF

SEQ ID NO: 12367 - protein, 7 aa, Artificial Sequence
  Synthetic construct
YWIPIAY

SEQ ID NO: 12368 - protein, 7 aa, Artificial Sequence
  Synthetic construct
YWIPIQF

SEQ ID NO: 12369 - protein, 7 aa, Artificial Sequence
  Synthetic construct
YWIPIQY

SEQ ID NO: 12370 - protein, 7 aa, Artificial Sequence
  Synthetic construct
YWIPIDF

SEQ ID NO: 12371 - protein, 7 aa, Artificial Sequence
  Synthetic construct
YWIPIDY

SEQ ID NO: 12372 - protein, 7 aa, Artificial Sequence
  Synthetic construct
YWIPIVF

SEQ ID NO: 12373 - protein, 7 aa, Artificial Sequence
  Synthetic construct
YWIPIVY

SEQ ID NO: 12374 - protein, 7 aa, Artificial Sequence
  Synthetic construct
YWIPDFF

SEQ ID NO: 12375 - protein, 7 aa, Artificial Sequence
  Synthetic construct
YWIPDFY

SEQ ID NO: 12376 - protein, 7 aa, Artificial Sequence
  Synthetic construct
YWIPDRF

SEQ ID NO: 12377 - protein, 7 aa, Artificial Sequence
  Synthetic construct
YWIPDRY

SEQ ID NO: 12378 - protein, 7 aa, Artificial Sequence
  Synthetic construct
YWIPDCF

SEQ ID NO: 12379 - protein, 7 aa, Artificial Sequence
  Synthetic construct
YWIPDCY

SEQ ID NO: 12380 - protein, 7 aa, Artificial Sequence
  Synthetic construct
YWIPDLF

SEQ ID NO: 12381 - protein, 7 aa, Artificial Sequence
  Synthetic construct
YWIPDLY

SEQ ID NO: 12382 - protein, 7 aa, Artificial Sequence
  Synthetic construct
YWIPDAF

SEQ ID NO: 12383 - protein, 7 aa, Artificial Sequence
  Synthetic construct
YWIPDAY

SEQ ID NO: 12384 - protein, 7 aa, Artificial Sequence
  Synthetic construct
YWIPDQF

SEQ ID NO: 12385 - protein, 7 aa, Artificial Sequence
  Synthetic construct
YWIPDQY

SEQ ID NO: 12386 - protein, 7 aa, Artificial Sequence
  Synthetic construct
YWIPDDF

SEQ ID NO: 12387 - protein, 7 aa, Artificial Sequence
  Synthetic construct
YWIPDDY

SEQ ID NO: 12388 - protein, 7 aa, Artificial Sequence
  Synthetic construct
YWIPDVF

SEQ ID NO: 12389 - protein, 7 aa, Artificial Sequence
  Synthetic construct
YWIPDVY

SEQ ID NO: 12390 - protein, 7 aa, Artificial Sequence
  Synthetic construct
YWIPYFF

SEQ ID NO: 12391 - protein, 7 aa, Artificial Sequence
  Synthetic construct
YWIPYFY

SEQ ID NO: 12392 - protein, 7 aa, Artificial Sequence
  Synthetic construct
YWIPYRF

SEQ ID NO: 12393 - protein, 7 aa, Artificial Sequence
  Synthetic construct
YWIPYRY

SEQ ID NO: 12394 - protein, 7 aa, Artificial Sequence
  Synthetic construct
YWIPYCF

SEQ ID NO: 12395 - protein, 7 aa, Artificial Sequence
  Synthetic construct
YWIPYCY

SEQ ID NO: 12396 - protein, 7 aa, Artificial Sequence
  Synthetic construct
YWIPYLF

SEQ ID NO: 12397 - protein, 7 aa, Artificial Sequence
  Synthetic construct
YWIPYLY

SEQ ID NO: 12398 - protein, 7 aa, Artificial Sequence
  Synthetic construct
YWIPYAF

SEQ ID NO: 12399 - protein, 7 aa, Artificial Sequence
  Synthetic construct
YWIPYAY

SEQ ID NO: 12400 - protein, 7 aa, Artificial Sequence
  Synthetic construct
YWIPYQF

SEQ ID NO: 12401 - protein, 7 aa, Artificial Sequence
  Synthetic construct
YWIPYQY

SEQ ID NO: 12402 - protein, 7 aa, Artificial Sequence
  Synthetic construct
YWIPYDF

SEQ ID NO: 12403 - protein, 7 aa, Artificial Sequence
  Synthetic construct
YWIPYDY

SEQ ID NO: 12404 - protein, 7 aa, Artificial Sequence
  Synthetic construct
YWIPYVF

SEQ ID NO: 12405 - protein, 7 aa, Artificial Sequence
  Synthetic construct
YWIPYVY

SEQ ID NO: 12406 - protein, 7 aa, Artificial Sequence
  Synthetic construct
YWIPFFF

SEQ ID NO: 12407 - protein, 7 aa, Artificial Sequence
  Synthetic construct
YWIPFFY

SEQ ID NO: 12408 - protein, 7 aa, Artificial Sequence
  Synthetic construct
YWIPFRF

SEQ ID NO: 12409 - protein, 7 aa, Artificial Sequence
  Synthetic construct
YWIPFRY

SEQ ID NO: 12410 - protein, 7 aa, Artificial Sequence
  Synthetic construct
YWIPFCF

SEQ ID NO: 12411 - protein, 7 aa, Artificial Sequence
  Synthetic construct
YWIPFCY

SEQ ID NO: 12412 - protein, 7 aa, Artificial Sequence
  Synthetic construct
YWIPFLF

SEQ ID NO: 12413 - protein, 7 aa, Artificial Sequence
  Synthetic construct
YWIPFLY

SEQ ID NO: 12414 - protein, 7 aa, Artificial Sequence
  Synthetic construct
YWIPFAF

SEQ ID NO: 12415 - protein, 7 aa, Artificial Sequence
  Synthetic construct
YWIPFAY

SEQ ID NO: 12416 - protein, 7 aa, Artificial Sequence
  Synthetic construct
YWIPFQF

SEQ ID NO: 12417 - protein, 7 aa, Artificial Sequence
  Synthetic construct
YWIPFQY

SEQ ID NO: 12418 - protein, 7 aa, Artificial Sequence
  Synthetic construct
YWIPFDF

SEQ ID NO: 12419 - protein, 7 aa, Artificial Sequence
  Synthetic construct
YWIPFDY

SEQ ID NO: 12420 - protein, 7 aa, Artificial Sequence
  Synthetic construct
YWIPFVF

SEQ ID NO: 12421 - protein, 7 aa, Artificial Sequence
  Synthetic construct
YWIPFVY

SEQ ID NO: 12422 - protein, 7 aa, Artificial Sequence
  Synthetic construct
YWIPVFF

SEQ ID NO: 12423 - protein, 7 aa, Artificial Sequence
  Synthetic construct
YWIPVFY

SEQ ID NO: 12424 - protein, 7 aa, Artificial Sequence
  Synthetic construct
YWIPVRF

SEQ ID NO: 12425 - protein, 7 aa, Artificial Sequence
  Synthetic construct
YWIPVRY

SEQ ID NO: 12426 - protein, 7 aa, Artificial Sequence
  Synthetic construct
YWIPVCF

SEQ ID NO: 12427 - protein, 7 aa, Artificial Sequence
  Synthetic construct
YWIPVCY

SEQ ID NO: 12428 - protein, 7 aa, Artificial Sequence
  Synthetic construct
YWIPVLF

SEQ ID NO: 12429 - protein, 7 aa, Artificial Sequence
  Synthetic construct
YWIPVLY

SEQ ID NO: 12430 - protein, 7 aa, Artificial Sequence
  Synthetic construct
YWIPVAF

SEQ ID NO: 12431 - protein, 7 aa, Artificial Sequence
  Synthetic construct
YWIPVAY

SEQ ID NO: 12432 - protein, 7 aa, Artificial Sequence
  Synthetic construct
YWIPVQF

SEQ ID NO: 12433 - protein, 7 aa, Artificial Sequence
  Synthetic construct
YWIPVQY

SEQ ID NO: 12434 - protein, 7 aa, Artificial Sequence
  Synthetic construct
YWIPVDF

SEQ ID NO: 12435 - protein, 7 aa, Artificial Sequence
  Synthetic construct
YWIPVDY

SEQ ID NO: 12436 - protein, 7 aa, Artificial Sequence
  Synthetic construct
YWIPVVF

SEQ ID NO: 12437 - protein, 7 aa, Artificial Sequence
  Synthetic construct
YWIPVVY

SEQ ID NO: 12438 - protein, 7 aa, Artificial Sequence
  Synthetic construct
YWIPTFF

SEQ ID NO: 12439 - protein, 7 aa, Artificial Sequence
  Synthetic construct
YWIPTFY

SEQ ID NO: 12440 - protein, 7 aa, Artificial Sequence
  Synthetic construct
YWIPTRF

SEQ ID NO: 12441 - protein, 7 aa, Artificial Sequence
  Synthetic construct
YWIPTRY

SEQ ID NO: 12442 - protein, 7 aa, Artificial Sequence
  Synthetic construct
YWIPTCF

SEQ ID NO: 12443 - protein, 7 aa, Artificial Sequence
  Synthetic construct
YWIPTCY

SEQ ID NO: 12444 - protein, 7 aa, Artificial Sequence
  Synthetic construct
YWIPTLF

SEQ ID NO: 12445 - protein, 7 aa, Artificial Sequence
  Synthetic construct
YWIPTLY

SEQ ID NO: 12446 - protein, 7 aa, Artificial Sequence
  Synthetic construct
YWIPTAF

SEQ ID NO: 12447 - protein, 7 aa, Artificial Sequence
  Synthetic construct
YWIPTAY

SEQ ID NO: 12448 - protein, 7 aa, Artificial Sequence
  Synthetic construct
YWIPTQF

SEQ ID NO: 12449 - protein, 7 aa, Artificial Sequence
  Synthetic construct
YWIPTQY

SEQ ID NO: 12450 - protein, 7 aa, Artificial Sequence
  Synthetic construct
YWIPTDF

SEQ ID NO: 12451 - protein, 7 aa, Artificial Sequence
  Synthetic construct
YWIPTDY

SEQ ID NO: 12452 - protein, 7 aa, Artificial Sequence
  Synthetic construct
YWIPTVF

SEQ ID NO: 12453 - protein, 7 aa, Artificial Sequence
  Synthetic construct
YWIPTVY

SEQ ID NO: 12454 - protein, 7 aa, Artificial Sequence
  Synthetic construct
YWIPGFF

SEQ ID NO: 12455 - protein, 7 aa, Artificial Sequence
  Synthetic construct
YWIPGFY

SEQ ID NO: 12456 - protein, 7 aa, Artificial Sequence
  Synthetic construct
YWIPGRF

SEQ ID NO: 12457 - protein, 7 aa, Artificial Sequence
  Synthetic construct
YWIPGRY

SEQ ID NO: 12458 - protein, 7 aa, Artificial Sequence
  Synthetic construct
YWIPGCF

SEQ ID NO: 12459 - protein, 7 aa, Artificial Sequence
  Synthetic construct
YWIPGCY

SEQ ID NO: 12460 - protein, 7 aa, Artificial Sequence
  Synthetic construct
YWIPGLF

SEQ ID NO: 12461 - protein, 7 aa, Artificial Sequence
  Synthetic construct
YWIPGLY

SEQ ID NO: 12462 - protein, 7 aa, Artificial Sequence
  Synthetic construct
YWIPGAF

SEQ ID NO: 12463 - protein, 7 aa, Artificial Sequence
  Synthetic construct
YWIPGAY

SEQ ID NO: 12464 - protein, 7 aa, Artificial Sequence
  Synthetic construct
YWIPGQF

SEQ ID NO: 12465 - protein, 7 aa, Artificial Sequence
  Synthetic construct
YWIPGQY

SEQ ID NO: 12466 - protein, 7 aa, Artificial Sequence
  Synthetic construct
YWIPGDF

SEQ ID NO: 12467 - protein, 7 aa, Artificial Sequence
  Synthetic construct
YWIPGDY

SEQ ID NO: 12468 - protein, 7 aa, Artificial Sequence
  Synthetic construct
YWIPGVF

SEQ ID NO: 12469 - protein, 7 aa, Artificial Sequence
  Synthetic construct
YWIPGVY

SEQ ID NO: 12470 - protein, 7 aa, Artificial Sequence
  Synthetic construct
YWIPAFF

SEQ ID NO: 12471 - protein, 7 aa, Artificial Sequence
  Synthetic construct
YWIPAFY

SEQ ID NO: 12472 - protein, 7 aa, Artificial Sequence
  Synthetic construct
YWIPARF

SEQ ID NO: 12473 - protein, 7 aa, Artificial Sequence
  Synthetic construct
YWIPARY

SEQ ID NO: 12474 - protein, 7 aa, Artificial Sequence
  Synthetic construct
YWIPACF

SEQ ID NO: 12475 - protein, 7 aa, Artificial Sequence
  Synthetic construct
YWIPACY

SEQ ID NO: 12476 - protein, 7 aa, Artificial Sequence
  Synthetic construct
YWIPALF

SEQ ID NO: 12477 - protein, 7 aa, Artificial Sequence
  Synthetic construct
YWIPALY

SEQ ID NO: 12478 - protein, 7 aa, Artificial Sequence
  Synthetic construct
YWIPAAF

SEQ ID NO: 12479 - protein, 7 aa, Artificial Sequence
  Synthetic construct
YWIPAAY

SEQ ID NO: 12480 - protein, 7 aa, Artificial Sequence
  Synthetic construct
YWIPAQF

SEQ ID NO: 12481 - protein, 7 aa, Artificial Sequence
  Synthetic construct
YWIPAQY

SEQ ID NO: 12482 - protein, 7 aa, Artificial Sequence
  Synthetic construct
YWIPADF

SEQ ID NO: 12483 - protein, 7 aa, Artificial Sequence
  Synthetic construct
YWIPADY

SEQ ID NO: 12484 - protein, 7 aa, Artificial Sequence
  Synthetic construct
YWIPAVF

SEQ ID NO: 12485 - protein, 7 aa, Artificial Sequence
  Synthetic construct
YWIPAVY

SEQ ID NO: 12486 - protein, 7 aa, Artificial Sequence
  Synthetic construct
YWIPQFF

SEQ ID NO: 12487 - protein, 7 aa, Artificial Sequence
  Synthetic construct
YWIPQFY

SEQ ID NO: 12488 - protein, 7 aa, Artificial Sequence
  Synthetic construct
YWIPQRF

SEQ ID NO: 12489 - protein, 7 aa, Artificial Sequence
  Synthetic construct
YWIPQRY

SEQ ID NO: 12490 - protein, 7 aa, Artificial Sequence
  Synthetic construct
YWIPQCF

SEQ ID NO: 12491 - protein, 7 aa, Artificial Sequence
  Synthetic construct
YWIPQCY

SEQ ID NO: 12492 - protein, 7 aa, Artificial Sequence
  Synthetic construct
YWIPQLF

SEQ ID NO: 12493 - protein, 7 aa, Artificial Sequence
  Synthetic construct
YWIPQLY

SEQ ID NO: 12494 - protein, 7 aa, Artificial Sequence
  Synthetic construct
YWIPQAF

SEQ ID NO: 12495 - protein, 7 aa, Artificial Sequence
  Synthetic construct
YWIPQAY

SEQ ID NO: 12496 - protein, 7 aa, Artificial Sequence
  Synthetic construct
YWIPQQF

SEQ ID NO: 12497 - protein, 7 aa, Artificial Sequence
  Synthetic construct
YWIPQQY

SEQ ID NO: 12498 - protein, 7 aa, Artificial Sequence
  Synthetic construct
YWIPQDF

SEQ ID NO: 12499 - protein, 7 aa, Artificial Sequence
  Synthetic construct
YWIPQDY

SEQ ID NO: 12500 - protein, 7 aa, Artificial Sequence
  Synthetic construct
YWIPQVF

SEQ ID NO: 12501 - protein, 7 aa, Artificial Sequence
  Synthetic construct
YWIPQVY

SEQ ID NO: 12502 - protein, 7 aa, Artificial Sequence
  Synthetic construct
YWIHIFF

SEQ ID NO: 12503 - protein, 7 aa, Artificial Sequence
  Synthetic construct
YWIHIFY

SEQ ID NO: 12504 - protein, 7 aa, Artificial Sequence
  Synthetic construct
YWIHIRF

SEQ ID NO: 12505 - protein, 7 aa, Artificial Sequence
  Synthetic construct
YWIHIRY

SEQ ID NO: 12506 - protein, 7 aa, Artificial Sequence
  Synthetic construct
YWIHICF

SEQ ID NO: 12507 - protein, 7 aa, Artificial Sequence
  Synthetic construct
YWIHICY

SEQ ID NO: 12508 - protein, 7 aa, Artificial Sequence
  Synthetic construct
YWIHILF

SEQ ID NO: 12509 - protein, 7 aa, Artificial Sequence
  Synthetic construct
YWIHILY

SEQ ID NO: 12510 - protein, 7 aa, Artificial Sequence
  Synthetic construct
YWIHIAF

SEQ ID NO: 12511 - protein, 7 aa, Artificial Sequence
  Synthetic construct
YWIHIAY

SEQ ID NO: 12512 - protein, 7 aa, Artificial Sequence
  Synthetic construct
YWIHIQF

SEQ ID NO: 12513 - protein, 7 aa, Artificial Sequence
  Synthetic construct
YWIHIQY

SEQ ID NO: 12514 - protein, 7 aa, Artificial Sequence
  Synthetic construct
YWIHIDF

SEQ ID NO: 12515 - protein, 7 aa, Artificial Sequence
  Synthetic construct
YWIHIDY

SEQ ID NO: 12516 - protein, 7 aa, Artificial Sequence
  Synthetic construct
YWIHIVF

SEQ ID NO: 12517 - protein, 7 aa, Artificial Sequence
  Synthetic construct
YWIHIVY

SEQ ID NO: 12518 - protein, 7 aa, Artificial Sequence
  Synthetic construct
YWIHDFF

SEQ ID NO: 12519 - protein, 7 aa, Artificial Sequence
  Synthetic construct
YWIHDFY

SEQ ID NO: 12520 - protein, 7 aa, Artificial Sequence
  Synthetic construct
YWIHDRF

SEQ ID NO: 12521 - protein, 7 aa, Artificial Sequence
  Synthetic construct
YWIHDRY

SEQ ID NO: 12522 - protein, 7 aa, Artificial Sequence
  Synthetic construct
YWIHDCF

SEQ ID NO: 12523 - protein, 7 aa, Artificial Sequence
  Synthetic construct
YWIHDCY

SEQ ID NO: 12524 - protein, 7 aa, Artificial Sequence
  Synthetic construct
YWIHDLF

SEQ ID NO: 12525 - protein, 7 aa, Artificial Sequence
  Synthetic construct
YWIHDLY

SEQ ID NO: 12526 - protein, 7 aa, Artificial Sequence
  Synthetic construct
YWIHDAF

SEQ ID NO: 12527 - protein, 7 aa, Artificial Sequence
  Synthetic construct
YWIHDAY

SEQ ID NO: 12528 - protein, 7 aa, Artificial Sequence
  Synthetic construct
YWIHDQF

SEQ ID NO: 12529 - protein, 7 aa, Artificial Sequence
  Synthetic construct
YWIHDQY

SEQ ID NO: 12530 - protein, 7 aa, Artificial Sequence
  Synthetic construct
YWIHDDF

SEQ ID NO: 12531 - protein, 7 aa, Artificial Sequence
  Synthetic construct
YWIHDDY

SEQ ID NO: 12532 - protein, 7 aa, Artificial Sequence
  Synthetic construct
YWIHDVF

SEQ ID NO: 12533 - protein, 7 aa, Artificial Sequence
  Synthetic construct
YWIHDVY

SEQ ID NO: 12534 - protein, 7 aa, Artificial Sequence
  Synthetic construct
YWIHYFF

SEQ ID NO: 12535 - protein, 7 aa, Artificial Sequence
  Synthetic construct
YWIHYFY

SEQ ID NO: 12536 - protein, 7 aa, Artificial Sequence
  Synthetic construct
YWIHYRF

SEQ ID NO: 12537 - protein, 7 aa, Artificial Sequence
  Synthetic construct
YWIHYRY

SEQ ID NO: 12538 - protein, 7 aa, Artificial Sequence
  Synthetic construct
YWIHYCF

SEQ ID NO: 12539 - protein, 7 aa, Artificial Sequence
  Synthetic construct
YWIHYCY

SEQ ID NO: 12540 - protein, 7 aa, Artificial Sequence
  Synthetic construct
YWIHYLF

SEQ ID NO: 12541 - protein, 7 aa, Artificial Sequence
  Synthetic construct
YWIHYLY

SEQ ID NO: 12542 - protein, 7 aa, Artificial Sequence
  Synthetic construct
YWIHYAF

SEQ ID NO: 12543 - protein, 7 aa, Artificial Sequence
  Synthetic construct
YWIHYAY

SEQ ID NO: 12544 - protein, 7 aa, Artificial Sequence
  Synthetic construct
YWIHYQF

SEQ ID NO: 12545 - protein, 7 aa, Artificial Sequence
  Synthetic construct
YWIHYQY

SEQ ID NO: 12546 - protein, 7 aa, Artificial Sequence
  Synthetic construct
YWIHYDF

SEQ ID NO: 12547 - protein, 7 aa, Artificial Sequence
  Synthetic construct
YWIHYDY

SEQ ID NO: 12548 - protein, 7 aa, Artificial Sequence
  Synthetic construct
YWIHYVF

SEQ ID NO: 12549 - protein, 7 aa, Artificial Sequence
  Synthetic construct
YWIHYVY

SEQ ID NO: 12550 - protein, 7 aa, Artificial Sequence
  Synthetic construct
YWIHFFF

SEQ ID NO: 12551 - protein, 7 aa, Artificial Sequence
  Synthetic construct
YWIHFFY

SEQ ID NO: 12552 - protein, 7 aa, Artificial Sequence
  Synthetic construct
YWIHFRF

SEQ ID NO: 12553 - protein, 7 aa, Artificial Sequence
  Synthetic construct
YWIHFRY

SEQ ID NO: 12554 - protein, 7 aa, Artificial Sequence
  Synthetic construct
YWIHFCF

SEQ ID NO: 12555 - protein, 7 aa, Artificial Sequence
  Synthetic construct
YWIHFCY

SEQ ID NO: 12556 - protein, 7 aa, Artificial Sequence
  Synthetic construct
YWIHFLF

SEQ ID NO: 12557 - protein, 7 aa, Artificial Sequence
  Synthetic construct
YWIHFLY

SEQ ID NO: 12558 - protein, 7 aa, Artificial Sequence
  Synthetic construct
YWIHFAF

SEQ ID NO: 12559 - protein, 7 aa, Artificial Sequence
  Synthetic construct
YWIHFAY

SEQ ID NO: 12560 - protein, 7 aa, Artificial Sequence
  Synthetic construct
YWIHFQF

SEQ ID NO: 12561 - protein, 7 aa, Artificial Sequence
  Synthetic construct
YWIHFQY

SEQ ID NO: 12562 - protein, 7 aa, Artificial Sequence
  Synthetic construct
YWIHFDF

SEQ ID NO: 12563 - protein, 7 aa, Artificial Sequence
  Synthetic construct
YWIHFDY

SEQ ID NO: 12564 - protein, 7 aa, Artificial Sequence
  Synthetic construct
YWIHFVF

SEQ ID NO: 12565 - protein, 7 aa, Artificial Sequence
  Synthetic construct
YWIHFVY

SEQ ID NO: 12566 - protein, 7 aa, Artificial Sequence
  Synthetic construct
YWIHVFF

SEQ ID NO: 12567 - protein, 7 aa, Artificial Sequence
  Synthetic construct
YWIHVFY

SEQ ID NO: 12568 - protein, 7 aa, Artificial Sequence
  Synthetic construct
YWIHVRF

SEQ ID NO: 12569 - protein, 7 aa, Artificial Sequence
  Synthetic construct
YWIHVRY

SEQ ID NO: 12570 - protein, 7 aa, Artificial Sequence
  Synthetic construct
YWIHVCF

SEQ ID NO: 12571 - protein, 7 aa, Artificial Sequence
  Synthetic construct
YWIHVCY

SEQ ID NO: 12572 - protein, 7 aa, Artificial Sequence
  Synthetic construct
YWIHVLF

SEQ ID NO: 12573 - protein, 7 aa, Artificial Sequence
  Synthetic construct
YWIHVLY

SEQ ID NO: 12574 - protein, 7 aa, Artificial Sequence
  Synthetic construct
YWIHVAF

SEQ ID NO: 12575 - protein, 7 aa, Artificial Sequence
  Synthetic construct
YWIHVAY

SEQ ID NO: 12576 - protein, 7 aa, Artificial Sequence
  Synthetic construct
YWIHVQF

SEQ ID NO: 12577 - protein, 7 aa, Artificial Sequence
  Synthetic construct
YWIHVQY

SEQ ID NO: 12578 - protein, 7 aa, Artificial Sequence
  Synthetic construct
YWIHVDF

SEQ ID NO: 12579 - protein, 7 aa, Artificial Sequence
  Synthetic construct
YWIHVDY

SEQ ID NO: 12580 - protein, 7 aa, Artificial Sequence
  Synthetic construct
YWIHVVF

SEQ ID NO: 12581 - protein, 7 aa, Artificial Sequence
  Synthetic construct
YWIHVVY

SEQ ID NO: 12582 - protein, 7 aa, Artificial Sequence
  Synthetic construct
YWIHTFF

SEQ ID NO: 12583 - protein, 7 aa, Artificial Sequence
  Synthetic construct
YWIHTFY

SEQ ID NO: 12584 - protein, 7 aa, Artificial Sequence
  Synthetic construct
YWIHTRF

SEQ ID NO: 12585 - protein, 7 aa, Artificial Sequence
  Synthetic construct
YWIHTRY

SEQ ID NO: 12586 - protein, 7 aa, Artificial Sequence
  Synthetic construct
YWIHTCF

SEQ ID NO: 12587 - protein, 7 aa, Artificial Sequence
  Synthetic construct
YWIHTCY

SEQ ID NO: 12588 - protein, 7 aa, Artificial Sequence
  Synthetic construct
YWIHTLF

SEQ ID NO: 12589 - protein, 7 aa, Artificial Sequence
  Synthetic construct
YWIHTLY

SEQ ID NO: 12590 - protein, 7 aa, Artificial Sequence
  Synthetic construct
YWIHTAF

SEQ ID NO: 12591 - protein, 7 aa, Artificial Sequence
  Synthetic construct
YWIHTAY

SEQ ID NO: 12592 - protein, 7 aa, Artificial Sequence
  Synthetic construct
YWIHTQF

SEQ ID NO: 12593 - protein, 7 aa, Artificial Sequence
  Synthetic construct
YWIHTQY

SEQ ID NO: 12594 - protein, 7 aa, Artificial Sequence
  Synthetic construct
YWIHTDF

SEQ ID NO: 12595 - protein, 7 aa, Artificial Sequence
  Synthetic construct
YWIHTDY

SEQ ID NO: 12596 - protein, 7 aa, Artificial Sequence
  Synthetic construct
YWIHTVF

SEQ ID NO: 12597 - protein, 7 aa, Artificial Sequence
  Synthetic construct
YWIHTVY

SEQ ID NO: 12598 - protein, 7 aa, Artificial Sequence
  Synthetic construct
YWIHGFF

SEQ ID NO: 12599 - protein, 7 aa, Artificial Sequence
  Synthetic construct
YWIHGFY

SEQ ID NO: 12600 - protein, 7 aa, Artificial Sequence
  Synthetic construct
YWIHGRF

SEQ ID NO: 12601 - protein, 7 aa, Artificial Sequence
  Synthetic construct
YWIHGRY

SEQ ID NO: 12602 - protein, 7 aa, Artificial Sequence
  Synthetic construct
YWIHGCF

SEQ ID NO: 12603 - protein, 7 aa, Artificial Sequence
  Synthetic construct
YWIHGCY

SEQ ID NO: 12604 - protein, 7 aa, Artificial Sequence
  Synthetic construct
YWIHGLF

SEQ ID NO: 12605 - protein, 7 aa, Artificial Sequence
  Synthetic construct
YWIHGLY

SEQ ID NO: 12606 - protein, 7 aa, Artificial Sequence
  Synthetic construct
YWIHGAF

SEQ ID NO: 12607 - protein, 7 aa, Artificial Sequence
  Synthetic construct
YWIHGAY

SEQ ID NO: 12608 - protein, 7 aa, Artificial Sequence
  Synthetic construct
YWIHGQF

SEQ ID NO: 12609 - protein, 7 aa, Artificial Sequence
  Synthetic construct
YWIHGQY

SEQ ID NO: 12610 - protein, 7 aa, Artificial Sequence
  Synthetic construct
YWIHGDF

SEQ ID NO: 12611 - protein, 7 aa, Artificial Sequence
  Synthetic construct
YWIHGDY

SEQ ID NO: 12612 - protein, 7 aa, Artificial Sequence
  Synthetic construct
YWIHGVF

SEQ ID NO: 12613 - protein, 7 aa, Artificial Sequence
  Synthetic construct
YWIHGVY

SEQ ID NO: 12614 - protein, 7 aa, Artificial Sequence
  Synthetic construct
YWIHAFF

SEQ ID NO: 12615 - protein, 7 aa, Artificial Sequence
  Synthetic construct
YWIHAFY

SEQ ID NO: 12616 - protein, 7 aa, Artificial Sequence
  Synthetic construct
YWIHARF

SEQ ID NO: 12617 - protein, 7 aa, Artificial Sequence
  Synthetic construct
YWIHARY

SEQ ID NO: 12618 - protein, 7 aa, Artificial Sequence
  Synthetic construct
YWIHACF

SEQ ID NO: 12619 - protein, 7 aa, Artificial Sequence
  Synthetic construct
YWIHACY

SEQ ID NO: 12620 - protein, 7 aa, Artificial Sequence
  Synthetic construct
YWIHALF

SEQ ID NO: 12621 - protein, 7 aa, Artificial Sequence
  Synthetic construct
YWIHALY

SEQ ID NO: 12622 - protein, 7 aa, Artificial Sequence
  Synthetic construct
YWIHAAF

SEQ ID NO: 12623 - protein, 7 aa, Artificial Sequence
  Synthetic construct
YWIHAAY

SEQ ID NO: 12624 - protein, 7 aa, Artificial Sequence
  Synthetic construct
YWIHAQF

SEQ ID NO: 12625 - protein, 7 aa, Artificial Sequence
  Synthetic construct
YWIHAQY

SEQ ID NO: 12626 - protein, 7 aa, Artificial Sequence
  Synthetic construct
YWIHADF

SEQ ID NO: 12627 - protein, 7 aa, Artificial Sequence
  Synthetic construct
YWIHADY

SEQ ID NO: 12628 - protein, 7 aa, Artificial Sequence
  Synthetic construct
YWIHAVF

SEQ ID NO: 12629 - protein, 7 aa, Artificial Sequence
  Synthetic construct
YWIHAVY

SEQ ID NO: 12630 - protein, 7 aa, Artificial Sequence
  Synthetic construct
YWIHQFF

SEQ ID NO: 12631 - protein, 7 aa, Artificial Sequence
  Synthetic construct
YWIHQFY

SEQ ID NO: 12632 - protein, 7 aa, Artificial Sequence
  Synthetic construct
YWIHQRF

SEQ ID NO: 12633 - protein, 7 aa, Artificial Sequence
  Synthetic construct
YWIHQRY

SEQ ID NO: 12634 - protein, 7 aa, Artificial Sequence
  Synthetic construct
YWIHQCF

SEQ ID NO: 12635 - protein, 7 aa, Artificial Sequence
  Synthetic construct
YWIHQCY

SEQ ID NO: 12636 - protein, 7 aa, Artificial Sequence
  Synthetic construct
YWIHQLF

SEQ ID NO: 12637 - protein, 7 aa, Artificial Sequence
  Synthetic construct
YWIHQLY

SEQ ID NO: 12638 - protein, 7 aa, Artificial Sequence
  Synthetic construct
YWIHQAF

SEQ ID NO: 12639 - protein, 7 aa, Artificial Sequence
  Synthetic construct
YWIHQAY

SEQ ID NO: 12640 - protein, 7 aa, Artificial Sequence
  Synthetic construct
YWIHQQF

SEQ ID NO: 12641 - protein, 7 aa, Artificial Sequence
  Synthetic construct
YWIHQQY

SEQ ID NO: 12642 - protein, 7 aa, Artificial Sequence
  Synthetic construct
YWIHQDF

SEQ ID NO: 12643 - protein, 7 aa, Artificial Sequence
  Synthetic construct
YWIHQDY

SEQ ID NO: 12644 - protein, 7 aa, Artificial Sequence
  Synthetic construct
YWIHQVF

SEQ ID NO: 12645 - protein, 7 aa, Artificial Sequence
  Synthetic construct
YWIHQVY

SEQ ID NO: 12646 - protein, 7 aa, Artificial Sequence
  Synthetic construct
YWILIFF

SEQ ID NO: 12647 - protein, 7 aa, Artificial Sequence
  Synthetic construct
YWILIFY

SEQ ID NO: 12648 - protein, 7 aa, Artificial Sequence
  Synthetic construct
YWILIRF

SEQ ID NO: 12649 - protein, 7 aa, Artificial Sequence
  Synthetic construct
YWILIRY

SEQ ID NO: 12650 - protein, 7 aa, Artificial Sequence
  Synthetic construct
YWILICF

SEQ ID NO: 12651 - protein, 7 aa, Artificial Sequence
  Synthetic construct
YWILICY

SEQ ID NO: 12652 - protein, 7 aa, Artificial Sequence
  Synthetic construct
YWILILF

SEQ ID NO: 12653 - protein, 7 aa, Artificial Sequence
  Synthetic construct
YWILILY

SEQ ID NO: 12654 - protein, 7 aa, Artificial Sequence
  Synthetic construct
YWILIAF

SEQ ID NO: 12655 - protein, 7 aa, Artificial Sequence
  Synthetic construct
YWILIAY

SEQ ID NO: 12656 - protein, 7 aa, Artificial Sequence
  Synthetic construct
YWILIQF

SEQ ID NO: 12657 - protein, 7 aa, Artificial Sequence
  Synthetic construct
YWILIQY

SEQ ID NO: 12658 - protein, 7 aa, Artificial Sequence
  Synthetic construct
YWILIDF

SEQ ID NO: 12659 - protein, 7 aa, Artificial Sequence
  Synthetic construct
YWILIDY

SEQ ID NO: 12660 - protein, 7 aa, Artificial Sequence
  Synthetic construct
YWILIVF

SEQ ID NO: 12661 - protein, 7 aa, Artificial Sequence
  Synthetic construct
YWILIVY

SEQ ID NO: 12662 - protein, 7 aa, Artificial Sequence
  Synthetic construct
YWILDFF

SEQ ID NO: 12663 - protein, 7 aa, Artificial Sequence
  Synthetic construct
YWILDFY

SEQ ID NO: 12664 - protein, 7 aa, Artificial Sequence
  Synthetic construct
YWILDRF

SEQ ID NO: 12665 - protein, 7 aa, Artificial Sequence
  Synthetic construct
YWILDRY

SEQ ID NO: 12666 - protein, 7 aa, Artificial Sequence
  Synthetic construct
YWILDCF

SEQ ID NO: 12667 - protein, 7 aa, Artificial Sequence
  Synthetic construct
YWILDCY

SEQ ID NO: 12668 - protein, 7 aa, Artificial Sequence
  Synthetic construct
YWILDLF

SEQ ID NO: 12669 - protein, 7 aa, Artificial Sequence
  Synthetic construct
YWILDLY

SEQ ID NO: 12670 - protein, 7 aa, Artificial Sequence
  Synthetic construct
YWILDAF

SEQ ID NO: 12671 - protein, 7 aa, Artificial Sequence
  Synthetic construct
YWILDAY

SEQ ID NO: 12672 - protein, 7 aa, Artificial Sequence
  Synthetic construct
YWILDQF

SEQ ID NO: 12673 - protein, 7 aa, Artificial Sequence
  Synthetic construct
YWILDQY

SEQ ID NO: 12674 - protein, 7 aa, Artificial Sequence
  Synthetic construct
YWILDDF

SEQ ID NO: 12675 - protein, 7 aa, Artificial Sequence
  Synthetic construct
YWILDDY

SEQ ID NO: 12676 - protein, 7 aa, Artificial Sequence
  Synthetic construct
YWILDVF

SEQ ID NO: 12677 - protein, 7 aa, Artificial Sequence
  Synthetic construct
YWILDVY

SEQ ID NO: 12678 - protein, 7 aa, Artificial Sequence
  Synthetic construct
YWILYFF

SEQ ID NO: 12679 - protein, 7 aa, Artificial Sequence
  Synthetic construct
YWILYFY

SEQ ID NO: 12680 - protein, 7 aa, Artificial Sequence
  Synthetic construct
YWILYRF

SEQ ID NO: 12681 - protein, 7 aa, Artificial Sequence
  Synthetic construct
YWILYRY

SEQ ID NO: 12682 - protein, 7 aa, Artificial Sequence
  Synthetic construct
YWILYCF

SEQ ID NO: 12683 - protein, 7 aa, Artificial Sequence
  Synthetic construct
YWILYCY

SEQ ID NO: 12684 - protein, 7 aa, Artificial Sequence
  Synthetic construct
YWILYLF

SEQ ID NO: 12685 - protein, 7 aa, Artificial Sequence
  Synthetic construct
YWILYLY

SEQ ID NO: 12686 - protein, 7 aa, Artificial Sequence
  Synthetic construct
YWILYAF

SEQ ID NO: 12687 - protein, 7 aa, Artificial Sequence
  Synthetic construct
YWILYAY

SEQ ID NO: 12688 - protein, 7 aa, Artificial Sequence
  Synthetic construct
YWILYQF

SEQ ID NO: 12689 - protein, 7 aa, Artificial Sequence
  Synthetic construct
YWILYQY

SEQ ID NO: 12690 - protein, 7 aa, Artificial Sequence
  Synthetic construct
YWILYDF

SEQ ID NO: 12691 - protein, 7 aa, Artificial Sequence
  Synthetic construct
YWILYDY

SEQ ID NO: 12692 - protein, 7 aa, Artificial Sequence
  Synthetic construct
YWILYVF

SEQ ID NO: 12693 - protein, 7 aa, Artificial Sequence
  Synthetic construct
YWILYVY

SEQ ID NO: 12694 - protein, 7 aa, Artificial Sequence
  Synthetic construct
YWILFFF

SEQ ID NO: 12695 - protein, 7 aa, Artificial Sequence
  Synthetic construct
YWILFFY

SEQ ID NO: 12696 - protein, 7 aa, Artificial Sequence
  Synthetic construct
YWILFRF

SEQ ID NO: 12697 - protein, 7 aa, Artificial Sequence
  Synthetic construct
YWILFRY

SEQ ID NO: 12698 - protein, 7 aa, Artificial Sequence
  Synthetic construct
YWILFCF

SEQ ID NO: 12699 - protein, 7 aa, Artificial Sequence
  Synthetic construct
YWILFCY

SEQ ID NO: 12700 - protein, 7 aa, Artificial Sequence
  Synthetic construct
YWILFLF

SEQ ID NO: 12701 - protein, 7 aa, Artificial Sequence
  Synthetic construct
YWILFLY

SEQ ID NO: 12702 - protein, 7 aa, Artificial Sequence
  Synthetic construct
YWILFAF

SEQ ID NO: 12703 - protein, 7 aa, Artificial Sequence
  Synthetic construct
YWILFAY

SEQ ID NO: 12704 - protein, 7 aa, Artificial Sequence
  Synthetic construct
YWILFQF

SEQ ID NO: 12705 - protein, 7 aa, Artificial Sequence
  Synthetic construct
YWILFQY

SEQ ID NO: 12706 - protein, 7 aa, Artificial Sequence
  Synthetic construct
YWILFDF

SEQ ID NO: 12707 - protein, 7 aa, Artificial Sequence
  Synthetic construct
YWILFDY

SEQ ID NO: 12708 - protein, 7 aa, Artificial Sequence
  Synthetic construct
YWILFVF

SEQ ID NO: 12709 - protein, 7 aa, Artificial Sequence
  Synthetic construct
YWILFVY

SEQ ID NO: 12710 - protein, 7 aa, Artificial Sequence
  Synthetic construct
YWILVFF

SEQ ID NO: 12711 - protein, 7 aa, Artificial Sequence
  Synthetic construct
YWILVFY

SEQ ID NO: 12712 - protein, 7 aa, Artificial Sequence
  Synthetic construct
YWILVRF

SEQ ID NO: 12713 - protein, 7 aa, Artificial Sequence
  Synthetic construct
YWILVRY

SEQ ID NO: 12714 - protein, 7 aa, Artificial Sequence
  Synthetic construct
YWILVCF

SEQ ID NO: 12715 - protein, 7 aa, Artificial Sequence
  Synthetic construct
YWILVCY

SEQ ID NO: 12716 - protein, 7 aa, Artificial Sequence
  Synthetic construct
YWILVLF

SEQ ID NO: 12717 - protein, 7 aa, Artificial Sequence
  Synthetic construct
YWILVLY

SEQ ID NO: 12718 - protein, 7 aa, Artificial Sequence
  Synthetic construct
YWILVAF

SEQ ID NO: 12719 - protein, 7 aa, Artificial Sequence
  Synthetic construct
YWILVAY

SEQ ID NO: 12720 - protein, 7 aa, Artificial Sequence
  Synthetic construct
YWILVQF

SEQ ID NO: 12721 - protein, 7 aa, Artificial Sequence
  Synthetic construct
YWILVQY

SEQ ID NO: 12722 - protein, 7 aa, Artificial Sequence
  Synthetic construct
YWILVDF

SEQ ID NO: 12723 - protein, 7 aa, Artificial Sequence
  Synthetic construct
YWILVDY

SEQ ID NO: 12724 - protein, 7 aa, Artificial Sequence
  Synthetic construct
YWILVVF

SEQ ID NO: 12725 - protein, 7 aa, Artificial Sequence
  Synthetic construct
YWILVVY

SEQ ID NO: 12726 - protein, 7 aa, Artificial Sequence
  Synthetic construct
YWILTFF

SEQ ID NO: 12727 - protein, 7 aa, Artificial Sequence
  Synthetic construct
YWILTFY

SEQ ID NO: 12728 - protein, 7 aa, Artificial Sequence
  Synthetic construct
YWILTRF

SEQ ID NO: 12729 - protein, 7 aa, Artificial Sequence
  Synthetic construct
YWILTRY

SEQ ID NO: 12730 - protein, 7 aa, Artificial Sequence
  Synthetic construct
YWILTCF

SEQ ID NO: 12731 - protein, 7 aa, Artificial Sequence
  Synthetic construct
YWILTCY

SEQ ID NO: 12732 - protein, 7 aa, Artificial Sequence
  Synthetic construct
YWILTLF

SEQ ID NO: 12733 - protein, 7 aa, Artificial Sequence
  Synthetic construct
YWILTLY

SEQ ID NO: 12734 - protein, 7 aa, Artificial Sequence
  Synthetic construct
YWILTAF

SEQ ID NO: 12735 - protein, 7 aa, Artificial Sequence
  Synthetic construct
YWILTAY

SEQ ID NO: 12736 - protein, 7 aa, Artificial Sequence
  Synthetic construct
YWILTQF

SEQ ID NO: 12737 - protein, 7 aa, Artificial Sequence
  Synthetic construct
YWILTQY

SEQ ID NO: 12738 - protein, 7 aa, Artificial Sequence
  Synthetic construct
YWILTDF

SEQ ID NO: 12739 - protein, 7 aa, Artificial Sequence
  Synthetic construct
YWILTDY

SEQ ID NO: 12740 - protein, 7 aa, Artificial Sequence
  Synthetic construct
YWILTVF

SEQ ID NO: 12741 - protein, 7 aa, Artificial Sequence
  Synthetic construct
YWILTVY

SEQ ID NO: 12742 - protein, 7 aa, Artificial Sequence
  Synthetic construct
YWILGFF

SEQ ID NO: 12743 - protein, 7 aa, Artificial Sequence
  Synthetic construct
YWILGFY

SEQ ID NO: 12744 - protein, 7 aa, Artificial Sequence
  Synthetic construct
YWILGRF

SEQ ID NO: 12745 - protein, 7 aa, Artificial Sequence
  Synthetic construct
YWILGRY

SEQ ID NO: 12746 - protein, 7 aa, Artificial Sequence
  Synthetic construct
YWILGCF

SEQ ID NO: 12747 - protein, 7 aa, Artificial Sequence
  Synthetic construct
YWILGCY

SEQ ID NO: 12748 - protein, 7 aa, Artificial Sequence
  Synthetic construct
YWILGLF

SEQ ID NO: 12749 - protein, 7 aa, Artificial Sequence
  Synthetic construct
YWILGLY

SEQ ID NO: 12750 - protein, 7 aa, Artificial Sequence
  Synthetic construct
YWILGAF

SEQ ID NO: 12751 - protein, 7 aa, Artificial Sequence
  Synthetic construct
YWILGAY

SEQ ID NO: 12752 - protein, 7 aa, Artificial Sequence
  Synthetic construct
YWILGQF

SEQ ID NO: 12753 - protein, 7 aa, Artificial Sequence
  Synthetic construct
YWILGQY

SEQ ID NO: 12754 - protein, 7 aa, Artificial Sequence
  Synthetic construct
YWILGDF

SEQ ID NO: 12755 - protein, 7 aa, Artificial Sequence
  Synthetic construct
YWILGDY

SEQ ID NO: 12756 - protein, 7 aa, Artificial Sequence
  Synthetic construct
YWILGVF

SEQ ID NO: 12757 - protein, 7 aa, Artificial Sequence
  Synthetic construct
YWILGVY

SEQ ID NO: 12758 - protein, 7 aa, Artificial Sequence
  Synthetic construct
YWILAFF

SEQ ID NO: 12759 - protein, 7 aa, Artificial Sequence
  Synthetic construct
YWILAFY

SEQ ID NO: 12760 - protein, 7 aa, Artificial Sequence
  Synthetic construct
YWILARF

SEQ ID NO: 12761 - protein, 7 aa, Artificial Sequence
  Synthetic construct
YWILARY

SEQ ID NO: 12762 - protein, 7 aa, Artificial Sequence
  Synthetic construct
YWILACF

SEQ ID NO: 12763 - protein, 7 aa, Artificial Sequence
  Synthetic construct
YWILACY

SEQ ID NO: 12764 - protein, 7 aa, Artificial Sequence
  Synthetic construct
YWILALF

SEQ ID NO: 12765 - protein, 7 aa, Artificial Sequence
  Synthetic construct
YWILALY

SEQ ID NO: 12766 - protein, 7 aa, Artificial Sequence
  Synthetic construct
YWILAAF

SEQ ID NO: 12767 - protein, 7 aa, Artificial Sequence
  Synthetic construct
YWILAAY

SEQ ID NO: 12768 - protein, 7 aa, Artificial Sequence
  Synthetic construct
YWILAQF

SEQ ID NO: 12769 - protein, 7 aa, Artificial Sequence
  Synthetic construct
YWILAQY

SEQ ID NO: 12770 - protein, 7 aa, Artificial Sequence
  Synthetic construct
YWILADF

SEQ ID NO: 12771 - protein, 7 aa, Artificial Sequence
  Synthetic construct
YWILADY

SEQ ID NO: 12772 - protein, 7 aa, Artificial Sequence
  Synthetic construct
YWILAVF

SEQ ID NO: 12773 - protein, 7 aa, Artificial Sequence
  Synthetic construct
YWILAVY

SEQ ID NO: 12774 - protein, 7 aa, Artificial Sequence
  Synthetic construct
YWILQFF

SEQ ID NO: 12775 - protein, 7 aa, Artificial Sequence
  Synthetic construct
YWILQFY

SEQ ID NO: 12776 - protein, 7 aa, Artificial Sequence
  Synthetic construct
YWILQRF

SEQ ID NO: 12777 - protein, 7 aa, Artificial Sequence
  Synthetic construct
YWILQRY

SEQ ID NO: 12778 - protein, 7 aa, Artificial Sequence
  Synthetic construct
YWILQCF

SEQ ID NO: 12779 - protein, 7 aa, Artificial Sequence
  Synthetic construct
YWILQCY

SEQ ID NO: 12780 - protein, 7 aa, Artificial Sequence
  Synthetic construct
YWILQLF

SEQ ID NO: 12781 - protein, 7 aa, Artificial Sequence
  Synthetic construct
YWILQLY

SEQ ID NO: 12782 - protein, 7 aa, Artificial Sequence
  Synthetic construct
YWILQAF

SEQ ID NO: 12783 - protein, 7 aa, Artificial Sequence
  Synthetic construct
YWILQAY

SEQ ID NO: 12784 - protein, 7 aa, Artificial Sequence
  Synthetic construct
YWILQQF

SEQ ID NO: 12785 - protein, 7 aa, Artificial Sequence
  Synthetic construct
YWILQQY

SEQ ID NO: 12786 - protein, 7 aa, Artificial Sequence
  Synthetic construct
YWILQDF

SEQ ID NO: 12787 - protein, 7 aa, Artificial Sequence
  Synthetic construct
YWILQDY

SEQ ID NO: 12788 - protein, 7 aa, Artificial Sequence
  Synthetic construct
YWILQVF

SEQ ID NO: 12789 - protein, 7 aa, Artificial Sequence
  Synthetic construct
YWILQVY

SEQ ID NO: 12790 - protein, 7 aa, Artificial Sequence
  Synthetic construct
YWIFIFF

SEQ ID NO: 12791 - protein, 7 aa, Artificial Sequence
  Synthetic construct
YWIFIFY

SEQ ID NO: 12792 - protein, 7 aa, Artificial Sequence
  Synthetic construct
YWIFIRF

SEQ ID NO: 12793 - protein, 7 aa, Artificial Sequence
  Synthetic construct
YWIFIRY

SEQ ID NO: 12794 - protein, 7 aa, Artificial Sequence
  Synthetic construct
YWIFICF

SEQ ID NO: 12795 - protein, 7 aa, Artificial Sequence
  Synthetic construct
YWIFICY

SEQ ID NO: 12796 - protein, 7 aa, Artificial Sequence
  Synthetic construct
YWIFILF

SEQ ID NO: 12797 - protein, 7 aa, Artificial Sequence
  Synthetic construct
YWIFILY

SEQ ID NO: 12798 - protein, 7 aa, Artificial Sequence
  Synthetic construct
YWIFIAF

SEQ ID NO: 12799 - protein, 7 aa, Artificial Sequence
  Synthetic construct
YWIFIAY

SEQ ID NO: 12800 - protein, 7 aa, Artificial Sequence
  Synthetic construct
YWIFIQF

SEQ ID NO: 12801 - protein, 7 aa, Artificial Sequence
  Synthetic construct
YWIFIQY

SEQ ID NO: 12802 - protein, 7 aa, Artificial Sequence
  Synthetic construct
YWIFIDF

SEQ ID NO: 12803 - protein, 7 aa, Artificial Sequence
  Synthetic construct
YWIFIDY

SEQ ID NO: 12804 - protein, 7 aa, Artificial Sequence
  Synthetic construct
YWIFIVF

SEQ ID NO: 12805 - protein, 7 aa, Artificial Sequence
  Synthetic construct
YWIFIVY

SEQ ID NO: 12806 - protein, 7 aa, Artificial Sequence
  Synthetic construct
YWIFDFF

SEQ ID NO: 12807 - protein, 7 aa, Artificial Sequence
  Synthetic construct
YWIFDFY

SEQ ID NO: 12808 - protein, 7 aa, Artificial Sequence
  Synthetic construct
YWIFDRF

SEQ ID NO: 12809 - protein, 7 aa, Artificial Sequence
  Synthetic construct
YWIFDRY

SEQ ID NO: 12810 - protein, 7 aa, Artificial Sequence
  Synthetic construct
YWIFDCF

SEQ ID NO: 12811 - protein, 7 aa, Artificial Sequence
  Synthetic construct
YWIFDCY

SEQ ID NO: 12812 - protein, 7 aa, Artificial Sequence
  Synthetic construct
YWIFDLF

SEQ ID NO: 12813 - protein, 7 aa, Artificial Sequence
  Synthetic construct
YWIFDLY

SEQ ID NO: 12814 - protein, 7 aa, Artificial Sequence
  Synthetic construct
YWIFDAF

SEQ ID NO: 12815 - protein, 7 aa, Artificial Sequence
  Synthetic construct
YWIFDAY

SEQ ID NO: 12816 - protein, 7 aa, Artificial Sequence
  Synthetic construct
YWIFDQF

SEQ ID NO: 12817 - protein, 7 aa, Artificial Sequence
  Synthetic construct
YWIFDQY

SEQ ID NO: 12818 - protein, 7 aa, Artificial Sequence
  Synthetic construct
YWIFDDF

SEQ ID NO: 12819 - protein, 7 aa, Artificial Sequence
  Synthetic construct
YWIFDDY

SEQ ID NO: 12820 - protein, 7 aa, Artificial Sequence
  Synthetic construct
YWIFDVF

SEQ ID NO: 12821 - protein, 7 aa, Artificial Sequence
  Synthetic construct
YWIFDVY

SEQ ID NO: 12822 - protein, 7 aa, Artificial Sequence
  Synthetic construct
YWIFYFF

SEQ ID NO: 12823 - protein, 7 aa, Artificial Sequence
  Synthetic construct
YWIFYFY

SEQ ID NO: 12824 - protein, 7 aa, Artificial Sequence
  Synthetic construct
YWIFYRF

SEQ ID NO: 12825 - protein, 7 aa, Artificial Sequence
  Synthetic construct
YWIFYRY

SEQ ID NO: 12826 - protein, 7 aa, Artificial Sequence
  Synthetic construct
YWIFYCF

SEQ ID NO: 12827 - protein, 7 aa, Artificial Sequence
  Synthetic construct
YWIFYCY

SEQ ID NO: 12828 - protein, 7 aa, Artificial Sequence
  Synthetic construct
YWIFYLF

SEQ ID NO: 12829 - protein, 7 aa, Artificial Sequence
  Synthetic construct
YWIFYLY

SEQ ID NO: 12830 - protein, 7 aa, Artificial Sequence
  Synthetic construct
YWIFYAF

SEQ ID NO: 12831 - protein, 7 aa, Artificial Sequence
  Synthetic construct
YWIFYAY

SEQ ID NO: 12832 - protein, 7 aa, Artificial Sequence
  Synthetic construct
YWIFYQF

SEQ ID NO: 12833 - protein, 7 aa, Artificial Sequence
  Synthetic construct
YWIFYQY

SEQ ID NO: 12834 - protein, 7 aa, Artificial Sequence
  Synthetic construct
YWIFYDF

SEQ ID NO: 12835 - protein, 7 aa, Artificial Sequence
  Synthetic construct
YWIFYDY

SEQ ID NO: 12836 - protein, 7 aa, Artificial Sequence
  Synthetic construct
YWIFYVF

SEQ ID NO: 12837 - protein, 7 aa, Artificial Sequence
  Synthetic construct
YWIFYVY

SEQ ID NO: 12838 - protein, 7 aa, Artificial Sequence
  Synthetic construct
YWIFFFF

SEQ ID NO: 12839 - protein, 7 aa, Artificial Sequence
  Synthetic construct
YWIFFFY

SEQ ID NO: 12840 - protein, 7 aa, Artificial Sequence
  Synthetic construct
YWIFFRF

SEQ ID NO: 12841 - protein, 7 aa, Artificial Sequence
  Synthetic construct
YWIFFRY

SEQ ID NO: 12842 - protein, 7 aa, Artificial Sequence
  Synthetic construct
YWIFFCF

SEQ ID NO: 12843 - protein, 7 aa, Artificial Sequence
  Synthetic construct
YWIFFCY

SEQ ID NO: 12844 - protein, 7 aa, Artificial Sequence
  Synthetic construct
YWIFFLF

SEQ ID NO: 12845 - protein, 7 aa, Artificial Sequence
  Synthetic construct
YWIFFLY

SEQ ID NO: 12846 - protein, 7 aa, Artificial Sequence
  Synthetic construct
YWIFFAF

SEQ ID NO: 12847 - protein, 7 aa, Artificial Sequence
  Synthetic construct
YWIFFAY

SEQ ID NO: 12848 - protein, 7 aa, Artificial Sequence
  Synthetic construct
YWIFFQF

SEQ ID NO: 12849 - protein, 7 aa, Artificial Sequence
  Synthetic construct
YWIFFQY

SEQ ID NO: 12850 - protein, 7 aa, Artificial Sequence
  Synthetic construct
YWIFFDF

SEQ ID NO: 12851 - protein, 7 aa, Artificial Sequence
  Synthetic construct
YWIFFDY

SEQ ID NO: 12852 - protein, 7 aa, Artificial Sequence
  Synthetic construct
YWIFFVF

SEQ ID NO: 12853 - protein, 7 aa, Artificial Sequence
  Synthetic construct
YWIFFVY

SEQ ID NO: 12854 - protein, 7 aa, Artificial Sequence
  Synthetic construct
YWIFVFF

SEQ ID NO: 12855 - protein, 7 aa, Artificial Sequence
  Synthetic construct
YWIFVFY

SEQ ID NO: 12856 - protein, 7 aa, Artificial Sequence
  Synthetic construct
YWIFVRF

SEQ ID NO: 12857 - protein, 7 aa, Artificial Sequence
  Synthetic construct
YWIFVRY

SEQ ID NO: 12858 - protein, 7 aa, Artificial Sequence
  Synthetic construct
YWIFVCF

SEQ ID NO: 12859 - protein, 7 aa, Artificial Sequence
  Synthetic construct
YWIFVCY

SEQ ID NO: 12860 - protein, 7 aa, Artificial Sequence
  Synthetic construct
YWIFVLF

SEQ ID NO: 12861 - protein, 7 aa, Artificial Sequence
  Synthetic construct
YWIFVLY

SEQ ID NO: 12862 - protein, 7 aa, Artificial Sequence
  Synthetic construct
YWIFVAF

SEQ ID NO: 12863 - protein, 7 aa, Artificial Sequence
  Synthetic construct
YWIFVAY

SEQ ID NO: 12864 - protein, 7 aa, Artificial Sequence
  Synthetic construct
YWIFVQF

SEQ ID NO: 12865 - protein, 7 aa, Artificial Sequence
  Synthetic construct
YWIFVQY

SEQ ID NO: 12866 - protein, 7 aa, Artificial Sequence
  Synthetic construct
YWIFVDF

SEQ ID NO: 12867 - protein, 7 aa, Artificial Sequence
  Synthetic construct
YWIFVDY

SEQ ID NO: 12868 - protein, 7 aa, Artificial Sequence
  Synthetic construct
YWIFVVF

SEQ ID NO: 12869 - protein, 7 aa, Artificial Sequence
  Synthetic construct
YWIFVVY

SEQ ID NO: 12870 - protein, 7 aa, Artificial Sequence
  Synthetic construct
YWIFTFF

SEQ ID NO: 12871 - protein, 7 aa, Artificial Sequence
  Synthetic construct
YWIFTFY

SEQ ID NO: 12872 - protein, 7 aa, Artificial Sequence
  Synthetic construct
YWIFTRF

SEQ ID NO: 12873 - protein, 7 aa, Artificial Sequence
  Synthetic construct
YWIFTRY

SEQ ID NO: 12874 - protein, 7 aa, Artificial Sequence
  Synthetic construct
YWIFTCF

SEQ ID NO: 12875 - protein, 7 aa, Artificial Sequence
  Synthetic construct
YWIFTCY

SEQ ID NO: 12876 - protein, 7 aa, Artificial Sequence
  Synthetic construct
YWIFTLF

SEQ ID NO: 12877 - protein, 7 aa, Artificial Sequence
  Synthetic construct
YWIFTLY

SEQ ID NO: 12878 - protein, 7 aa, Artificial Sequence
  Synthetic construct
YWIFTAF

SEQ ID NO: 12879 - protein, 7 aa, Artificial Sequence
  Synthetic construct
YWIFTAY

SEQ ID NO: 12880 - protein, 7 aa, Artificial Sequence
  Synthetic construct
YWIFTQF

SEQ ID NO: 12881 - protein, 7 aa, Artificial Sequence
  Synthetic construct
YWIFTQY

SEQ ID NO: 12882 - protein, 7 aa, Artificial Sequence
  Synthetic construct
YWIFTDF

SEQ ID NO: 12883 - protein, 7 aa, Artificial Sequence
  Synthetic construct
YWIFTDY

SEQ ID NO: 12884 - protein, 7 aa, Artificial Sequence
  Synthetic construct
YWIFTVF

SEQ ID NO: 12885 - protein, 7 aa, Artificial Sequence
  Synthetic construct
YWIFTVY

SEQ ID NO: 12886 - protein, 7 aa, Artificial Sequence
  Synthetic construct
YWIFGFF

SEQ ID NO: 12887 - protein, 7 aa, Artificial Sequence
  Synthetic construct
YWIFGFY

SEQ ID NO: 12888 - protein, 7 aa, Artificial Sequence
  Synthetic construct
YWIFGRF

SEQ ID NO: 12889 - protein, 7 aa, Artificial Sequence
  Synthetic construct
YWIFGRY

SEQ ID NO: 12890 - protein, 7 aa, Artificial Sequence
  Synthetic construct
YWIFGCF

SEQ ID NO: 12891 - protein, 7 aa, Artificial Sequence
  Synthetic construct
YWIFGCY

SEQ ID NO: 12892 - protein, 7 aa, Artificial Sequence
  Synthetic construct
YWIFGLF

SEQ ID NO: 12893 - protein, 7 aa, Artificial Sequence
  Synthetic construct
YWIFGLY

SEQ ID NO: 12894 - protein, 7 aa, Artificial Sequence
  Synthetic construct
YWIFGAF

SEQ ID NO: 12895 - protein, 7 aa, Artificial Sequence
  Synthetic construct
YWIFGAY

SEQ ID NO: 12896 - protein, 7 aa, Artificial Sequence
  Synthetic construct
YWIFGQF

SEQ ID NO: 12897 - protein, 7 aa, Artificial Sequence
  Synthetic construct
YWIFGQY

SEQ ID NO: 12898 - protein, 7 aa, Artificial Sequence
  Synthetic construct
YWIFGDF

SEQ ID NO: 12899 - protein, 7 aa, Artificial Sequence
  Synthetic construct
YWIFGDY

SEQ ID NO: 12900 - protein, 7 aa, Artificial Sequence
  Synthetic construct
YWIFGVF

SEQ ID NO: 12901 - protein, 7 aa, Artificial Sequence
  Synthetic construct
YWIFGVY

SEQ ID NO: 12902 - protein, 7 aa, Artificial Sequence
  Synthetic construct
YWIFAFF

SEQ ID NO: 12903 - protein, 7 aa, Artificial Sequence
  Synthetic construct
YWIFAFY

SEQ ID NO: 12904 - protein, 7 aa, Artificial Sequence
  Synthetic construct
YWIFARF

SEQ ID NO: 12905 - protein, 7 aa, Artificial Sequence
  Synthetic construct
YWIFARY

SEQ ID NO: 12906 - protein, 7 aa, Artificial Sequence
  Synthetic construct
YWIFACF

SEQ ID NO: 12907 - protein, 7 aa, Artificial Sequence
  Synthetic construct
YWIFACY

SEQ ID NO: 12908 - protein, 7 aa, Artificial Sequence
  Synthetic construct
YWIFALF

SEQ ID NO: 12909 - protein, 7 aa, Artificial Sequence
  Synthetic construct
YWIFALY

SEQ ID NO: 12910 - protein, 7 aa, Artificial Sequence
  Synthetic construct
YWIFAAF

SEQ ID NO: 12911 - protein, 7 aa, Artificial Sequence
  Synthetic construct
YWIFAAY

SEQ ID NO: 12912 - protein, 7 aa, Artificial Sequence
  Synthetic construct
YWIFAQF

SEQ ID NO: 12913 - protein, 7 aa, Artificial Sequence
  Synthetic construct
YWIFAQY

SEQ ID NO: 12914 - protein, 7 aa, Artificial Sequence
  Synthetic construct
YWIFADF

SEQ ID NO: 12915 - protein, 7 aa, Artificial Sequence
  Synthetic construct
YWIFADY

SEQ ID NO: 12916 - protein, 7 aa, Artificial Sequence
  Synthetic construct
YWIFAVF

SEQ ID NO: 12917 - protein, 7 aa, Artificial Sequence
  Synthetic construct
YWIFAVY

SEQ ID NO: 12918 - protein, 7 aa, Artificial Sequence
  Synthetic construct
YWIFQFF

SEQ ID NO: 12919 - protein, 7 aa, Artificial Sequence
  Synthetic construct
YWIFQFY

SEQ ID NO: 12920 - protein, 7 aa, Artificial Sequence
  Synthetic construct
YWIFQRF

SEQ ID NO: 12921 - protein, 7 aa, Artificial Sequence
  Synthetic construct
YWIFQRY

SEQ ID NO: 12922 - protein, 7 aa, Artificial Sequence
  Synthetic construct
YWIFQCF

SEQ ID NO: 12923 - protein, 7 aa, Artificial Sequence
  Synthetic construct
YWIFQCY

SEQ ID NO: 12924 - protein, 7 aa, Artificial Sequence
  Synthetic construct
YWIFQLF

SEQ ID NO: 12925 - protein, 7 aa, Artificial Sequence
  Synthetic construct
YWIFQLY

SEQ ID NO: 12926 - protein, 7 aa, Artificial Sequence
  Synthetic construct
YWIFQAF

SEQ ID NO: 12927 - protein, 7 aa, Artificial Sequence
  Synthetic construct
YWIFQAY

SEQ ID NO: 12928 - protein, 7 aa, Artificial Sequence
  Synthetic construct
YWIFQQF

SEQ ID NO: 12929 - protein, 7 aa, Artificial Sequence
  Synthetic construct
YWIFQQY

SEQ ID NO: 12930 - protein, 7 aa, Artificial Sequence
  Synthetic construct
YWIFQDF

SEQ ID NO: 12931 - protein, 7 aa, Artificial Sequence
  Synthetic construct
YWIFQDY

SEQ ID NO: 12932 - protein, 7 aa, Artificial Sequence
  Synthetic construct
YWIFQVF

SEQ ID NO: 12933 - protein, 7 aa, Artificial Sequence
  Synthetic construct
YWIFQVY

SEQ ID NO: 12934 - protein, 7 aa, Artificial Sequence
  Synthetic construct
YWGYIFF

SEQ ID NO: 12935 - protein, 7 aa, Artificial Sequence
  Synthetic construct
YWGYIFY

SEQ ID NO: 12936 - protein, 7 aa, Artificial Sequence
  Synthetic construct
YWGYIRF

SEQ ID NO: 12937 - protein, 7 aa, Artificial Sequence
  Synthetic construct
YWGYIRY

SEQ ID NO: 12938 - protein, 7 aa, Artificial Sequence
  Synthetic construct
YWGYICF

SEQ ID NO: 12939 - protein, 7 aa, Artificial Sequence
  Synthetic construct
YWGYICY

SEQ ID NO: 12940 - protein, 7 aa, Artificial Sequence
  Synthetic construct
YWGYILF

SEQ ID NO: 12941 - protein, 7 aa, Artificial Sequence
  Synthetic construct
YWGYILY

SEQ ID NO: 12942 - protein, 7 aa, Artificial Sequence
  Synthetic construct
YWGYIAF

SEQ ID NO: 12943 - protein, 7 aa, Artificial Sequence
  Synthetic construct
YWGYIAY

SEQ ID NO: 12944 - protein, 7 aa, Artificial Sequence
  Synthetic construct
YWGYIQF

SEQ ID NO: 12945 - protein, 7 aa, Artificial Sequence
  Synthetic construct
YWGYIQY

SEQ ID NO: 12946 - protein, 7 aa, Artificial Sequence
  Synthetic construct
YWGYIDF

SEQ ID NO: 12947 - protein, 7 aa, Artificial Sequence
  Synthetic construct
YWGYIDY

SEQ ID NO: 12948 - protein, 7 aa, Artificial Sequence
  Synthetic construct
YWGYIVF

SEQ ID NO: 12949 - protein, 7 aa, Artificial Sequence
  Synthetic construct
YWGYIVY

SEQ ID NO: 12950 - protein, 7 aa, Artificial Sequence
  Synthetic construct
YWGYDFF

SEQ ID NO: 12951 - protein, 7 aa, Artificial Sequence
  Synthetic construct
YWGYDFY

SEQ ID NO: 12952 - protein, 7 aa, Artificial Sequence
  Synthetic construct
YWGYDRF

SEQ ID NO: 12953 - protein, 7 aa, Artificial Sequence
  Synthetic construct
YWGYDRY

SEQ ID NO: 12954 - protein, 7 aa, Artificial Sequence
  Synthetic construct
YWGYDCF

SEQ ID NO: 12955 - protein, 7 aa, Artificial Sequence
  Synthetic construct
YWGYDCY

SEQ ID NO: 12956 - protein, 7 aa, Artificial Sequence
  Synthetic construct
YWGYDLF

SEQ ID NO: 12957 - protein, 7 aa, Artificial Sequence
  Synthetic construct
YWGYDLY

SEQ ID NO: 12958 - protein, 7 aa, Artificial Sequence
  Synthetic construct
YWGYDAF

SEQ ID NO: 12959 - protein, 7 aa, Artificial Sequence
  Synthetic construct
YWGYDAY

SEQ ID NO: 12960 - protein, 7 aa, Artificial Sequence
  Synthetic construct
YWGYDQF

SEQ ID NO: 12961 - protein, 7 aa, Artificial Sequence
  Synthetic construct
YWGYDQY

SEQ ID NO: 12962 - protein, 7 aa, Artificial Sequence
  Synthetic construct
YWGYDDF

SEQ ID NO: 12963 - protein, 7 aa, Artificial Sequence
  Synthetic construct
YWGYDDY

SEQ ID NO: 12964 - protein, 7 aa, Artificial Sequence
  Synthetic construct
YWGYDVF

SEQ ID NO: 12965 - protein, 7 aa, Artificial Sequence
  Synthetic construct
YWGYDVY

SEQ ID NO: 12966 - protein, 7 aa, Artificial Sequence
  Synthetic construct
YWGYYFF

SEQ ID NO: 12967 - protein, 7 aa, Artificial Sequence
  Synthetic construct
YWGYYFY

SEQ ID NO: 12968 - protein, 7 aa, Artificial Sequence
  Synthetic construct
YWGYYRF

SEQ ID NO: 12969 - protein, 7 aa, Artificial Sequence
  Synthetic construct
YWGYYRY

SEQ ID NO: 12970 - protein, 7 aa, Artificial Sequence
  Synthetic construct
YWGYYCF

SEQ ID NO: 12971 - protein, 7 aa, Artificial Sequence
  Synthetic construct
YWGYYCY

SEQ ID NO: 12972 - protein, 7 aa, Artificial Sequence
  Synthetic construct
YWGYYLF

SEQ ID NO: 12973 - protein, 7 aa, Artificial Sequence
  Synthetic construct
YWGYYLY

SEQ ID NO: 12974 - protein, 7 aa, Artificial Sequence
  Synthetic construct
YWGYYAF

SEQ ID NO: 12975 - protein, 7 aa, Artificial Sequence
  Synthetic construct
YWGYYAY

SEQ ID NO: 12976 - protein, 7 aa, Artificial Sequence
  Synthetic construct
YWGYYQF

SEQ ID NO: 12977 - protein, 7 aa, Artificial Sequence
  Synthetic construct
YWGYYQY

SEQ ID NO: 12978 - protein, 7 aa, Artificial Sequence
  Synthetic construct
YWGYYDF

SEQ ID NO: 12979 - protein, 7 aa, Artificial Sequence
  Synthetic construct
YWGYYDY

SEQ ID NO: 12980 - protein, 7 aa, Artificial Sequence
  Synthetic construct
YWGYYVF

SEQ ID NO: 12981 - protein, 7 aa, Artificial Sequence
  Synthetic construct
YWGYYVY

SEQ ID NO: 12982 - protein, 7 aa, Artificial Sequence
  Synthetic construct
YWGYFFF

SEQ ID NO: 12983 - protein, 7 aa, Artificial Sequence
  Synthetic construct
YWGYFFY

SEQ ID NO: 12984 - protein, 7 aa, Artificial Sequence
  Synthetic construct
YWGYFRF

SEQ ID NO: 12985 - protein, 7 aa, Artificial Sequence
  Synthetic construct
YWGYFRY

SEQ ID NO: 12986 - protein, 7 aa, Artificial Sequence
  Synthetic construct
YWGYFCF

SEQ ID NO: 12987 - protein, 7 aa, Artificial Sequence
  Synthetic construct
YWGYFCY

SEQ ID NO: 12988 - protein, 7 aa, Artificial Sequence
  Synthetic construct
YWGYFLF

SEQ ID NO: 12989 - protein, 7 aa, Artificial Sequence
  Synthetic construct
YWGYFLY

SEQ ID NO: 12990 - protein, 7 aa, Artificial Sequence
  Synthetic construct
YWGYFAF

SEQ ID NO: 12991 - protein, 7 aa, Artificial Sequence
  Synthetic construct
YWGYFAY

SEQ ID NO: 12992 - protein, 7 aa, Artificial Sequence
  Synthetic construct
YWGYFQF

SEQ ID NO: 12993 - protein, 7 aa, Artificial Sequence
  Synthetic construct
YWGYFQY

SEQ ID NO: 12994 - protein, 7 aa, Artificial Sequence
  Synthetic construct
YWGYFDF

SEQ ID NO: 12995 - protein, 7 aa, Artificial Sequence
  Synthetic construct
YWGYFDY

SEQ ID NO: 12996 - protein, 7 aa, Artificial Sequence
  Synthetic construct
YWGYFVF

SEQ ID NO: 12997 - protein, 7 aa, Artificial Sequence
  Synthetic construct
YWGYFVY

SEQ ID NO: 12998 - protein, 7 aa, Artificial Sequence
  Synthetic construct
YWGYVFF

SEQ ID NO: 12999 - protein, 7 aa, Artificial Sequence
  Synthetic construct
YWGYVFY

SEQ ID NO: 13000 - protein, 7 aa, Artificial Sequence
  Synthetic construct
YWGYVRF

SEQ ID NO: 13001 - protein, 7 aa, Artificial Sequence
  Synthetic construct
YWGYVRY

SEQ ID NO: 13002 - protein, 7 aa, Artificial Sequence
  Synthetic construct
YWGYVCF

SEQ ID NO: 13003 - protein, 7 aa, Artificial Sequence
  Synthetic construct
YWGYVCY

SEQ ID NO: 13004 - protein, 7 aa, Artificial Sequence
  Synthetic construct
YWGYVLF

SEQ ID NO: 13005 - protein, 7 aa, Artificial Sequence
  Synthetic construct
YWGYVLY

SEQ ID NO: 13006 - protein, 7 aa, Artificial Sequence
  Synthetic construct
YWGYVAF

SEQ ID NO: 13007 - protein, 7 aa, Artificial Sequence
  Synthetic construct
YWGYVAY

SEQ ID NO: 13008 - protein, 7 aa, Artificial Sequence
  Synthetic construct
YWGYVQF

SEQ ID NO: 13009 - protein, 7 aa, Artificial Sequence
  Synthetic construct
YWGYVQY

SEQ ID NO: 13010 - protein, 7 aa, Artificial Sequence
  Synthetic construct
YWGYVDF

SEQ ID NO: 13011 - protein, 7 aa, Artificial Sequence
  Synthetic construct
YWGYVDY

SEQ ID NO: 13012 - protein, 7 aa, Artificial Sequence
  Synthetic construct
YWGYVVF

SEQ ID NO: 13013 - protein, 7 aa, Artificial Sequence
  Synthetic construct
YWGYVVY

SEQ ID NO: 13014 - protein, 7 aa, Artificial Sequence
  Synthetic construct
YWGYTFF

SEQ ID NO: 13015 - protein, 7 aa, Artificial Sequence
  Synthetic construct
YWGYTFY

SEQ ID NO: 13016 - protein, 7 aa, Artificial Sequence
  Synthetic construct
YWGYTRF

SEQ ID NO: 13017 - protein, 7 aa, Artificial Sequence
  Synthetic construct
YWGYTRY

SEQ ID NO: 13018 - protein, 7 aa, Artificial Sequence
  Synthetic construct
YWGYTCF

SEQ ID NO: 13019 - protein, 7 aa, Artificial Sequence
  Synthetic construct
YWGYTCY

SEQ ID NO: 13020 - protein, 7 aa, Artificial Sequence
  Synthetic construct
YWGYTLF

SEQ ID NO: 13021 - protein, 7 aa, Artificial Sequence
  Synthetic construct
YWGYTLY

SEQ ID NO: 13022 - protein, 7 aa, Artificial Sequence
  Synthetic construct
YWGYTAF

SEQ ID NO: 13023 - protein, 7 aa, Artificial Sequence
  Synthetic construct
YWGYTAY

SEQ ID NO: 13024 - protein, 7 aa, Artificial Sequence
  Synthetic construct
YWGYTQF

SEQ ID NO: 13025 - protein, 7 aa, Artificial Sequence
  Synthetic construct
YWGYTQY

SEQ ID NO: 13026 - protein, 7 aa, Artificial Sequence
  Synthetic construct
YWGYTDF

SEQ ID NO: 13027 - protein, 7 aa, Artificial Sequence
  Synthetic construct
YWGYTDY

SEQ ID NO: 13028 - protein, 7 aa, Artificial Sequence
  Synthetic construct
YWGYTVF

SEQ ID NO: 13029 - protein, 7 aa, Artificial Sequence
  Synthetic construct
YWGYTVY

SEQ ID NO: 13030 - protein, 7 aa, Artificial Sequence
  Synthetic construct
YWGYGFF

SEQ ID NO: 13031 - protein, 7 aa, Artificial Sequence
  Synthetic construct
YWGYGFY

SEQ ID NO: 13032 - protein, 7 aa, Artificial Sequence
  Synthetic construct
YWGYGRF

SEQ ID NO: 13033 - protein, 7 aa, Artificial Sequence
  Synthetic construct
YWGYGRY

SEQ ID NO: 13034 - protein, 7 aa, Artificial Sequence
  Synthetic construct
YWGYGCF

SEQ ID NO: 13035 - protein, 7 aa, Artificial Sequence
  Synthetic construct
YWGYGCY

SEQ ID NO: 13036 - protein, 7 aa, Artificial Sequence
  Synthetic construct
YWGYGLF

SEQ ID NO: 13037 - protein, 7 aa, Artificial Sequence
  Synthetic construct
YWGYGLY

SEQ ID NO: 13038 - protein, 7 aa, Artificial Sequence
  Synthetic construct
YWGYGAF

SEQ ID NO: 13039 - protein, 7 aa, Artificial Sequence
  Synthetic construct
YWGYGAY

SEQ ID NO: 13040 - protein, 7 aa, Artificial Sequence
  Synthetic construct
YWGYGQF

SEQ ID NO: 13041 - protein, 7 aa, Artificial Sequence
  Synthetic construct
YWGYGQY

SEQ ID NO: 13042 - protein, 7 aa, Artificial Sequence
  Synthetic construct
YWGYGDF

SEQ ID NO: 13043 - protein, 7 aa, Artificial Sequence
  Synthetic construct
YWGYGDY

SEQ ID NO: 13044 - protein, 7 aa, Artificial Sequence
  Synthetic construct
YWGYGVF

SEQ ID NO: 13045 - protein, 7 aa, Artificial Sequence
  Synthetic construct
YWGYGVY

SEQ ID NO: 13046 - protein, 7 aa, Artificial Sequence
  Synthetic construct
YWGYAFF

SEQ ID NO: 13047 - protein, 7 aa, Artificial Sequence
  Synthetic construct
YWGYAFY

SEQ ID NO: 13048 - protein, 7 aa, Artificial Sequence
  Synthetic construct
YWGYARF

SEQ ID NO: 13049 - protein, 7 aa, Artificial Sequence
  Synthetic construct
YWGYARY

SEQ ID NO: 13050 - protein, 7 aa, Artificial Sequence
  Synthetic construct
YWGYACF

SEQ ID NO: 13051 - protein, 7 aa, Artificial Sequence
  Synthetic construct
YWGYACY

SEQ ID NO: 13052 - protein, 7 aa, Artificial Sequence
  Synthetic construct
YWGYALF

SEQ ID NO: 13053 - protein, 7 aa, Artificial Sequence
  Synthetic construct
YWGYALY

SEQ ID NO: 13054 - protein, 7 aa, Artificial Sequence
  Synthetic construct
YWGYAAF

SEQ ID NO: 13055 - protein, 7 aa, Artificial Sequence
  Synthetic construct
YWGYAAY

SEQ ID NO: 13056 - protein, 7 aa, Artificial Sequence
  Synthetic construct
YWGYAQF

SEQ ID NO: 13057 - protein, 7 aa, Artificial Sequence
  Synthetic construct
YWGYAQY

SEQ ID NO: 13058 - protein, 7 aa, Artificial Sequence
  Synthetic construct
YWGYADF

SEQ ID NO: 13059 - protein, 7 aa, Artificial Sequence
  Synthetic construct
YWGYADY

SEQ ID NO: 13060 - protein, 7 aa, Artificial Sequence
  Synthetic construct
YWGYAVF

SEQ ID NO: 13061 - protein, 7 aa, Artificial Sequence
  Synthetic construct
YWGYAVY

SEQ ID NO: 13062 - protein, 7 aa, Artificial Sequence
  Synthetic construct
YWGYQFF

SEQ ID NO: 13063 - protein, 7 aa, Artificial Sequence
  Synthetic construct
YWGYQFY

SEQ ID NO: 13064 - protein, 7 aa, Artificial Sequence
  Synthetic construct
YWGYQRF

SEQ ID NO: 13065 - protein, 7 aa, Artificial Sequence
  Synthetic construct
YWGYQRY

SEQ ID NO: 13066 - protein, 7 aa, Artificial Sequence
  Synthetic construct
YWGYQCF

SEQ ID NO: 13067 - protein, 7 aa, Artificial Sequence
  Synthetic construct
YWGYQCY

SEQ ID NO: 13068 - protein, 7 aa, Artificial Sequence
  Synthetic construct
YWGYQLF

SEQ ID NO: 13069 - protein, 7 aa, Artificial Sequence
  Synthetic construct
YWGYQLY

SEQ ID NO: 13070 - protein, 7 aa, Artificial Sequence
  Synthetic construct
YWGYQAF

SEQ ID NO: 13071 - protein, 7 aa, Artificial Sequence
  Synthetic construct
YWGYQAY

SEQ ID NO: 13072 - protein, 7 aa, Artificial Sequence
  Synthetic construct
YWGYQQF

SEQ ID NO: 13073 - protein, 7 aa, Artificial Sequence
  Synthetic construct
YWGYQQY

SEQ ID NO: 13074 - protein, 7 aa, Artificial Sequence
  Synthetic construct
YWGYQDF

SEQ ID NO: 13075 - protein, 7 aa, Artificial Sequence
  Synthetic construct
YWGYQDY

SEQ ID NO: 13076 - protein, 7 aa, Artificial Sequence
  Synthetic construct
YWGYQVF

SEQ ID NO: 13077 - protein, 7 aa, Artificial Sequence
  Synthetic construct
YWGYQVY

SEQ ID NO: 13078 - protein, 7 aa, Artificial Sequence
  Synthetic construct
YWGPIFF

SEQ ID NO: 13079 - protein, 7 aa, Artificial Sequence
  Synthetic construct
YWGPIFY

SEQ ID NO: 13080 - protein, 7 aa, Artificial Sequence
  Synthetic construct
YWGPIRF

SEQ ID NO: 13081 - protein, 7 aa, Artificial Sequence
  Synthetic construct
YWGPIRY

SEQ ID NO: 13082 - protein, 7 aa, Artificial Sequence
  Synthetic construct
YWGPICF

SEQ ID NO: 13083 - protein, 7 aa, Artificial Sequence
  Synthetic construct
YWGPICY

SEQ ID NO: 13084 - protein, 7 aa, Artificial Sequence
  Synthetic construct
YWGPILF

SEQ ID NO: 13085 - protein, 7 aa, Artificial Sequence
  Synthetic construct
YWGPILY

SEQ ID NO: 13086 - protein, 7 aa, Artificial Sequence
  Synthetic construct
YWGPIAF

SEQ ID NO: 13087 - protein, 7 aa, Artificial Sequence
  Synthetic construct
YWGPIAY

SEQ ID NO: 13088 - protein, 7 aa, Artificial Sequence
  Synthetic construct
YWGPIQF

SEQ ID NO: 13089 - protein, 7 aa, Artificial Sequence
  Synthetic construct
YWGPIQY

SEQ ID NO: 13090 - protein, 7 aa, Artificial Sequence
  Synthetic construct
YWGPIDF

SEQ ID NO: 13091 - protein, 7 aa, Artificial Sequence
  Synthetic construct
YWGPIDY

SEQ ID NO: 13092 - protein, 7 aa, Artificial Sequence
  Synthetic construct
YWGPIVF

SEQ ID NO: 13093 - protein, 7 aa, Artificial Sequence
  Synthetic construct
YWGPIVY

SEQ ID NO: 13094 - protein, 7 aa, Artificial Sequence
  Synthetic construct
YWGPDFF

SEQ ID NO: 13095 - protein, 7 aa, Artificial Sequence
  Synthetic construct
YWGPDFY

SEQ ID NO: 13096 - protein, 7 aa, Artificial Sequence
  Synthetic construct
YWGPDRF

SEQ ID NO: 13097 - protein, 7 aa, Artificial Sequence
  Synthetic construct
YWGPDRY

SEQ ID NO: 13098 - protein, 7 aa, Artificial Sequence
  Synthetic construct
YWGPDCF

SEQ ID NO: 13099 - protein, 7 aa, Artificial Sequence
  Synthetic construct
YWGPDCY

SEQ ID NO: 13100 - protein, 7 aa, Artificial Sequence
  Synthetic construct
YWGPDLF

SEQ ID NO: 13101 - protein, 7 aa, Artificial Sequence
  Synthetic construct
YWGPDLY

SEQ ID NO: 13102 - protein, 7 aa, Artificial Sequence
  Synthetic construct
YWGPDAF

SEQ ID NO: 13103 - protein, 7 aa, Artificial Sequence
  Synthetic construct
YWGPDAY

SEQ ID NO: 13104 - protein, 7 aa, Artificial Sequence
  Synthetic construct
YWGPDQF

SEQ ID NO: 13105 - protein, 7 aa, Artificial Sequence
  Synthetic construct
YWGPDQY

SEQ ID NO: 13106 - protein, 7 aa, Artificial Sequence
  Synthetic construct
YWGPDDF

SEQ ID NO: 13107 - protein, 7 aa, Artificial Sequence
  Synthetic construct
YWGPDDY

SEQ ID NO: 13108 - protein, 7 aa, Artificial Sequence
  Synthetic construct
YWGPDVF

SEQ ID NO: 13109 - protein, 7 aa, Artificial Sequence
  Synthetic construct
YWGPDVY

SEQ ID NO: 13110 - protein, 7 aa, Artificial Sequence
  Synthetic construct
YWGPYFF

SEQ ID NO: 13111 - protein, 7 aa, Artificial Sequence
  Synthetic construct
YWGPYFY

SEQ ID NO: 13112 - protein, 7 aa, Artificial Sequence
  Synthetic construct
YWGPYRF

SEQ ID NO: 13113 - protein, 7 aa, Artificial Sequence
  Synthetic construct
YWGPYRY

SEQ ID NO: 13114 - protein, 7 aa, Artificial Sequence
  Synthetic construct
YWGPYCF

SEQ ID NO: 13115 - protein, 7 aa, Artificial Sequence
  Synthetic construct
YWGPYCY

SEQ ID NO: 13116 - protein, 7 aa, Artificial Sequence
  Synthetic construct
YWGPYLF

SEQ ID NO: 13117 - protein, 7 aa, Artificial Sequence
  Synthetic construct
YWGPYLY

SEQ ID NO: 13118 - protein, 7 aa, Artificial Sequence
  Synthetic construct
YWGPYAF

SEQ ID NO: 13119 - protein, 7 aa, Artificial Sequence
  Synthetic construct
YWGPYAY

SEQ ID NO: 13120 - protein, 7 aa, Artificial Sequence
  Synthetic construct
YWGPYQF

SEQ ID NO: 13121 - protein, 7 aa, Artificial Sequence
  Synthetic construct
YWGPYQY

SEQ ID NO: 13122 - protein, 7 aa, Artificial Sequence
  Synthetic construct
YWGPYDF

SEQ ID NO: 13123 - protein, 7 aa, Artificial Sequence
  Synthetic construct
YWGPYDY

SEQ ID NO: 13124 - protein, 7 aa, Artificial Sequence
  Synthetic construct
YWGPYVF

SEQ ID NO: 13125 - protein, 7 aa, Artificial Sequence
  Synthetic construct
YWGPYVY

SEQ ID NO: 13126 - protein, 7 aa, Artificial Sequence
  Synthetic construct
YWGPFFF

SEQ ID NO: 13127 - protein, 7 aa, Artificial Sequence
  Synthetic construct
YWGPFFY

SEQ ID NO: 13128 - protein, 7 aa, Artificial Sequence
  Synthetic construct
YWGPFRF

SEQ ID NO: 13129 - protein, 7 aa, Artificial Sequence
  Synthetic construct
YWGPFRY

SEQ ID NO: 13130 - protein, 7 aa, Artificial Sequence
  Synthetic construct
YWGPFCF

SEQ ID NO: 13131 - protein, 7 aa, Artificial Sequence
  Synthetic construct
YWGPFCY

SEQ ID NO: 13132 - protein, 7 aa, Artificial Sequence
  Synthetic construct
YWGPFLF

SEQ ID NO: 13133 - protein, 7 aa, Artificial Sequence
  Synthetic construct
YWGPFLY

SEQ ID NO: 13134 - protein, 7 aa, Artificial Sequence
  Synthetic construct
YWGPFAF

SEQ ID NO: 13135 - protein, 7 aa, Artificial Sequence
  Synthetic construct
YWGPFAY

SEQ ID NO: 13136 - protein, 7 aa, Artificial Sequence
  Synthetic construct
YWGPFQF

SEQ ID NO: 13137 - protein, 7 aa, Artificial Sequence
  Synthetic construct
YWGPFQY

SEQ ID NO: 13138 - protein, 7 aa, Artificial Sequence
  Synthetic construct
YWGPFDF

SEQ ID NO: 13139 - protein, 7 aa, Artificial Sequence
  Synthetic construct
YWGPFDY

SEQ ID NO: 13140 - protein, 7 aa, Artificial Sequence
  Synthetic construct
YWGPFVF

SEQ ID NO: 13141 - protein, 7 aa, Artificial Sequence
  Synthetic construct
YWGPFVY

SEQ ID NO: 13142 - protein, 7 aa, Artificial Sequence
  Synthetic construct
YWGPVFF

SEQ ID NO: 13143 - protein, 7 aa, Artificial Sequence
  Synthetic construct
YWGPVFY

SEQ ID NO: 13144 - protein, 7 aa, Artificial Sequence
  Synthetic construct
YWGPVRF

SEQ ID NO: 13145 - protein, 7 aa, Artificial Sequence
  Synthetic construct
YWGPVRY

SEQ ID NO: 13146 - protein, 7 aa, Artificial Sequence
  Synthetic construct
YWGPVCF

SEQ ID NO: 13147 - protein, 7 aa, Artificial Sequence
  Synthetic construct
YWGPVCY

SEQ ID NO: 13148 - protein, 7 aa, Artificial Sequence
  Synthetic construct
YWGPVLF

SEQ ID NO: 13149 - protein, 7 aa, Artificial Sequence
  Synthetic construct
YWGPVLY

SEQ ID NO: 13150 - protein, 7 aa, Artificial Sequence
  Synthetic construct
YWGPVAF

SEQ ID NO: 13151 - protein, 7 aa, Artificial Sequence
  Synthetic construct
YWGPVAY

SEQ ID NO: 13152 - protein, 7 aa, Artificial Sequence
  Synthetic construct
YWGPVQF

SEQ ID NO: 13153 - protein, 7 aa, Artificial Sequence
  Synthetic construct
YWGPVQY

SEQ ID NO: 13154 - protein, 7 aa, Artificial Sequence
  Synthetic construct
YWGPVDF

SEQ ID NO: 13155 - protein, 7 aa, Artificial Sequence
  Synthetic construct
YWGPVDY

SEQ ID NO: 13156 - protein, 7 aa, Artificial Sequence
  Synthetic construct
YWGPVVF

SEQ ID NO: 13157 - protein, 7 aa, Artificial Sequence
  Synthetic construct
YWGPVVY

SEQ ID NO: 13158 - protein, 7 aa, Artificial Sequence
  Synthetic construct
YWGPTFF

SEQ ID NO: 13159 - protein, 7 aa, Artificial Sequence
  Synthetic construct
YWGPTFY

SEQ ID NO: 13160 - protein, 7 aa, Artificial Sequence
  Synthetic construct
YWGPTRF

SEQ ID NO: 13161 - protein, 7 aa, Artificial Sequence
  Synthetic construct
YWGPTRY

SEQ ID NO: 13162 - protein, 7 aa, Artificial Sequence
  Synthetic construct
YWGPTCF

SEQ ID NO: 13163 - protein, 7 aa, Artificial Sequence
  Synthetic construct
YWGPTCY

SEQ ID NO: 13164 - protein, 7 aa, Artificial Sequence
  Synthetic construct
YWGPTLF

SEQ ID NO: 13165 - protein, 7 aa, Artificial Sequence
  Synthetic construct
YWGPTLY

SEQ ID NO: 13166 - protein, 7 aa, Artificial Sequence
  Synthetic construct
YWGPTAF

SEQ ID NO: 13167 - protein, 7 aa, Artificial Sequence
  Synthetic construct
YWGPTAY

SEQ ID NO: 13168 - protein, 7 aa, Artificial Sequence
  Synthetic construct
YWGPTQF

SEQ ID NO: 13169 - protein, 7 aa, Artificial Sequence
  Synthetic construct
YWGPTQY

SEQ ID NO: 13170 - protein, 7 aa, Artificial Sequence
  Synthetic construct
YWGPTDF

SEQ ID NO: 13171 - protein, 7 aa, Artificial Sequence
  Synthetic construct
YWGPTDY

SEQ ID NO: 13172 - protein, 7 aa, Artificial Sequence
  Synthetic construct
YWGPTVF

SEQ ID NO: 13173 - protein, 7 aa, Artificial Sequence
  Synthetic construct
YWGPTVY

SEQ ID NO: 13174 - protein, 7 aa, Artificial Sequence
  Synthetic construct
YWGPGFF

SEQ ID NO: 13175 - protein, 7 aa, Artificial Sequence
  Synthetic construct
YWGPGFY

SEQ ID NO: 13176 - protein, 7 aa, Artificial Sequence
  Synthetic construct
YWGPGRF

SEQ ID NO: 13177 - protein, 7 aa, Artificial Sequence
  Synthetic construct
YWGPGRY

SEQ ID NO: 13178 - protein, 7 aa, Artificial Sequence
  Synthetic construct
YWGPGCF

SEQ ID NO: 13179 - protein, 7 aa, Artificial Sequence
  Synthetic construct
YWGPGCY

SEQ ID NO: 13180 - protein, 7 aa, Artificial Sequence
  Synthetic construct
YWGPGLF

SEQ ID NO: 13181 - protein, 7 aa, Artificial Sequence
  Synthetic construct
YWGPGLY

SEQ ID NO: 13182 - protein, 7 aa, Artificial Sequence
  Synthetic construct
YWGPGAF

SEQ ID NO: 13183 - protein, 7 aa, Artificial Sequence
  Synthetic construct
YWGPGAY

SEQ ID NO: 13184 - protein, 7 aa, Artificial Sequence
  Synthetic construct
YWGPGQF

SEQ ID NO: 13185 - protein, 7 aa, Artificial Sequence
  Synthetic construct
YWGPGQY

SEQ ID NO: 13186 - protein, 7 aa, Artificial Sequence
  Synthetic construct
YWGPGDF

SEQ ID NO: 13187 - protein, 7 aa, Artificial Sequence
  Synthetic construct
YWGPGDY

SEQ ID NO: 13188 - protein, 7 aa, Artificial Sequence
  Synthetic construct
YWGPGVF

SEQ ID NO: 13189 - protein, 7 aa, Artificial Sequence
  Synthetic construct
YWGPGVY

SEQ ID NO: 13190 - protein, 7 aa, Artificial Sequence
  Synthetic construct
YWGPAFF

SEQ ID NO: 13191 - protein, 7 aa, Artificial Sequence
  Synthetic construct
YWGPAFY

SEQ ID NO: 13192 - protein, 7 aa, Artificial Sequence
  Synthetic construct
YWGPARF

SEQ ID NO: 13193 - protein, 7 aa, Artificial Sequence
  Synthetic construct
YWGPARY

SEQ ID NO: 13194 - protein, 7 aa, Artificial Sequence
  Synthetic construct
YWGPACF

SEQ ID NO: 13195 - protein, 7 aa, Artificial Sequence
  Synthetic construct
YWGPACY

SEQ ID NO: 13196 - protein, 7 aa, Artificial Sequence
  Synthetic construct
YWGPALF

SEQ ID NO: 13197 - protein, 7 aa, Artificial Sequence
  Synthetic construct
YWGPALY

SEQ ID NO: 13198 - protein, 7 aa, Artificial Sequence
  Synthetic construct
YWGPAAF

SEQ ID NO: 13199 - protein, 7 aa, Artificial Sequence
  Synthetic construct
YWGPAAY

SEQ ID NO: 13200 - protein, 7 aa, Artificial Sequence
  Synthetic construct
YWGPAQF

SEQ ID NO: 13201 - protein, 7 aa, Artificial Sequence
  Synthetic construct
YWGPAQY

SEQ ID NO: 13202 - protein, 7 aa, Artificial Sequence
  Synthetic construct
YWGPADF

SEQ ID NO: 13203 - protein, 7 aa, Artificial Sequence
  Synthetic construct
YWGPADY

SEQ ID NO: 13204 - protein, 7 aa, Artificial Sequence
  Synthetic construct
YWGPAVF

SEQ ID NO: 13205 - protein, 7 aa, Artificial Sequence
  Synthetic construct
YWGPAVY

SEQ ID NO: 13206 - protein, 7 aa, Artificial Sequence
  Synthetic construct
YWGPQFF

SEQ ID NO: 13207 - protein, 7 aa, Artificial Sequence
  Synthetic construct
YWGPQFY

SEQ ID NO: 13208 - protein, 7 aa, Artificial Sequence
  Synthetic construct
YWGPQRF

SEQ ID NO: 13209 - protein, 7 aa, Artificial Sequence
  Synthetic construct
YWGPQRY

SEQ ID NO: 13210 - protein, 7 aa, Artificial Sequence
  Synthetic construct
YWGPQCF

SEQ ID NO: 13211 - protein, 7 aa, Artificial Sequence
  Synthetic construct
YWGPQCY

SEQ ID NO: 13212 - protein, 7 aa, Artificial Sequence
  Synthetic construct
YWGPQLF

SEQ ID NO: 13213 - protein, 7 aa, Artificial Sequence
  Synthetic construct
YWGPQLY

SEQ ID NO: 13214 - protein, 7 aa, Artificial Sequence
  Synthetic construct
YWGPQAF

SEQ ID NO: 13215 - protein, 7 aa, Artificial Sequence
  Synthetic construct
YWGPQAY

SEQ ID NO: 13216 - protein, 7 aa, Artificial Sequence
  Synthetic construct
YWGPQQF

SEQ ID NO: 13217 - protein, 7 aa, Artificial Sequence
  Synthetic construct
YWGPQQY

SEQ ID NO: 13218 - protein, 7 aa, Artificial Sequence
  Synthetic construct
YWGPQDF

SEQ ID NO: 13219 - protein, 7 aa, Artificial Sequence
  Synthetic construct
YWGPQDY

SEQ ID NO: 13220 - protein, 7 aa, Artificial Sequence
  Synthetic construct
YWGPQVF

SEQ ID NO: 13221 - protein, 7 aa, Artificial Sequence
  Synthetic construct
YWGPQVY

SEQ ID NO: 13222 - protein, 7 aa, Artificial Sequence
  Synthetic construct
YWGHIFF

SEQ ID NO: 13223 - protein, 7 aa, Artificial Sequence
  Synthetic construct
YWGHIFY

SEQ ID NO: 13224 - protein, 7 aa, Artificial Sequence
  Synthetic construct
YWGHIRF

SEQ ID NO: 13225 - protein, 7 aa, Artificial Sequence
  Synthetic construct
YWGHIRY

SEQ ID NO: 13226 - protein, 7 aa, Artificial Sequence
  Synthetic construct
YWGHICF

SEQ ID NO: 13227 - protein, 7 aa, Artificial Sequence
  Synthetic construct
YWGHICY

SEQ ID NO: 13228 - protein, 7 aa, Artificial Sequence
  Synthetic construct
YWGHILF

SEQ ID NO: 13229 - protein, 7 aa, Artificial Sequence
  Synthetic construct
YWGHILY

SEQ ID NO: 13230 - protein, 7 aa, Artificial Sequence
  Synthetic construct
YWGHIAF

SEQ ID NO: 13231 - protein, 7 aa, Artificial Sequence
  Synthetic construct
YWGHIAY

SEQ ID NO: 13232 - protein, 7 aa, Artificial Sequence
  Synthetic construct
YWGHIQF

SEQ ID NO: 13233 - protein, 7 aa, Artificial Sequence
  Synthetic construct
YWGHIQY

SEQ ID NO: 13234 - protein, 7 aa, Artificial Sequence
  Synthetic construct
YWGHIDF

SEQ ID NO: 13235 - protein, 7 aa, Artificial Sequence
  Synthetic construct
YWGHIDY

SEQ ID NO: 13236 - protein, 7 aa, Artificial Sequence
  Synthetic construct
YWGHIVF

SEQ ID NO: 13237 - protein, 7 aa, Artificial Sequence
  Synthetic construct
YWGHIVY

SEQ ID NO: 13238 - protein, 7 aa, Artificial Sequence
  Synthetic construct
YWGHDFF

SEQ ID NO: 13239 - protein, 7 aa, Artificial Sequence
  Synthetic construct
YWGHDFY

SEQ ID NO: 13240 - protein, 7 aa, Artificial Sequence
  Synthetic construct
YWGHDRF

SEQ ID NO: 13241 - protein, 7 aa, Artificial Sequence
  Synthetic construct
YWGHDRY

SEQ ID NO: 13242 - protein, 7 aa, Artificial Sequence
  Synthetic construct
YWGHDCF

SEQ ID NO: 13243 - protein, 7 aa, Artificial Sequence
  Synthetic construct
YWGHDCY

SEQ ID NO: 13244 - protein, 7 aa, Artificial Sequence
  Synthetic construct
YWGHDLF

SEQ ID NO: 13245 - protein, 7 aa, Artificial Sequence
  Synthetic construct
YWGHDLY

SEQ ID NO: 13246 - protein, 7 aa, Artificial Sequence
  Synthetic construct
YWGHDAF

SEQ ID NO: 13247 - protein, 7 aa, Artificial Sequence
  Synthetic construct
YWGHDAY

SEQ ID NO: 13248 - protein, 7 aa, Artificial Sequence
  Synthetic construct
YWGHDQF

SEQ ID NO: 13249 - protein, 7 aa, Artificial Sequence
  Synthetic construct
YWGHDQY

SEQ ID NO: 13250 - protein, 7 aa, Artificial Sequence
  Synthetic construct
YWGHDDF

SEQ ID NO: 13251 - protein, 7 aa, Artificial Sequence
  Synthetic construct
YWGHDDY

SEQ ID NO: 13252 - protein, 7 aa, Artificial Sequence
  Synthetic construct
YWGHDVF

SEQ ID NO: 13253 - protein, 7 aa, Artificial Sequence
  Synthetic construct
YWGHDVY

SEQ ID NO: 13254 - protein, 7 aa, Artificial Sequence
  Synthetic construct
YWGHYFF

SEQ ID NO: 13255 - protein, 7 aa, Artificial Sequence
  Synthetic construct
YWGHYFY

SEQ ID NO: 13256 - protein, 7 aa, Artificial Sequence
  Synthetic construct
YWGHYRF

SEQ ID NO: 13257 - protein, 7 aa, Artificial Sequence
  Synthetic construct
YWGHYRY

SEQ ID NO: 13258 - protein, 7 aa, Artificial Sequence
  Synthetic construct
YWGHYCF

SEQ ID NO: 13259 - protein, 7 aa, Artificial Sequence
  Synthetic construct
YWGHYCY

SEQ ID NO: 13260 - protein, 7 aa, Artificial Sequence
  Synthetic construct
YWGHYLF

SEQ ID NO: 13261 - protein, 7 aa, Artificial Sequence
  Synthetic construct
YWGHYLY

SEQ ID NO: 13262 - protein, 7 aa, Artificial Sequence
  Synthetic construct
YWGHYAF

SEQ ID NO: 13263 - protein, 7 aa, Artificial Sequence
  Synthetic construct
YWGHYAY

SEQ ID NO: 13264 - protein, 7 aa, Artificial Sequence
  Synthetic construct
YWGHYQF

SEQ ID NO: 13265 - protein, 7 aa, Artificial Sequence
  Synthetic construct
YWGHYQY

SEQ ID NO: 13266 - protein, 7 aa, Artificial Sequence
  Synthetic construct
YWGHYDF

SEQ ID NO: 13267 - protein, 7 aa, Artificial Sequence
  Synthetic construct
YWGHYDY

SEQ ID NO: 13268 - protein, 7 aa, Artificial Sequence
  Synthetic construct
YWGHYVF

SEQ ID NO: 13269 - protein, 7 aa, Artificial Sequence
  Synthetic construct
YWGHYVY

SEQ ID NO: 13270 - protein, 7 aa, Artificial Sequence
  Synthetic construct
YWGHFFF

SEQ ID NO: 13271 - protein, 7 aa, Artificial Sequence
  Synthetic construct
YWGHFFY

SEQ ID NO: 13272 - protein, 7 aa, Artificial Sequence
  Synthetic construct
YWGHFRF

SEQ ID NO: 13273 - protein, 7 aa, Artificial Sequence
  Synthetic construct
YWGHFRY

SEQ ID NO: 13274 - protein, 7 aa, Artificial Sequence
  Synthetic construct
YWGHFCF

SEQ ID NO: 13275 - protein, 7 aa, Artificial Sequence
  Synthetic construct
YWGHFCY

SEQ ID NO: 13276 - protein, 7 aa, Artificial Sequence
  Synthetic construct
YWGHFLF

SEQ ID NO: 13277 - protein, 7 aa, Artificial Sequence
  Synthetic construct
YWGHFLY

SEQ ID NO: 13278 - protein, 7 aa, Artificial Sequence
  Synthetic construct
YWGHFAF

SEQ ID NO: 13279 - protein, 7 aa, Artificial Sequence
  Synthetic construct
YWGHFAY

SEQ ID NO: 13280 - protein, 7 aa, Artificial Sequence
  Synthetic construct
YWGHFQF

SEQ ID NO: 13281 - protein, 7 aa, Artificial Sequence
  Synthetic construct
YWGHFQY

SEQ ID NO: 13282 - protein, 7 aa, Artificial Sequence
  Synthetic construct
YWGHFDF

SEQ ID NO: 13283 - protein, 7 aa, Artificial Sequence
  Synthetic construct
YWGHFDY

SEQ ID NO: 13284 - protein, 7 aa, Artificial Sequence
  Synthetic construct
YWGHFVF

SEQ ID NO: 13285 - protein, 7 aa, Artificial Sequence
  Synthetic construct
YWGHFVY

SEQ ID NO: 13286 - protein, 7 aa, Artificial Sequence
  Synthetic construct
YWGHVFF

SEQ ID NO: 13287 - protein, 7 aa, Artificial Sequence
  Synthetic construct
YWGHVFY

SEQ ID NO: 13288 - protein, 7 aa, Artificial Sequence
  Synthetic construct
YWGHVRF

SEQ ID NO: 13289 - protein, 7 aa, Artificial Sequence
  Synthetic construct
YWGHVRY

SEQ ID NO: 13290 - protein, 7 aa, Artificial Sequence
  Synthetic construct
YWGHVCF

SEQ ID NO: 13291 - protein, 7 aa, Artificial Sequence
  Synthetic construct
YWGHVCY

SEQ ID NO: 13292 - protein, 7 aa, Artificial Sequence
  Synthetic construct
YWGHVLF

SEQ ID NO: 13293 - protein, 7 aa, Artificial Sequence
  Synthetic construct
YWGHVLY

SEQ ID NO: 13294 - protein, 7 aa, Artificial Sequence
  Synthetic construct
YWGHVAF

SEQ ID NO: 13295 - protein, 7 aa, Artificial Sequence
  Synthetic construct
YWGHVAY

SEQ ID NO: 13296 - protein, 7 aa, Artificial Sequence
  Synthetic construct
YWGHVQF

SEQ ID NO: 13297 - protein, 7 aa, Artificial Sequence
  Synthetic construct
YWGHVQY

SEQ ID NO: 13298 - protein, 7 aa, Artificial Sequence
  Synthetic construct
YWGHVDF

SEQ ID NO: 13299 - protein, 7 aa, Artificial Sequence
  Synthetic construct
YWGHVDY

SEQ ID NO: 13300 - protein, 7 aa, Artificial Sequence
  Synthetic construct
YWGHVVF

SEQ ID NO: 13301 - protein, 7 aa, Artificial Sequence
  Synthetic construct
YWGHVVY

SEQ ID NO: 13302 - protein, 7 aa, Artificial Sequence
  Synthetic construct
YWGHTFF

SEQ ID NO: 13303 - protein, 7 aa, Artificial Sequence
  Synthetic construct
YWGHTFY

SEQ ID NO: 13304 - protein, 7 aa, Artificial Sequence
  Synthetic construct
YWGHTRF

SEQ ID NO: 13305 - protein, 7 aa, Artificial Sequence
  Synthetic construct
YWGHTRY

SEQ ID NO: 13306 - protein, 7 aa, Artificial Sequence
  Synthetic construct
YWGHTCF

SEQ ID NO: 13307 - protein, 7 aa, Artificial Sequence
  Synthetic construct
YWGHTCY

SEQ ID NO: 13308 - protein, 7 aa, Artificial Sequence
  Synthetic construct
YWGHTLF

SEQ ID NO: 13309 - protein, 7 aa, Artificial Sequence
  Synthetic construct
YWGHTLY

SEQ ID NO: 13310 - protein, 7 aa, Artificial Sequence
  Synthetic construct
YWGHTAF

SEQ ID NO: 13311 - protein, 7 aa, Artificial Sequence
  Synthetic construct
YWGHTAY

SEQ ID NO: 13312 - protein, 7 aa, Artificial Sequence
  Synthetic construct
YWGHTQF

SEQ ID NO: 13313 - protein, 7 aa, Artificial Sequence
  Synthetic construct
YWGHTQY

SEQ ID NO: 13314 - protein, 7 aa, Artificial Sequence
  Synthetic construct
YWGHTDF

SEQ ID NO: 13315 - protein, 7 aa, Artificial Sequence
  Synthetic construct
YWGHTDY

SEQ ID NO: 13316 - protein, 7 aa, Artificial Sequence
  Synthetic construct
YWGHTVF

SEQ ID NO: 13317 - protein, 7 aa, Artificial Sequence
  Synthetic construct
YWGHTVY

SEQ ID NO: 13318 - protein, 7 aa, Artificial Sequence
  Synthetic construct
YWGHGFF

SEQ ID NO: 13319 - protein, 7 aa, Artificial Sequence
  Synthetic construct
YWGHGFY

SEQ ID NO: 13320 - protein, 7 aa, Artificial Sequence
  Synthetic construct
YWGHGRF

SEQ ID NO: 13321 - protein, 7 aa, Artificial Sequence
  Synthetic construct
YWGHGRY

SEQ ID NO: 13322 - protein, 7 aa, Artificial Sequence
  Synthetic construct
YWGHGCF

SEQ ID NO: 13323 - protein, 7 aa, Artificial Sequence
  Synthetic construct
YWGHGCY

SEQ ID NO: 13324 - protein, 7 aa, Artificial Sequence
  Synthetic construct
YWGHGLF

SEQ ID NO: 13325 - protein, 7 aa, Artificial Sequence
  Synthetic construct
YWGHGLY

SEQ ID NO: 13326 - protein, 7 aa, Artificial Sequence
  Synthetic construct
YWGHGAF

SEQ ID NO: 13327 - protein, 7 aa, Artificial Sequence
  Synthetic construct
YWGHGAY

SEQ ID NO: 13328 - protein, 7 aa, Artificial Sequence
  Synthetic construct
YWGHGQF

SEQ ID NO: 13329 - protein, 7 aa, Artificial Sequence
  Synthetic construct
YWGHGQY

SEQ ID NO: 13330 - protein, 7 aa, Artificial Sequence
  Synthetic construct
YWGHGDF

SEQ ID NO: 13331 - protein, 7 aa, Artificial Sequence
  Synthetic construct
YWGHGDY

SEQ ID NO: 13332 - protein, 7 aa, Artificial Sequence
  Synthetic construct
YWGHGVF

SEQ ID NO: 13333 - protein, 7 aa, Artificial Sequence
  Synthetic construct
YWGHGVY

SEQ ID NO: 13334 - protein, 7 aa, Artificial Sequence
  Synthetic construct
YWGHAFF

SEQ ID NO: 13335 - protein, 7 aa, Artificial Sequence
  Synthetic construct
YWGHAFY

SEQ ID NO: 13336 - protein, 7 aa, Artificial Sequence
  Synthetic construct
YWGHARF

SEQ ID NO: 13337 - protein, 7 aa, Artificial Sequence
  Synthetic construct
YWGHARY

SEQ ID NO: 13338 - protein, 7 aa, Artificial Sequence
  Synthetic construct
YWGHACF

SEQ ID NO: 13339 - protein, 7 aa, Artificial Sequence
  Synthetic construct
YWGHACY

SEQ ID NO: 13340 - protein, 7 aa, Artificial Sequence
  Synthetic construct
YWGHALF

SEQ ID NO: 13341 - protein, 7 aa, Artificial Sequence
  Synthetic construct
YWGHALY

SEQ ID NO: 13342 - protein, 7 aa, Artificial Sequence
  Synthetic construct
YWGHAAF

SEQ ID NO: 13343 - protein, 7 aa, Artificial Sequence
  Synthetic construct
YWGHAAY

SEQ ID NO: 13344 - protein, 7 aa, Artificial Sequence
  Synthetic construct
YWGHAQF

SEQ ID NO: 13345 - protein, 7 aa, Artificial Sequence
  Synthetic construct
YWGHAQY

SEQ ID NO: 13346 - protein, 7 aa, Artificial Sequence
  Synthetic construct
YWGHADF

SEQ ID NO: 13347 - protein, 7 aa, Artificial Sequence
  Synthetic construct
YWGHADY

SEQ ID NO: 13348 - protein, 7 aa, Artificial Sequence
  Synthetic construct
YWGHAVF

SEQ ID NO: 13349 - protein, 7 aa, Artificial Sequence
  Synthetic construct
YWGHAVY

SEQ ID NO: 13350 - protein, 7 aa, Artificial Sequence
  Synthetic construct
YWGHQFF

SEQ ID NO: 13351 - protein, 7 aa, Artificial Sequence
  Synthetic construct
YWGHQFY

SEQ ID NO: 13352 - protein, 7 aa, Artificial Sequence
  Synthetic construct
YWGHQRF

SEQ ID NO: 13353 - protein, 7 aa, Artificial Sequence
  Synthetic construct
YWGHQRY

SEQ ID NO: 13354 - protein, 7 aa, Artificial Sequence
  Synthetic construct
YWGHQCF

SEQ ID NO: 13355 - protein, 7 aa, Artificial Sequence
  Synthetic construct
YWGHQCY

SEQ ID NO: 13356 - protein, 7 aa, Artificial Sequence
  Synthetic construct
YWGHQLF

SEQ ID NO: 13357 - protein, 7 aa, Artificial Sequence
  Synthetic construct
YWGHQLY

SEQ ID NO: 13358 - protein, 7 aa, Artificial Sequence
  Synthetic construct
YWGHQAF

SEQ ID NO: 13359 - protein, 7 aa, Artificial Sequence
  Synthetic construct
YWGHQAY

SEQ ID NO: 13360 - protein, 7 aa, Artificial Sequence
  Synthetic construct
YWGHQQF

SEQ ID NO: 13361 - protein, 7 aa, Artificial Sequence
  Synthetic construct
YWGHQQY

SEQ ID NO: 13362 - protein, 7 aa, Artificial Sequence
  Synthetic construct
YWGHQDF

SEQ ID NO: 13363 - protein, 7 aa, Artificial Sequence
  Synthetic construct
YWGHQDY

SEQ ID NO: 13364 - protein, 7 aa, Artificial Sequence
  Synthetic construct
YWGHQVF

SEQ ID NO: 13365 - protein, 7 aa, Artificial Sequence
  Synthetic construct
YWGHQVY

SEQ ID NO: 13366 - protein, 7 aa, Artificial Sequence
  Synthetic construct
YWGLIFF

SEQ ID NO: 13367 - protein, 7 aa, Artificial Sequence
  Synthetic construct
YWGLIFY

SEQ ID NO: 13368 - protein, 7 aa, Artificial Sequence
  Synthetic construct
YWGLIRF

SEQ ID NO: 13369 - protein, 7 aa, Artificial Sequence
  Synthetic construct
YWGLIRY

SEQ ID NO: 13370 - protein, 7 aa, Artificial Sequence
  Synthetic construct
YWGLICF

SEQ ID NO: 13371 - protein, 7 aa, Artificial Sequence
  Synthetic construct
YWGLICY

SEQ ID NO: 13372 - protein, 7 aa, Artificial Sequence
  Synthetic construct
YWGLILF

SEQ ID NO: 13373 - protein, 7 aa, Artificial Sequence
  Synthetic construct
YWGLILY

SEQ ID NO: 13374 - protein, 7 aa, Artificial Sequence
  Synthetic construct
YWGLIAF

SEQ ID NO: 13375 - protein, 7 aa, Artificial Sequence
  Synthetic construct
YWGLIAY

SEQ ID NO: 13376 - protein, 7 aa, Artificial Sequence
  Synthetic construct
YWGLIQF

SEQ ID NO: 13377 - protein, 7 aa, Artificial Sequence
  Synthetic construct
YWGLIQY

SEQ ID NO: 13378 - protein, 7 aa, Artificial Sequence
  Synthetic construct
YWGLIDF

SEQ ID NO: 13379 - protein, 7 aa, Artificial Sequence
  Synthetic construct
YWGLIDY

SEQ ID NO: 13380 - protein, 7 aa, Artificial Sequence
  Synthetic construct
YWGLIVF

SEQ ID NO: 13381 - protein, 7 aa, Artificial Sequence
  Synthetic construct
YWGLIVY

SEQ ID NO: 13382 - protein, 7 aa, Artificial Sequence
  Synthetic construct
YWGLDFF

SEQ ID NO: 13383 - protein, 7 aa, Artificial Sequence
  Synthetic construct
YWGLDFY

SEQ ID NO: 13384 - protein, 7 aa, Artificial Sequence
  Synthetic construct
YWGLDRF

SEQ ID NO: 13385 - protein, 7 aa, Artificial Sequence
  Synthetic construct
YWGLDRY

SEQ ID NO: 13386 - protein, 7 aa, Artificial Sequence
  Synthetic construct
YWGLDCF

SEQ ID NO: 13387 - protein, 7 aa, Artificial Sequence
  Synthetic construct
YWGLDCY

SEQ ID NO: 13388 - protein, 7 aa, Artificial Sequence
  Synthetic construct
YWGLDLF

SEQ ID NO: 13389 - protein, 7 aa, Artificial Sequence
  Synthetic construct
YWGLDLY

SEQ ID NO: 13390 - protein, 7 aa, Artificial Sequence
  Synthetic construct
YWGLDAF

SEQ ID NO: 13391 - protein, 7 aa, Artificial Sequence
  Synthetic construct
YWGLDAY

SEQ ID NO: 13392 - protein, 7 aa, Artificial Sequence
  Synthetic construct
YWGLDQF

SEQ ID NO: 13393 - protein, 7 aa, Artificial Sequence
  Synthetic construct
YWGLDQY

SEQ ID NO: 13394 - protein, 7 aa, Artificial Sequence
  Synthetic construct
YWGLDDF

SEQ ID NO: 13395 - protein, 7 aa, Artificial Sequence
  Synthetic construct
YWGLDDY

SEQ ID NO: 13396 - protein, 7 aa, Artificial Sequence
  Synthetic construct
YWGLDVF

SEQ ID NO: 13397 - protein, 7 aa, Artificial Sequence
  Synthetic construct
YWGLDVY

SEQ ID NO: 13398 - protein, 7 aa, Artificial Sequence
  Synthetic construct
YWGLYFF

SEQ ID NO: 13399 - protein, 7 aa, Artificial Sequence
  Synthetic construct
YWGLYFY

SEQ ID NO: 13400 - protein, 7 aa, Artificial Sequence
  Synthetic construct
YWGLYRF

SEQ ID NO: 13401 - protein, 7 aa, Artificial Sequence
  Synthetic construct
YWGLYRY

SEQ ID NO: 13402 - protein, 7 aa, Artificial Sequence
  Synthetic construct
YWGLYCF

SEQ ID NO: 13403 - protein, 7 aa, Artificial Sequence
  Synthetic construct
YWGLYCY

SEQ ID NO: 13404 - protein, 7 aa, Artificial Sequence
  Synthetic construct
YWGLYLF

SEQ ID NO: 13405 - protein, 7 aa, Artificial Sequence
  Synthetic construct
YWGLYLY

SEQ ID NO: 13406 - protein, 7 aa, Artificial Sequence
  Synthetic construct
YWGLYAF

SEQ ID NO: 13407 - protein, 7 aa, Artificial Sequence
  Synthetic construct
YWGLYAY

SEQ ID NO: 13408 - protein, 7 aa, Artificial Sequence
  Synthetic construct
YWGLYQF

SEQ ID NO: 13409 - protein, 7 aa, Artificial Sequence
  Synthetic construct
YWGLYQY

SEQ ID NO: 13410 - protein, 7 aa, Artificial Sequence
  Synthetic construct
YWGLYDF

SEQ ID NO: 13411 - protein, 7 aa, Artificial Sequence
  Synthetic construct
YWGLYDY

SEQ ID NO: 13412 - protein, 7 aa, Artificial Sequence
  Synthetic construct
YWGLYVF

SEQ ID NO: 13413 - protein, 7 aa, Artificial Sequence
  Synthetic construct
YWGLYVY

SEQ ID NO: 13414 - protein, 7 aa, Artificial Sequence
  Synthetic construct
YWGLFFF

SEQ ID NO: 13415 - protein, 7 aa, Artificial Sequence
  Synthetic construct
YWGLFFY

SEQ ID NO: 13416 - protein, 7 aa, Artificial Sequence
  Synthetic construct
YWGLFRF

SEQ ID NO: 13417 - protein, 7 aa, Artificial Sequence
  Synthetic construct
YWGLFRY

SEQ ID NO: 13418 - protein, 7 aa, Artificial Sequence
  Synthetic construct
YWGLFCF

SEQ ID NO: 13419 - protein, 7 aa, Artificial Sequence
  Synthetic construct
YWGLFCY

SEQ ID NO: 13420 - protein, 7 aa, Artificial Sequence
  Synthetic construct
YWGLFLF

SEQ ID NO: 13421 - protein, 7 aa, Artificial Sequence
  Synthetic construct
YWGLFLY

SEQ ID NO: 13422 - protein, 7 aa, Artificial Sequence
  Synthetic construct
YWGLFAF

SEQ ID NO: 13423 - protein, 7 aa, Artificial Sequence
  Synthetic construct
YWGLFAY

SEQ ID NO: 13424 - protein, 7 aa, Artificial Sequence
  Synthetic construct
YWGLFQF

SEQ ID NO: 13425 - protein, 7 aa, Artificial Sequence
  Synthetic construct
YWGLFQY

SEQ ID NO: 13426 - protein, 7 aa, Artificial Sequence
  Synthetic construct
YWGLFDF

SEQ ID NO: 13427 - protein, 7 aa, Artificial Sequence
  Synthetic construct
YWGLFDY

SEQ ID NO: 13428 - protein, 7 aa, Artificial Sequence
  Synthetic construct
YWGLFVF

SEQ ID NO: 13429 - protein, 7 aa, Artificial Sequence
  Synthetic construct
YWGLFVY

SEQ ID NO: 13430 - protein, 7 aa, Artificial Sequence
  Synthetic construct
YWGLVFF

SEQ ID NO: 13431 - protein, 7 aa, Artificial Sequence
  Synthetic construct
YWGLVFY

SEQ ID NO: 13432 - protein, 7 aa, Artificial Sequence
  Synthetic construct
YWGLVRF

SEQ ID NO: 13433 - protein, 7 aa, Artificial Sequence
  Synthetic construct
YWGLVRY

SEQ ID NO: 13434 - protein, 7 aa, Artificial Sequence
  Synthetic construct
YWGLVCF

SEQ ID NO: 13435 - protein, 7 aa, Artificial Sequence
  Synthetic construct
YWGLVCY

SEQ ID NO: 13436 - protein, 7 aa, Artificial Sequence
  Synthetic construct
YWGLVLF

SEQ ID NO: 13437 - protein, 7 aa, Artificial Sequence
  Synthetic construct
YWGLVLY

SEQ ID NO: 13438 - protein, 7 aa, Artificial Sequence
  Synthetic construct
YWGLVAF

SEQ ID NO: 13439 - protein, 7 aa, Artificial Sequence
  Synthetic construct
YWGLVAY

SEQ ID NO: 13440 - protein, 7 aa, Artificial Sequence
  Synthetic construct
YWGLVQF

SEQ ID NO: 13441 - protein, 7 aa, Artificial Sequence
  Synthetic construct
YWGLVQY

SEQ ID NO: 13442 - protein, 7 aa, Artificial Sequence
  Synthetic construct
YWGLVDF

SEQ ID NO: 13443 - protein, 7 aa, Artificial Sequence
  Synthetic construct
YWGLVDY

SEQ ID NO: 13444 - protein, 7 aa, Artificial Sequence
  Synthetic construct
YWGLVVF

SEQ ID NO: 13445 - protein, 7 aa, Artificial Sequence
  Synthetic construct
YWGLVVY

SEQ ID NO: 13446 - protein, 7 aa, Artificial Sequence
  Synthetic construct
YWGLTFF

SEQ ID NO: 13447 - protein, 7 aa, Artificial Sequence
  Synthetic construct
YWGLTFY

SEQ ID NO: 13448 - protein, 7 aa, Artificial Sequence
  Synthetic construct
YWGLTRF

SEQ ID NO: 13449 - protein, 7 aa, Artificial Sequence
  Synthetic construct
YWGLTRY

SEQ ID NO: 13450 - protein, 7 aa, Artificial Sequence
  Synthetic construct
YWGLTCF

SEQ ID NO: 13451 - protein, 7 aa, Artificial Sequence
  Synthetic construct
YWGLTCY

SEQ ID NO: 13452 - protein, 7 aa, Artificial Sequence
  Synthetic construct
YWGLTLF

SEQ ID NO: 13453 - protein, 7 aa, Artificial Sequence
  Synthetic construct
YWGLTLY

SEQ ID NO: 13454 - protein, 7 aa, Artificial Sequence
  Synthetic construct
YWGLTAF

SEQ ID NO: 13455 - protein, 7 aa, Artificial Sequence
  Synthetic construct
YWGLTAY

SEQ ID NO: 13456 - protein, 7 aa, Artificial Sequence
  Synthetic construct
YWGLTQF

SEQ ID NO: 13457 - protein, 7 aa, Artificial Sequence
  Synthetic construct
YWGLTQY

SEQ ID NO: 13458 - protein, 7 aa, Artificial Sequence
  Synthetic construct
YWGLTDF

SEQ ID NO: 13459 - protein, 7 aa, Artificial Sequence
  Synthetic construct
YWGLTDY

SEQ ID NO: 13460 - protein, 7 aa, Artificial Sequence
  Synthetic construct
YWGLTVF

SEQ ID NO: 13461 - protein, 7 aa, Artificial Sequence
  Synthetic construct
YWGLTVY

SEQ ID NO: 13462 - protein, 7 aa, Artificial Sequence
  Synthetic construct
YWGLGFF

SEQ ID NO: 13463 - protein, 7 aa, Artificial Sequence
  Synthetic construct
YWGLGFY

SEQ ID NO: 13464 - protein, 7 aa, Artificial Sequence
  Synthetic construct
YWGLGRF

SEQ ID NO: 13465 - protein, 7 aa, Artificial Sequence
  Synthetic construct
YWGLGRY

SEQ ID NO: 13466 - protein, 7 aa, Artificial Sequence
  Synthetic construct
YWGLGCF

SEQ ID NO: 13467 - protein, 7 aa, Artificial Sequence
  Synthetic construct
YWGLGCY

SEQ ID NO: 13468 - protein, 7 aa, Artificial Sequence
  Synthetic construct
YWGLGLF

SEQ ID NO: 13469 - protein, 7 aa, Artificial Sequence
  Synthetic construct
YWGLGLY

SEQ ID NO: 13470 - protein, 7 aa, Artificial Sequence
  Synthetic construct
YWGLGAF

SEQ ID NO: 13471 - protein, 7 aa, Artificial Sequence
  Synthetic construct
YWGLGAY

SEQ ID NO: 13472 - protein, 7 aa, Artificial Sequence
  Synthetic construct
YWGLGQF

SEQ ID NO: 13473 - protein, 7 aa, Artificial Sequence
  Synthetic construct
YWGLGQY

SEQ ID NO: 13474 - protein, 7 aa, Artificial Sequence
  Synthetic construct
YWGLGDF

SEQ ID NO: 13475 - protein, 7 aa, Artificial Sequence
  Synthetic construct
YWGLGDY

SEQ ID NO: 13476 - protein, 7 aa, Artificial Sequence
  Synthetic construct
YWGLGVF

SEQ ID NO: 13477 - protein, 7 aa, Artificial Sequence
  Synthetic construct
YWGLGVY

SEQ ID NO: 13478 - protein, 7 aa, Artificial Sequence
  Synthetic construct
YWGLAFF

SEQ ID NO: 13479 - protein, 7 aa, Artificial Sequence
  Synthetic construct
YWGLAFY

SEQ ID NO: 13480 - protein, 7 aa, Artificial Sequence
  Synthetic construct
YWGLARF

SEQ ID NO: 13481 - protein, 7 aa, Artificial Sequence
  Synthetic construct
YWGLARY

SEQ ID NO: 13482 - protein, 7 aa, Artificial Sequence
  Synthetic construct
YWGLACF

SEQ ID NO: 13483 - protein, 7 aa, Artificial Sequence
  Synthetic construct
YWGLACY

SEQ ID NO: 13484 - protein, 7 aa, Artificial Sequence
  Synthetic construct
YWGLALF

SEQ ID NO: 13485 - protein, 7 aa, Artificial Sequence
  Synthetic construct
YWGLALY

SEQ ID NO: 13486 - protein, 7 aa, Artificial Sequence
  Synthetic construct
YWGLAAF

SEQ ID NO: 13487 - protein, 7 aa, Artificial Sequence
  Synthetic construct
YWGLAAY

SEQ ID NO: 13488 - protein, 7 aa, Artificial Sequence
  Synthetic construct
YWGLAQF

SEQ ID NO: 13489 - protein, 7 aa, Artificial Sequence
  Synthetic construct
YWGLAQY

SEQ ID NO: 13490 - protein, 7 aa, Artificial Sequence
  Synthetic construct
YWGLADF

SEQ ID NO: 13491 - protein, 7 aa, Artificial Sequence
  Synthetic construct
YWGLADY

SEQ ID NO: 13492 - protein, 7 aa, Artificial Sequence
  Synthetic construct
YWGLAVF

SEQ ID NO: 13493 - protein, 7 aa, Artificial Sequence
  Synthetic construct
YWGLAVY

SEQ ID NO: 13494 - protein, 7 aa, Artificial Sequence
  Synthetic construct
YWGLQFF

SEQ ID NO: 13495 - protein, 7 aa, Artificial Sequence
  Synthetic construct
YWGLQFY

SEQ ID NO: 13496 - protein, 7 aa, Artificial Sequence
  Synthetic construct
YWGLQRF

SEQ ID NO: 13497 - protein, 7 aa, Artificial Sequence
  Synthetic construct
YWGLQRY

SEQ ID NO: 13498 - protein, 7 aa, Artificial Sequence
  Synthetic construct
YWGLQCF

SEQ ID NO: 13499 - protein, 7 aa, Artificial Sequence
  Synthetic construct
YWGLQCY

SEQ ID NO: 13500 - protein, 7 aa, Artificial Sequence
  Synthetic construct
YWGLQLF

SEQ ID NO: 13501 - protein, 7 aa, Artificial Sequence
  Synthetic construct
YWGLQLY

SEQ ID NO: 13502 - protein, 7 aa, Artificial Sequence
  Synthetic construct
YWGLQAF

SEQ ID NO: 13503 - protein, 7 aa, Artificial Sequence
  Synthetic construct
YWGLQAY

SEQ ID NO: 13504 - protein, 7 aa, Artificial Sequence
  Synthetic construct
YWGLQQF

SEQ ID NO: 13505 - protein, 7 aa, Artificial Sequence
  Synthetic construct
YWGLQQY

SEQ ID NO: 13506 - protein, 7 aa, Artificial Sequence
  Synthetic construct
YWGLQDF

SEQ ID NO: 13507 - protein, 7 aa, Artificial Sequence
  Synthetic construct
YWGLQDY

SEQ ID NO: 13508 - protein, 7 aa, Artificial Sequence
  Synthetic construct
YWGLQVF

SEQ ID NO: 13509 - protein, 7 aa, Artificial Sequence
  Synthetic construct
YWGLQVY

SEQ ID NO: 13510 - protein, 7 aa, Artificial Sequence
  Synthetic construct
YWGFIFF

SEQ ID NO: 13511 - protein, 7 aa, Artificial Sequence
  Synthetic construct
YWGFIFY

SEQ ID NO: 13512 - protein, 7 aa, Artificial Sequence
  Synthetic construct
YWGFIRF

SEQ ID NO: 13513 - protein, 7 aa, Artificial Sequence
  Synthetic construct
YWGFIRY

SEQ ID NO: 13514 - protein, 7 aa, Artificial Sequence
  Synthetic construct
YWGFICF

SEQ ID NO: 13515 - protein, 7 aa, Artificial Sequence
  Synthetic construct
YWGFICY

SEQ ID NO: 13516 - protein, 7 aa, Artificial Sequence
  Synthetic construct
YWGFILF

SEQ ID NO: 13517 - protein, 7 aa, Artificial Sequence
  Synthetic construct
YWGFILY

SEQ ID NO: 13518 - protein, 7 aa, Artificial Sequence
  Synthetic construct
YWGFIAF

SEQ ID NO: 13519 - protein, 7 aa, Artificial Sequence
  Synthetic construct
YWGFIAY

SEQ ID NO: 13520 - protein, 7 aa, Artificial Sequence
  Synthetic construct
YWGFIQF

SEQ ID NO: 13521 - protein, 7 aa, Artificial Sequence
  Synthetic construct
YWGFIQY

SEQ ID NO: 13522 - protein, 7 aa, Artificial Sequence
  Synthetic construct
YWGFIDF

SEQ ID NO: 13523 - protein, 7 aa, Artificial Sequence
  Synthetic construct
YWGFIDY

SEQ ID NO: 13524 - protein, 7 aa, Artificial Sequence
  Synthetic construct
YWGFIVF

SEQ ID NO: 13525 - protein, 7 aa, Artificial Sequence
  Synthetic construct
YWGFIVY

SEQ ID NO: 13526 - protein, 7 aa, Artificial Sequence
  Synthetic construct
YWGFDFF

SEQ ID NO: 13527 - protein, 7 aa, Artificial Sequence
  Synthetic construct
YWGFDFY

SEQ ID NO: 13528 - protein, 7 aa, Artificial Sequence
  Synthetic construct
YWGFDRF

SEQ ID NO: 13529 - protein, 7 aa, Artificial Sequence
  Synthetic construct
YWGFDRY

SEQ ID NO: 13530 - protein, 7 aa, Artificial Sequence
  Synthetic construct
YWGFDCF

SEQ ID NO: 13531 - protein, 7 aa, Artificial Sequence
  Synthetic construct
YWGFDCY

SEQ ID NO: 13532 - protein, 7 aa, Artificial Sequence
  Synthetic construct
YWGFDLF

SEQ ID NO: 13533 - protein, 7 aa, Artificial Sequence
  Synthetic construct
YWGFDLY

SEQ ID NO: 13534 - protein, 7 aa, Artificial Sequence
  Synthetic construct
YWGFDAF

SEQ ID NO: 13535 - protein, 7 aa, Artificial Sequence
  Synthetic construct
YWGFDAY

SEQ ID NO: 13536 - protein, 7 aa, Artificial Sequence
  Synthetic construct
YWGFDQF

SEQ ID NO: 13537 - protein, 7 aa, Artificial Sequence
  Synthetic construct
YWGFDQY

SEQ ID NO: 13538 - protein, 7 aa, Artificial Sequence
  Synthetic construct
YWGFDDF

SEQ ID NO: 13539 - protein, 7 aa, Artificial Sequence
  Synthetic construct
YWGFDDY

SEQ ID NO: 13540 - protein, 7 aa, Artificial Sequence
  Synthetic construct
YWGFDVF

SEQ ID NO: 13541 - protein, 7 aa, Artificial Sequence
  Synthetic construct
YWGFDVY

SEQ ID NO: 13542 - protein, 7 aa, Artificial Sequence
  Synthetic construct
YWGFYFF

SEQ ID NO: 13543 - protein, 7 aa, Artificial Sequence
  Synthetic construct
YWGFYFY

SEQ ID NO: 13544 - protein, 7 aa, Artificial Sequence
  Synthetic construct
YWGFYRF

SEQ ID NO: 13545 - protein, 7 aa, Artificial Sequence
  Synthetic construct
YWGFYRY

SEQ ID NO: 13546 - protein, 7 aa, Artificial Sequence
  Synthetic construct
YWGFYCF

SEQ ID NO: 13547 - protein, 7 aa, Artificial Sequence
  Synthetic construct
YWGFYCY

SEQ ID NO: 13548 - protein, 7 aa, Artificial Sequence
  Synthetic construct
YWGFYLF

SEQ ID NO: 13549 - protein, 7 aa, Artificial Sequence
  Synthetic construct
YWGFYLY

SEQ ID NO: 13550 - protein, 7 aa, Artificial Sequence
  Synthetic construct
YWGFYAF

SEQ ID NO: 13551 - protein, 7 aa, Artificial Sequence
  Synthetic construct
YWGFYAY

SEQ ID NO: 13552 - protein, 7 aa, Artificial Sequence
  Synthetic construct
YWGFYQF

SEQ ID NO: 13553 - protein, 7 aa, Artificial Sequence
  Synthetic construct
YWGFYQY

SEQ ID NO: 13554 - protein, 7 aa, Artificial Sequence
  Synthetic construct
YWGFYDF

SEQ ID NO: 13555 - protein, 7 aa, Artificial Sequence
  Synthetic construct
YWGFYDY

SEQ ID NO: 13556 - protein, 7 aa, Artificial Sequence
  Synthetic construct
YWGFYVF

SEQ ID NO: 13557 - protein, 7 aa, Artificial Sequence
  Synthetic construct
YWGFYVY

SEQ ID NO: 13558 - protein, 7 aa, Artificial Sequence
  Synthetic construct
YWGFFFF

SEQ ID NO: 13559 - protein, 7 aa, Artificial Sequence
  Synthetic construct
YWGFFFY

SEQ ID NO: 13560 - protein, 7 aa, Artificial Sequence
  Synthetic construct
YWGFFRF

SEQ ID NO: 13561 - protein, 7 aa, Artificial Sequence
  Synthetic construct
YWGFFRY

SEQ ID NO: 13562 - protein, 7 aa, Artificial Sequence
  Synthetic construct
YWGFFCF

SEQ ID NO: 13563 - protein, 7 aa, Artificial Sequence
  Synthetic construct
YWGFFCY

SEQ ID NO: 13564 - protein, 7 aa, Artificial Sequence
  Synthetic construct
YWGFFLF

SEQ ID NO: 13565 - protein, 7 aa, Artificial Sequence
  Synthetic construct
YWGFFLY

SEQ ID NO: 13566 - protein, 7 aa, Artificial Sequence
  Synthetic construct
YWGFFAF

SEQ ID NO: 13567 - protein, 7 aa, Artificial Sequence
  Synthetic construct
YWGFFAY

SEQ ID NO: 13568 - protein, 7 aa, Artificial Sequence
  Synthetic construct
YWGFFQF

SEQ ID NO: 13569 - protein, 7 aa, Artificial Sequence
  Synthetic construct
YWGFFQY

SEQ ID NO: 13570 - protein, 7 aa, Artificial Sequence
  Synthetic construct
YWGFFDF

SEQ ID NO: 13571 - protein, 7 aa, Artificial Sequence
  Synthetic construct
YWGFFDY

SEQ ID NO: 13572 - protein, 7 aa, Artificial Sequence
  Synthetic construct
YWGFFVF

SEQ ID NO: 13573 - protein, 7 aa, Artificial Sequence
  Synthetic construct
YWGFFVY

SEQ ID NO: 13574 - protein, 7 aa, Artificial Sequence
  Synthetic construct
YWGFVFF

SEQ ID NO: 13575 - protein, 7 aa, Artificial Sequence
  Synthetic construct
YWGFVFY

SEQ ID NO: 13576 - protein, 7 aa, Artificial Sequence
  Synthetic construct
YWGFVRF

SEQ ID NO: 13577 - protein, 7 aa, Artificial Sequence
  Synthetic construct
YWGFVRY

SEQ ID NO: 13578 - protein, 7 aa, Artificial Sequence
  Synthetic construct
YWGFVCF

SEQ ID NO: 13579 - protein, 7 aa, Artificial Sequence
  Synthetic construct
YWGFVCY

SEQ ID NO: 13580 - protein, 7 aa, Artificial Sequence
  Synthetic construct
YWGFVLF

SEQ ID NO: 13581 - protein, 7 aa, Artificial Sequence
  Synthetic construct
YWGFVLY

SEQ ID NO: 13582 - protein, 7 aa, Artificial Sequence
  Synthetic construct
YWGFVAF

SEQ ID NO: 13583 - protein, 7 aa, Artificial Sequence
  Synthetic construct
YWGFVAY

SEQ ID NO: 13584 - protein, 7 aa, Artificial Sequence
  Synthetic construct
YWGFVQF

SEQ ID NO: 13585 - protein, 7 aa, Artificial Sequence
  Synthetic construct
YWGFVQY

SEQ ID NO: 13586 - protein, 7 aa, Artificial Sequence
  Synthetic construct
YWGFVDF

SEQ ID NO: 13587 - protein, 7 aa, Artificial Sequence
  Synthetic construct
YWGFVDY

SEQ ID NO: 13588 - protein, 7 aa, Artificial Sequence
  Synthetic construct
YWGFVVF

SEQ ID NO: 13589 - protein, 7 aa, Artificial Sequence
  Synthetic construct
YWGFVVY

SEQ ID NO: 13590 - protein, 7 aa, Artificial Sequence
  Synthetic construct
YWGFTFF

SEQ ID NO: 13591 - protein, 7 aa, Artificial Sequence
  Synthetic construct
YWGFTFY

SEQ ID NO: 13592 - protein, 7 aa, Artificial Sequence
  Synthetic construct
YWGFTRF

SEQ ID NO: 13593 - protein, 7 aa, Artificial Sequence
  Synthetic construct
YWGFTRY

SEQ ID NO: 13594 - protein, 7 aa, Artificial Sequence
  Synthetic construct
YWGFTCF

SEQ ID NO: 13595 - protein, 7 aa, Artificial Sequence
  Synthetic construct
YWGFTCY

SEQ ID NO: 13596 - protein, 7 aa, Artificial Sequence
  Synthetic construct
YWGFTLF

SEQ ID NO: 13597 - protein, 7 aa, Artificial Sequence
  Synthetic construct
YWGFTLY

SEQ ID NO: 13598 - protein, 7 aa, Artificial Sequence
  Synthetic construct
YWGFTAF

SEQ ID NO: 13599 - protein, 7 aa, Artificial Sequence
  Synthetic construct
YWGFTAY

SEQ ID NO: 13600 - protein, 7 aa, Artificial Sequence
  Synthetic construct
YWGFTQF

SEQ ID NO: 13601 - protein, 7 aa, Artificial Sequence
  Synthetic construct
YWGFTQY

SEQ ID NO: 13602 - protein, 7 aa, Artificial Sequence
  Synthetic construct
YWGFTDF

SEQ ID NO: 13603 - protein, 7 aa, Artificial Sequence
  Synthetic construct
YWGFTDY

SEQ ID NO: 13604 - protein, 7 aa, Artificial Sequence
  Synthetic construct
YWGFTVF

SEQ ID NO: 13605 - protein, 7 aa, Artificial Sequence
  Synthetic construct
YWGFTVY

SEQ ID NO: 13606 - protein, 7 aa, Artificial Sequence
  Synthetic construct
YWGFGFF

SEQ ID NO: 13607 - protein, 7 aa, Artificial Sequence
  Synthetic construct
YWGFGFY

SEQ ID NO: 13608 - protein, 7 aa, Artificial Sequence
  Synthetic construct
YWGFGRF

SEQ ID NO: 13609 - protein, 7 aa, Artificial Sequence
  Synthetic construct
YWGFGRY

SEQ ID NO: 13610 - protein, 7 aa, Artificial Sequence
  Synthetic construct
YWGFGCF

SEQ ID NO: 13611 - protein, 7 aa, Artificial Sequence
  Synthetic construct
YWGFGCY

SEQ ID NO: 13612 - protein, 7 aa, Artificial Sequence
  Synthetic construct
YWGFGLF

SEQ ID NO: 13613 - protein, 7 aa, Artificial Sequence
  Synthetic construct
YWGFGLY

SEQ ID NO: 13614 - protein, 7 aa, Artificial Sequence
  Synthetic construct
YWGFGAF

SEQ ID NO: 13615 - protein, 7 aa, Artificial Sequence
  Synthetic construct
YWGFGAY

SEQ ID NO: 13616 - protein, 7 aa, Artificial Sequence
  Synthetic construct
YWGFGQF

SEQ ID NO: 13617 - protein, 7 aa, Artificial Sequence
  Synthetic construct
YWGFGQY

SEQ ID NO: 13618 - protein, 7 aa, Artificial Sequence
  Synthetic construct
YWGFGDF

SEQ ID NO: 13619 - protein, 7 aa, Artificial Sequence
  Synthetic construct
YWGFGDY

SEQ ID NO: 13620 - protein, 7 aa, Artificial Sequence
  Synthetic construct
YWGFGVF

SEQ ID NO: 13621 - protein, 7 aa, Artificial Sequence
  Synthetic construct
YWGFGVY

SEQ ID NO: 13622 - protein, 7 aa, Artificial Sequence
  Synthetic construct
YWGFAFF

SEQ ID NO: 13623 - protein, 7 aa, Artificial Sequence
  Synthetic construct
YWGFAFY

SEQ ID NO: 13624 - protein, 7 aa, Artificial Sequence
  Synthetic construct
YWGFARF

SEQ ID NO: 13625 - protein, 7 aa, Artificial Sequence
  Synthetic construct
YWGFARY

SEQ ID NO: 13626 - protein, 7 aa, Artificial Sequence
  Synthetic construct
YWGFACF

SEQ ID NO: 13627 - protein, 7 aa, Artificial Sequence
  Synthetic construct
YWGFACY

SEQ ID NO: 13628 - protein, 7 aa, Artificial Sequence
  Synthetic construct
YWGFALF

SEQ ID NO: 13629 - protein, 7 aa, Artificial Sequence
  Synthetic construct
YWGFALY

SEQ ID NO: 13630 - protein, 7 aa, Artificial Sequence
  Synthetic construct
YWGFAAF

SEQ ID NO: 13631 - protein, 7 aa, Artificial Sequence
  Synthetic construct
YWGFAAY

SEQ ID NO: 13632 - protein, 7 aa, Artificial Sequence
  Synthetic construct
YWGFAQF

SEQ ID NO: 13633 - protein, 7 aa, Artificial Sequence
  Synthetic construct
YWGFAQY

SEQ ID NO: 13634 - protein, 7 aa, Artificial Sequence
  Synthetic construct
YWGFADF

SEQ ID NO: 13635 - protein, 7 aa, Artificial Sequence
  Synthetic construct
YWGFADY

SEQ ID NO: 13636 - protein, 7 aa, Artificial Sequence
  Synthetic construct
YWGFAVF

SEQ ID NO: 13637 - protein, 7 aa, Artificial Sequence
  Synthetic construct
YWGFAVY

SEQ ID NO: 13638 - protein, 7 aa, Artificial Sequence
  Synthetic construct
YWGFQFF

SEQ ID NO: 13639 - protein, 7 aa, Artificial Sequence
  Synthetic construct
YWGFQFY

SEQ ID NO: 13640 - protein, 7 aa, Artificial Sequence
  Synthetic construct
YWGFQRF

SEQ ID NO: 13641 - protein, 7 aa, Artificial Sequence
  Synthetic construct
YWGFQRY

SEQ ID NO: 13642 - protein, 7 aa, Artificial Sequence
  Synthetic construct
YWGFQCF

SEQ ID NO: 13643 - protein, 7 aa, Artificial Sequence
  Synthetic construct
YWGFQCY

SEQ ID NO: 13644 - protein, 7 aa, Artificial Sequence
  Synthetic construct
YWGFQLF

SEQ ID NO: 13645 - protein, 7 aa, Artificial Sequence
  Synthetic construct
YWGFQLY

SEQ ID NO: 13646 - protein, 7 aa, Artificial Sequence
  Synthetic construct
YWGFQAF

SEQ ID NO: 13647 - protein, 7 aa, Artificial Sequence
  Synthetic construct
YWGFQAY

SEQ ID NO: 13648 - protein, 7 aa, Artificial Sequence
  Synthetic construct
YWGFQQF

SEQ ID NO: 13649 - protein, 7 aa, Artificial Sequence
  Synthetic construct
YWGFQQY

SEQ ID NO: 13650 - protein, 7 aa, Artificial Sequence
  Synthetic construct
YWGFQDF

SEQ ID NO: 13651 - protein, 7 aa, Artificial Sequence
  Synthetic construct
YWGFQDY

SEQ ID NO: 13652 - protein, 7 aa, Artificial Sequence
  Synthetic construct
YWGFQVF

SEQ ID NO: 13653 - protein, 7 aa, Artificial Sequence
  Synthetic construct
YWGFQVY

SEQ ID NO: 13654 - protein, 7 aa, Artificial Sequence
  Synthetic construct
YVIYIFF

SEQ ID NO: 13655 - protein, 7 aa, Artificial Sequence
  Synthetic construct
YVIYIFY

SEQ ID NO: 13656 - protein, 7 aa, Artificial Sequence
  Synthetic construct
YVIYIRF

SEQ ID NO: 13657 - protein, 7 aa, Artificial Sequence
  Synthetic construct
YVIYIRY

SEQ ID NO: 13658 - protein, 7 aa, Artificial Sequence
  Synthetic construct
YVIYICF

SEQ ID NO: 13659 - protein, 7 aa, Artificial Sequence
  Synthetic construct
YVIYICY

SEQ ID NO: 13660 - protein, 7 aa, Artificial Sequence
  Synthetic construct
YVIYILF

SEQ ID NO: 13661 - protein, 7 aa, Artificial Sequence
  Synthetic construct
YVIYILY

SEQ ID NO: 13662 - protein, 7 aa, Artificial Sequence
  Synthetic construct
YVIYIAF

SEQ ID NO: 13663 - protein, 7 aa, Artificial Sequence
  Synthetic construct
YVIYIAY

SEQ ID NO: 13664 - protein, 7 aa, Artificial Sequence
  Synthetic construct
YVIYIQF

SEQ ID NO: 13665 - protein, 7 aa, Artificial Sequence
  Synthetic construct
YVIYIQY

SEQ ID NO: 13666 - protein, 7 aa, Artificial Sequence
  Synthetic construct
YVIYIDF

SEQ ID NO: 13667 - protein, 7 aa, Artificial Sequence
  Synthetic construct
YVIYIDY

SEQ ID NO: 13668 - protein, 7 aa, Artificial Sequence
  Synthetic construct
YVIYIVF

SEQ ID NO: 13669 - protein, 7 aa, Artificial Sequence
  Synthetic construct
YVIYIVY

SEQ ID NO: 13670 - protein, 7 aa, Artificial Sequence
  Synthetic construct
YVIYDFF

SEQ ID NO: 13671 - protein, 7 aa, Artificial Sequence
  Synthetic construct
YVIYDFY

SEQ ID NO: 13672 - protein, 7 aa, Artificial Sequence
  Synthetic construct
YVIYDRF

SEQ ID NO: 13673 - protein, 7 aa, Artificial Sequence
  Synthetic construct
YVIYDRY

SEQ ID NO: 13674 - protein, 7 aa, Artificial Sequence
  Synthetic construct
YVIYDCF

SEQ ID NO: 13675 - protein, 7 aa, Artificial Sequence
  Synthetic construct
YVIYDCY

SEQ ID NO: 13676 - protein, 7 aa, Artificial Sequence
  Synthetic construct
YVIYDLF

SEQ ID NO: 13677 - protein, 7 aa, Artificial Sequence
  Synthetic construct
YVIYDLY

SEQ ID NO: 13678 - protein, 7 aa, Artificial Sequence
  Synthetic construct
YVIYDAF

SEQ ID NO: 13679 - protein, 7 aa, Artificial Sequence
  Synthetic construct
YVIYDAY

SEQ ID NO: 13680 - protein, 7 aa, Artificial Sequence
  Synthetic construct
YVIYDQF

SEQ ID NO: 13681 - protein, 7 aa, Artificial Sequence
  Synthetic construct
YVIYDQY

SEQ ID NO: 13682 - protein, 7 aa, Artificial Sequence
  Synthetic construct
YVIYDDF

SEQ ID NO: 13683 - protein, 7 aa, Artificial Sequence
  Synthetic construct
YVIYDDY

SEQ ID NO: 13684 - protein, 7 aa, Artificial Sequence
  Synthetic construct
YVIYDVF

SEQ ID NO: 13685 - protein, 7 aa, Artificial Sequence
  Synthetic construct
YVIYDVY

SEQ ID NO: 13686 - protein, 7 aa, Artificial Sequence
  Synthetic construct
YVIYYFF

SEQ ID NO: 13687 - protein, 7 aa, Artificial Sequence
  Synthetic construct
YVIYYFY

SEQ ID NO: 13688 - protein, 7 aa, Artificial Sequence
  Synthetic construct
YVIYYRF

SEQ ID NO: 13689 - protein, 7 aa, Artificial Sequence
  Synthetic construct
YVIYYRY

SEQ ID NO: 13690 - protein, 7 aa, Artificial Sequence
  Synthetic construct
YVIYYCF

SEQ ID NO: 13691 - protein, 7 aa, Artificial Sequence
  Synthetic construct
YVIYYCY

SEQ ID NO: 13692 - protein, 7 aa, Artificial Sequence
  Synthetic construct
YVIYYLF

SEQ ID NO: 13693 - protein, 7 aa, Artificial Sequence
  Synthetic construct
YVIYYLY

SEQ ID NO: 13694 - protein, 7 aa, Artificial Sequence
  Synthetic construct
YVIYYAF

SEQ ID NO: 13695 - protein, 7 aa, Artificial Sequence
  Synthetic construct
YVIYYAY

SEQ ID NO: 13696 - protein, 7 aa, Artificial Sequence
  Synthetic construct
YVIYYQF

SEQ ID NO: 13697 - protein, 7 aa, Artificial Sequence
  Synthetic construct
YVIYYQY

SEQ ID NO: 13698 - protein, 7 aa, Artificial Sequence
  Synthetic construct
YVIYYDF

SEQ ID NO: 13699 - protein, 7 aa, Artificial Sequence
  Synthetic construct
YVIYYDY

SEQ ID NO: 13700 - protein, 7 aa, Artificial Sequence
  Synthetic construct
YVIYYVF

SEQ ID NO: 13701 - protein, 7 aa, Artificial Sequence
  Synthetic construct
YVIYYVY

SEQ ID NO: 13702 - protein, 7 aa, Artificial Sequence
  Synthetic construct
YVIYFFF

SEQ ID NO: 13703 - protein, 7 aa, Artificial Sequence
  Synthetic construct
YVIYFFY

SEQ ID NO: 13704 - protein, 7 aa, Artificial Sequence
  Synthetic construct
YVIYFRF

SEQ ID NO: 13705 - protein, 7 aa, Artificial Sequence
  Synthetic construct
YVIYFRY

SEQ ID NO: 13706 - protein, 7 aa, Artificial Sequence
  Synthetic construct
YVIYFCF

SEQ ID NO: 13707 - protein, 7 aa, Artificial Sequence
  Synthetic construct
YVIYFCY

SEQ ID NO: 13708 - protein, 7 aa, Artificial Sequence
  Synthetic construct
YVIYFLF

SEQ ID NO: 13709 - protein, 7 aa, Artificial Sequence
  Synthetic construct
YVIYFLY

SEQ ID NO: 13710 - protein, 7 aa, Artificial Sequence
  Synthetic construct
YVIYFAF

SEQ ID NO: 13711 - protein, 7 aa, Artificial Sequence
  Synthetic construct
YVIYFAY

SEQ ID NO: 13712 - protein, 7 aa, Artificial Sequence
  Synthetic construct
YVIYFQF

SEQ ID NO: 13713 - protein, 7 aa, Artificial Sequence
  Synthetic construct
YVIYFQY

SEQ ID NO: 13714 - protein, 7 aa, Artificial Sequence
  Synthetic construct
YVIYFDF

SEQ ID NO: 13715 - protein, 7 aa, Artificial Sequence
  Synthetic construct
YVIYFDY

SEQ ID NO: 13716 - protein, 7 aa, Artificial Sequence
  Synthetic construct
YVIYFVF

SEQ ID NO: 13717 - protein, 7 aa, Artificial Sequence
  Synthetic construct
YVIYFVY

SEQ ID NO: 13718 - protein, 7 aa, Artificial Sequence
  Synthetic construct
YVIYVFF

SEQ ID NO: 13719 - protein, 7 aa, Artificial Sequence
  Synthetic construct
YVIYVFY

SEQ ID NO: 13720 - protein, 7 aa, Artificial Sequence
  Synthetic construct
YVIYVRF

SEQ ID NO: 13721 - protein, 7 aa, Artificial Sequence
  Synthetic construct
YVIYVRY

SEQ ID NO: 13722 - protein, 7 aa, Artificial Sequence
  Synthetic construct
YVIYVCF

SEQ ID NO: 13723 - protein, 7 aa, Artificial Sequence
  Synthetic construct
YVIYVCY

SEQ ID NO: 13724 - protein, 7 aa, Artificial Sequence
  Synthetic construct
YVIYVLF

SEQ ID NO: 13725 - protein, 7 aa, Artificial Sequence
  Synthetic construct
YVIYVLY

SEQ ID NO: 13726 - protein, 7 aa, Artificial Sequence
  Synthetic construct
YVIYVAF

SEQ ID NO: 13727 - protein, 7 aa, Artificial Sequence
  Synthetic construct
YVIYVAY

SEQ ID NO: 13728 - protein, 7 aa, Artificial Sequence
  Synthetic construct
YVIYVQF

SEQ ID NO: 13729 - protein, 7 aa, Artificial Sequence
  Synthetic construct
YVIYVQY

SEQ ID NO: 13730 - protein, 7 aa, Artificial Sequence
  Synthetic construct
YVIYVDF

SEQ ID NO: 13731 - protein, 7 aa, Artificial Sequence
  Synthetic construct
YVIYVDY

SEQ ID NO: 13732 - protein, 7 aa, Artificial Sequence
  Synthetic construct
YVIYVVF

SEQ ID NO: 13733 - protein, 7 aa, Artificial Sequence
  Synthetic construct
YVIYVVY

SEQ ID NO: 13734 - protein, 7 aa, Artificial Sequence
  Synthetic construct
YVIYTFF

SEQ ID NO: 13735 - protein, 7 aa, Artificial Sequence
  Synthetic construct
YVIYTFY

SEQ ID NO: 13736 - protein, 7 aa, Artificial Sequence
  Synthetic construct
YVIYTRF

SEQ ID NO: 13737 - protein, 7 aa, Artificial Sequence
  Synthetic construct
YVIYTRY

SEQ ID NO: 13738 - protein, 7 aa, Artificial Sequence
  Synthetic construct
YVIYTCF

SEQ ID NO: 13739 - protein, 7 aa, Artificial Sequence
  Synthetic construct
YVIYTCY

SEQ ID NO: 13740 - protein, 7 aa, Artificial Sequence
  Synthetic construct
YVIYTLF

SEQ ID NO: 13741 - protein, 7 aa, Artificial Sequence
  Synthetic construct
YVIYTLY

SEQ ID NO: 13742 - protein, 7 aa, Artificial Sequence
  Synthetic construct
YVIYTAF

SEQ ID NO: 13743 - protein, 7 aa, Artificial Sequence
  Synthetic construct
YVIYTAY

SEQ ID NO: 13744 - protein, 7 aa, Artificial Sequence
  Synthetic construct
YVIYTQF

SEQ ID NO: 13745 - protein, 7 aa, Artificial Sequence
  Synthetic construct
YVIYTQY

SEQ ID NO: 13746 - protein, 7 aa, Artificial Sequence
  Synthetic construct
YVIYTDF

SEQ ID NO: 13747 - protein, 7 aa, Artificial Sequence
  Synthetic construct
YVIYTDY

SEQ ID NO: 13748 - protein, 7 aa, Artificial Sequence
  Synthetic construct
YVIYTVF

SEQ ID NO: 13749 - protein, 7 aa, Artificial Sequence
  Synthetic construct
YVIYTVY

SEQ ID NO: 13750 - protein, 7 aa, Artificial Sequence
  Synthetic construct
YVIYGFF

SEQ ID NO: 13751 - protein, 7 aa, Artificial Sequence
  Synthetic construct
YVIYGFY

SEQ ID NO: 13752 - protein, 7 aa, Artificial Sequence
  Synthetic construct
YVIYGRF

SEQ ID NO: 13753 - protein, 7 aa, Artificial Sequence
  Synthetic construct
YVIYGRY

SEQ ID NO: 13754 - protein, 7 aa, Artificial Sequence
  Synthetic construct
YVIYGCF

SEQ ID NO: 13755 - protein, 7 aa, Artificial Sequence
  Synthetic construct
YVIYGCY

SEQ ID NO: 13756 - protein, 7 aa, Artificial Sequence
  Synthetic construct
YVIYGLF

SEQ ID NO: 13757 - protein, 7 aa, Artificial Sequence
  Synthetic construct
YVIYGLY

SEQ ID NO: 13758 - protein, 7 aa, Artificial Sequence
  Synthetic construct
YVIYGAF

SEQ ID NO: 13759 - protein, 7 aa, Artificial Sequence
  Synthetic construct
YVIYGAY

SEQ ID NO: 13760 - protein, 7 aa, Artificial Sequence
  Synthetic construct
YVIYGQF

SEQ ID NO: 13761 - protein, 7 aa, Artificial Sequence
  Synthetic construct
YVIYGQY

SEQ ID NO: 13762 - protein, 7 aa, Artificial Sequence
  Synthetic construct
YVIYGDF

SEQ ID NO: 13763 - protein, 7 aa, Artificial Sequence
  Synthetic construct
YVIYGDY

SEQ ID NO: 13764 - protein, 7 aa, Artificial Sequence
  Synthetic construct
YVIYGVF

SEQ ID NO: 13765 - protein, 7 aa, Artificial Sequence
  Synthetic construct
YVIYGVY

SEQ ID NO: 13766 - protein, 7 aa, Artificial Sequence
  Synthetic construct
YVIYAFF

SEQ ID NO: 13767 - protein, 7 aa, Artificial Sequence
  Synthetic construct
YVIYAFY

SEQ ID NO: 13768 - protein, 7 aa, Artificial Sequence
  Synthetic construct
YVIYARF

SEQ ID NO: 13769 - protein, 7 aa, Artificial Sequence
  Synthetic construct
YVIYARY

SEQ ID NO: 13770 - protein, 7 aa, Artificial Sequence
  Synthetic construct
YVIYACF

SEQ ID NO: 13771 - protein, 7 aa, Artificial Sequence
  Synthetic construct
YVIYACY

SEQ ID NO: 13772 - protein, 7 aa, Artificial Sequence
  Synthetic construct
YVIYALF

SEQ ID NO: 13773 - protein, 7 aa, Artificial Sequence
  Synthetic construct
YVIYALY

SEQ ID NO: 13774 - protein, 7 aa, Artificial Sequence
  Synthetic construct
YVIYAAF

SEQ ID NO: 13775 - protein, 7 aa, Artificial Sequence
  Synthetic construct
YVIYAAY

SEQ ID NO: 13776 - protein, 7 aa, Artificial Sequence
  Synthetic construct
YVIYAQF

SEQ ID NO: 13777 - protein, 7 aa, Artificial Sequence
  Synthetic construct
YVIYAQY

SEQ ID NO: 13778 - protein, 7 aa, Artificial Sequence
  Synthetic construct
YVIYADF

SEQ ID NO: 13779 - protein, 7 aa, Artificial Sequence
  Synthetic construct
YVIYADY

SEQ ID NO: 13780 - protein, 7 aa, Artificial Sequence
  Synthetic construct
YVIYAVF

SEQ ID NO: 13781 - protein, 7 aa, Artificial Sequence
  Synthetic construct
YVIYAVY

SEQ ID NO: 13782 - protein, 7 aa, Artificial Sequence
  Synthetic construct
YVIYQFF

SEQ ID NO: 13783 - protein, 7 aa, Artificial Sequence
  Synthetic construct
YVIYQFY

SEQ ID NO: 13784 - protein, 7 aa, Artificial Sequence
  Synthetic construct
YVIYQRF

SEQ ID NO: 13785 - protein, 7 aa, Artificial Sequence
  Synthetic construct
YVIYQRY

SEQ ID NO: 13786 - protein, 7 aa, Artificial Sequence
  Synthetic construct
YVIYQCF

SEQ ID NO: 13787 - protein, 7 aa, Artificial Sequence
  Synthetic construct
YVIYQCY

SEQ ID NO: 13788 - protein, 7 aa, Artificial Sequence
  Synthetic construct
YVIYQLF

SEQ ID NO: 13789 - protein, 7 aa, Artificial Sequence
  Synthetic construct
YVIYQLY

SEQ ID NO: 13790 - protein, 7 aa, Artificial Sequence
  Synthetic construct
YVIYQAF

SEQ ID NO: 13791 - protein, 7 aa, Artificial Sequence
  Synthetic construct
YVIYQAY

SEQ ID NO: 13792 - protein, 7 aa, Artificial Sequence
  Synthetic construct
YVIYQQF

SEQ ID NO: 13793 - protein, 7 aa, Artificial Sequence
  Synthetic construct
YVIYQQY

SEQ ID NO: 13794 - protein, 7 aa, Artificial Sequence
  Synthetic construct
YVIYQDF

SEQ ID NO: 13795 - protein, 7 aa, Artificial Sequence
  Synthetic construct
YVIYQDY

SEQ ID NO: 13796 - protein, 7 aa, Artificial Sequence
  Synthetic construct
YVIYQVF

SEQ ID NO: 13797 - protein, 7 aa, Artificial Sequence
  Synthetic construct
YVIYQVY

SEQ ID NO: 13798 - protein, 7 aa, Artificial Sequence
  Synthetic construct
YVIPIFF

SEQ ID NO: 13799 - protein, 7 aa, Artificial Sequence
  Synthetic construct
YVIPIFY

SEQ ID NO: 13800 - protein, 7 aa, Artificial Sequence
  Synthetic construct
YVIPIRF

SEQ ID NO: 13801 - protein, 7 aa, Artificial Sequence
  Synthetic construct
YVIPIRY

SEQ ID NO: 13802 - protein, 7 aa, Artificial Sequence
  Synthetic construct
YVIPICF

SEQ ID NO: 13803 - protein, 7 aa, Artificial Sequence
  Synthetic construct
YVIPICY

SEQ ID NO: 13804 - protein, 7 aa, Artificial Sequence
  Synthetic construct
YVIPILF

SEQ ID NO: 13805 - protein, 7 aa, Artificial Sequence
  Synthetic construct
YVIPILY

SEQ ID NO: 13806 - protein, 7 aa, Artificial Sequence
  Synthetic construct
YVIPIAF

SEQ ID NO: 13807 - protein, 7 aa, Artificial Sequence
  Synthetic construct
YVIPIAY

SEQ ID NO: 13808 - protein, 7 aa, Artificial Sequence
  Synthetic construct
YVIPIQF

SEQ ID NO: 13809 - protein, 7 aa, Artificial Sequence
  Synthetic construct
YVIPIQY

SEQ ID NO: 13810 - protein, 7 aa, Artificial Sequence
  Synthetic construct
YVIPIDF

SEQ ID NO: 13811 - protein, 7 aa, Artificial Sequence
  Synthetic construct
YVIPIDY

SEQ ID NO: 13812 - protein, 7 aa, Artificial Sequence
  Synthetic construct
YVIPIVF

SEQ ID NO: 13813 - protein, 7 aa, Artificial Sequence
  Synthetic construct
YVIPIVY

SEQ ID NO: 13814 - protein, 7 aa, Artificial Sequence
  Synthetic construct
YVIPDFF

SEQ ID NO: 13815 - protein, 7 aa, Artificial Sequence
  Synthetic construct
YVIPDFY

SEQ ID NO: 13816 - protein, 7 aa, Artificial Sequence
  Synthetic construct
YVIPDRF

SEQ ID NO: 13817 - protein, 7 aa, Artificial Sequence
  Synthetic construct
YVIPDRY

SEQ ID NO: 13818 - protein, 7 aa, Artificial Sequence
  Synthetic construct
YVIPDCF

SEQ ID NO: 13819 - protein, 7 aa, Artificial Sequence
  Synthetic construct
YVIPDCY

SEQ ID NO: 13820 - protein, 7 aa, Artificial Sequence
  Synthetic construct
YVIPDLF

SEQ ID NO: 13821 - protein, 7 aa, Artificial Sequence
  Synthetic construct
YVIPDLY

SEQ ID NO: 13822 - protein, 7 aa, Artificial Sequence
  Synthetic construct
YVIPDAF

SEQ ID NO: 13823 - protein, 7 aa, Artificial Sequence
  Synthetic construct
YVIPDAY

SEQ ID NO: 13824 - protein, 7 aa, Artificial Sequence
  Synthetic construct
YVIPDQF

SEQ ID NO: 13825 - protein, 7 aa, Artificial Sequence
  Synthetic construct
YVIPDQY

SEQ ID NO: 13826 - protein, 7 aa, Artificial Sequence
  Synthetic construct
YVIPDDF

SEQ ID NO: 13827 - protein, 7 aa, Artificial Sequence
  Synthetic construct
YVIPDDY

SEQ ID NO: 13828 - protein, 7 aa, Artificial Sequence
  Synthetic construct
YVIPDVF

SEQ ID NO: 13829 - protein, 7 aa, Artificial Sequence
  Synthetic construct
YVIPDVY

SEQ ID NO: 13830 - protein, 7 aa, Artificial Sequence
  Synthetic construct
YVIPYFF

SEQ ID NO: 13831 - protein, 7 aa, Artificial Sequence
  Synthetic construct
YVIPYFY

SEQ ID NO: 13832 - protein, 7 aa, Artificial Sequence
  Synthetic construct
YVIPYRF

SEQ ID NO: 13833 - protein, 7 aa, Artificial Sequence
  Synthetic construct
YVIPYRY

SEQ ID NO: 13834 - protein, 7 aa, Artificial Sequence
  Synthetic construct
YVIPYCF

SEQ ID NO: 13835 - protein, 7 aa, Artificial Sequence
  Synthetic construct
YVIPYCY

SEQ ID NO: 13836 - protein, 7 aa, Artificial Sequence
  Synthetic construct
YVIPYLF

SEQ ID NO: 13837 - protein, 7 aa, Artificial Sequence
  Synthetic construct
YVIPYLY

SEQ ID NO: 13838 - protein, 7 aa, Artificial Sequence
  Synthetic construct
YVIPYAF

SEQ ID NO: 13839 - protein, 7 aa, Artificial Sequence
  Synthetic construct
YVIPYAY

SEQ ID NO: 13840 - protein, 7 aa, Artificial Sequence
  Synthetic construct
YVIPYQF

SEQ ID NO: 13841 - protein, 7 aa, Artificial Sequence
  Synthetic construct
YVIPYQY

SEQ ID NO: 13842 - protein, 7 aa, Artificial Sequence
  Synthetic construct
YVIPYDF

SEQ ID NO: 13843 - protein, 7 aa, Artificial Sequence
  Synthetic construct
YVIPYDY

SEQ ID NO: 13844 - protein, 7 aa, Artificial Sequence
  Synthetic construct
YVIPYVF

SEQ ID NO: 13845 - protein, 7 aa, Artificial Sequence
  Synthetic construct
YVIPYVY

SEQ ID NO: 13846 - protein, 7 aa, Artificial Sequence
  Synthetic construct
YVIPFFF

SEQ ID NO: 13847 - protein, 7 aa, Artificial Sequence
  Synthetic construct
YVIPFFY

SEQ ID NO: 13848 - protein, 7 aa, Artificial Sequence
  Synthetic construct
YVIPFRF

SEQ ID NO: 13849 - protein, 7 aa, Artificial Sequence
  Synthetic construct
YVIPFRY

SEQ ID NO: 13850 - protein, 7 aa, Artificial Sequence
  Synthetic construct
YVIPFCF

SEQ ID NO: 13851 - protein, 7 aa, Artificial Sequence
  Synthetic construct
YVIPFCY

SEQ ID NO: 13852 - protein, 7 aa, Artificial Sequence
  Synthetic construct
YVIPFLF

SEQ ID NO: 13853 - protein, 7 aa, Artificial Sequence
  Synthetic construct
YVIPFLY

SEQ ID NO: 13854 - protein, 7 aa, Artificial Sequence
  Synthetic construct
YVIPFAF

SEQ ID NO: 13855 - protein, 7 aa, Artificial Sequence
  Synthetic construct
YVIPFAY

SEQ ID NO: 13856 - protein, 7 aa, Artificial Sequence
  Synthetic construct
YVIPFQF

SEQ ID NO: 13857 - protein, 7 aa, Artificial Sequence
  Synthetic construct
YVIPFQY

SEQ ID NO: 13858 - protein, 7 aa, Artificial Sequence
  Synthetic construct
YVIPFDF

SEQ ID NO: 13859 - protein, 7 aa, Artificial Sequence
  Synthetic construct
YVIPFDY

SEQ ID NO: 13860 - protein, 7 aa, Artificial Sequence
  Synthetic construct
YVIPFVF

SEQ ID NO: 13861 - protein, 7 aa, Artificial Sequence
  Synthetic construct
YVIPFVY

SEQ ID NO: 13862 - protein, 7 aa, Artificial Sequence
  Synthetic construct
YVIPVFF

SEQ ID NO: 13863 - protein, 7 aa, Artificial Sequence
  Synthetic construct
YVIPVFY

SEQ ID NO: 13864 - protein, 7 aa, Artificial Sequence
  Synthetic construct
YVIPVRF

SEQ ID NO: 13865 - protein, 7 aa, Artificial Sequence
  Synthetic construct
YVIPVRY

SEQ ID NO: 13866 - protein, 7 aa, Artificial Sequence
  Synthetic construct
YVIPVCF

SEQ ID NO: 13867 - protein, 7 aa, Artificial Sequence
  Synthetic construct
YVIPVCY

SEQ ID NO: 13868 - protein, 7 aa, Artificial Sequence
  Synthetic construct
YVIPVLF

SEQ ID NO: 13869 - protein, 7 aa, Artificial Sequence
  Synthetic construct
YVIPVLY

SEQ ID NO: 13870 - protein, 7 aa, Artificial Sequence
  Synthetic construct
YVIPVAF

SEQ ID NO: 13871 - protein, 7 aa, Artificial Sequence
  Synthetic construct
YVIPVAY

SEQ ID NO: 13872 - protein, 7 aa, Artificial Sequence
  Synthetic construct
YVIPVQF

SEQ ID NO: 13873 - protein, 7 aa, Artificial Sequence
  Synthetic construct
YVIPVQY

SEQ ID NO: 13874 - protein, 7 aa, Artificial Sequence
  Synthetic construct
YVIPVDF

SEQ ID NO: 13875 - protein, 7 aa, Artificial Sequence
  Synthetic construct
YVIPVDY

SEQ ID NO: 13876 - protein, 7 aa, Artificial Sequence
  Synthetic construct
YVIPVVF

SEQ ID NO: 13877 - protein, 7 aa, Artificial Sequence
  Synthetic construct
YVIPVVY

SEQ ID NO: 13878 - protein, 7 aa, Artificial Sequence
  Synthetic construct
YVIPTFF

SEQ ID NO: 13879 - protein, 7 aa, Artificial Sequence
  Synthetic construct
YVIPTFY

SEQ ID NO: 13880 - protein, 7 aa, Artificial Sequence
  Synthetic construct
YVIPTRF

SEQ ID NO: 13881 - protein, 7 aa, Artificial Sequence
  Synthetic construct
YVIPTRY

SEQ ID NO: 13882 - protein, 7 aa, Artificial Sequence
  Synthetic construct
YVIPTCF

SEQ ID NO: 13883 - protein, 7 aa, Artificial Sequence
  Synthetic construct
YVIPTCY

SEQ ID NO: 13884 - protein, 7 aa, Artificial Sequence
  Synthetic construct
YVIPTLF

SEQ ID NO: 13885 - protein, 7 aa, Artificial Sequence
  Synthetic construct
YVIPTLY

SEQ ID NO: 13886 - protein, 7 aa, Artificial Sequence
  Synthetic construct
YVIPTAF

SEQ ID NO: 13887 - protein, 7 aa, Artificial Sequence
  Synthetic construct
YVIPTAY

SEQ ID NO: 13888 - protein, 7 aa, Artificial Sequence
  Synthetic construct
YVIPTQF

SEQ ID NO: 13889 - protein, 7 aa, Artificial Sequence
  Synthetic construct
YVIPTQY

SEQ ID NO: 13890 - protein, 7 aa, Artificial Sequence
  Synthetic construct
YVIPTDF

SEQ ID NO: 13891 - protein, 7 aa, Artificial Sequence
  Synthetic construct
YVIPTDY

SEQ ID NO: 13892 - protein, 7 aa, Artificial Sequence
  Synthetic construct
YVIPTVF

SEQ ID NO: 13893 - protein, 7 aa, Artificial Sequence
  Synthetic construct
YVIPTVY

SEQ ID NO: 13894 - protein, 7 aa, Artificial Sequence
  Synthetic construct
YVIPGFF

SEQ ID NO: 13895 - protein, 7 aa, Artificial Sequence
  Synthetic construct
YVIPGFY

SEQ ID NO: 13896 - protein, 7 aa, Artificial Sequence
  Synthetic construct
YVIPGRF

SEQ ID NO: 13897 - protein, 7 aa, Artificial Sequence
  Synthetic construct
YVIPGRY

SEQ ID NO: 13898 - protein, 7 aa, Artificial Sequence
  Synthetic construct
YVIPGCF

SEQ ID NO: 13899 - protein, 7 aa, Artificial Sequence
  Synthetic construct
YVIPGCY

SEQ ID NO: 13900 - protein, 7 aa, Artificial Sequence
  Synthetic construct
YVIPGLF

SEQ ID NO: 13901 - protein, 7 aa, Artificial Sequence
  Synthetic construct
YVIPGLY

SEQ ID NO: 13902 - protein, 7 aa, Artificial Sequence
  Synthetic construct
YVIPGAF

SEQ ID NO: 13903 - protein, 7 aa, Artificial Sequence
  Synthetic construct
YVIPGAY

SEQ ID NO: 13904 - protein, 7 aa, Artificial Sequence
  Synthetic construct
YVIPGQF

SEQ ID NO: 13905 - protein, 7 aa, Artificial Sequence
  Synthetic construct
YVIPGQY

SEQ ID NO: 13906 - protein, 7 aa, Artificial Sequence
  Synthetic construct
YVIPGDF

SEQ ID NO: 13907 - protein, 7 aa, Artificial Sequence
  Synthetic construct
YVIPGDY

SEQ ID NO: 13908 - protein, 7 aa, Artificial Sequence
  Synthetic construct
YVIPGVF

SEQ ID NO: 13909 - protein, 7 aa, Artificial Sequence
  Synthetic construct
YVIPGVY

SEQ ID NO: 13910 - protein, 7 aa, Artificial Sequence
  Synthetic construct
YVIPAFF

SEQ ID NO: 13911 - protein, 7 aa, Artificial Sequence
  Synthetic construct
YVIPAFY

SEQ ID NO: 13912 - protein, 7 aa, Artificial Sequence
  Synthetic construct
YVIPARF

SEQ ID NO: 13913 - protein, 7 aa, Artificial Sequence
  Synthetic construct
YVIPARY

SEQ ID NO: 13914 - protein, 7 aa, Artificial Sequence
  Synthetic construct
YVIPACF

SEQ ID NO: 13915 - protein, 7 aa, Artificial Sequence
  Synthetic construct
YVIPACY

SEQ ID NO: 13916 - protein, 7 aa, Artificial Sequence
  Synthetic construct
YVIPALF

SEQ ID NO: 13917 - protein, 7 aa, Artificial Sequence
  Synthetic construct
YVIPALY

SEQ ID NO: 13918 - protein, 7 aa, Artificial Sequence
  Synthetic construct
YVIPAAF

SEQ ID NO: 13919 - protein, 7 aa, Artificial Sequence
  Synthetic construct
YVIPAAY

SEQ ID NO: 13920 - protein, 7 aa, Artificial Sequence
  Synthetic construct
YVIPAQF

SEQ ID NO: 13921 - protein, 7 aa, Artificial Sequence
  Synthetic construct
YVIPAQY

SEQ ID NO: 13922 - protein, 7 aa, Artificial Sequence
  Synthetic construct
YVIPADF

SEQ ID NO: 13923 - protein, 7 aa, Artificial Sequence
  Synthetic construct
YVIPADY

SEQ ID NO: 13924 - protein, 7 aa, Artificial Sequence
  Synthetic construct
YVIPAVF

SEQ ID NO: 13925 - protein, 7 aa, Artificial Sequence
  Synthetic construct
YVIPAVY

SEQ ID NO: 13926 - protein, 7 aa, Artificial Sequence
  Synthetic construct
YVIPQFF

SEQ ID NO: 13927 - protein, 7 aa, Artificial Sequence
  Synthetic construct
YVIPQFY

SEQ ID NO: 13928 - protein, 7 aa, Artificial Sequence
  Synthetic construct
YVIPQRF

SEQ ID NO: 13929 - protein, 7 aa, Artificial Sequence
  Synthetic construct
YVIPQRY

SEQ ID NO: 13930 - protein, 7 aa, Artificial Sequence
  Synthetic construct
YVIPQCF

SEQ ID NO: 13931 - protein, 7 aa, Artificial Sequence
  Synthetic construct
YVIPQCY

SEQ ID NO: 13932 - protein, 7 aa, Artificial Sequence
  Synthetic construct
YVIPQLF

SEQ ID NO: 13933 - protein, 7 aa, Artificial Sequence
  Synthetic construct
YVIPQLY

SEQ ID NO: 13934 - protein, 7 aa, Artificial Sequence
  Synthetic construct
YVIPQAF

SEQ ID NO: 13935 - protein, 7 aa, Artificial Sequence
  Synthetic construct
YVIPQAY

SEQ ID NO: 13936 - protein, 7 aa, Artificial Sequence
  Synthetic construct
YVIPQQF

SEQ ID NO: 13937 - protein, 7 aa, Artificial Sequence
  Synthetic construct
YVIPQQY

SEQ ID NO: 13938 - protein, 7 aa, Artificial Sequence
  Synthetic construct
YVIPQDF

SEQ ID NO: 13939 - protein, 7 aa, Artificial Sequence
  Synthetic construct
YVIPQDY

SEQ ID NO: 13940 - protein, 7 aa, Artificial Sequence
  Synthetic construct
YVIPQVF

SEQ ID NO: 13941 - protein, 7 aa, Artificial Sequence
  Synthetic construct
YVIPQVY

SEQ ID NO: 13942 - protein, 7 aa, Artificial Sequence
  Synthetic construct
YVIHIFF

SEQ ID NO: 13943 - protein, 7 aa, Artificial Sequence
  Synthetic construct
YVIHIFY

SEQ ID NO: 13944 - protein, 7 aa, Artificial Sequence
  Synthetic construct
YVIHIRF

SEQ ID NO: 13945 - protein, 7 aa, Artificial Sequence
  Synthetic construct
YVIHIRY

SEQ ID NO: 13946 - protein, 7 aa, Artificial Sequence
  Synthetic construct
YVIHICF

SEQ ID NO: 13947 - protein, 7 aa, Artificial Sequence
  Synthetic construct
YVIHICY

SEQ ID NO: 13948 - protein, 7 aa, Artificial Sequence
  Synthetic construct
YVIHILF

SEQ ID NO: 13949 - protein, 7 aa, Artificial Sequence
  Synthetic construct
YVIHILY

SEQ ID NO: 13950 - protein, 7 aa, Artificial Sequence
  Synthetic construct
YVIHIAF

SEQ ID NO: 13951 - protein, 7 aa, Artificial Sequence
  Synthetic construct
YVIHIAY

SEQ ID NO: 13952 - protein, 7 aa, Artificial Sequence
  Synthetic construct
YVIHIQF

SEQ ID NO: 13953 - protein, 7 aa, Artificial Sequence
  Synthetic construct
YVIHIQY

SEQ ID NO: 13954 - protein, 7 aa, Artificial Sequence
  Synthetic construct
YVIHIDF

SEQ ID NO: 13955 - protein, 7 aa, Artificial Sequence
  Synthetic construct
YVIHIDY

SEQ ID NO: 13956 - protein, 7 aa, Artificial Sequence
  Synthetic construct
YVIHIVF

SEQ ID NO: 13957 - protein, 7 aa, Artificial Sequence
  Synthetic construct
YVIHIVY

SEQ ID NO: 13958 - protein, 7 aa, Artificial Sequence
  Synthetic construct
YVIHDFF

SEQ ID NO: 13959 - protein, 7 aa, Artificial Sequence
  Synthetic construct
YVIHDFY

SEQ ID NO: 13960 - protein, 7 aa, Artificial Sequence
  Synthetic construct
YVIHDRF

SEQ ID NO: 13961 - protein, 7 aa, Artificial Sequence
  Synthetic construct
YVIHDRY

SEQ ID NO: 13962 - protein, 7 aa, Artificial Sequence
  Synthetic construct
YVIHDCF

SEQ ID NO: 13963 - protein, 7 aa, Artificial Sequence
  Synthetic construct
YVIHDCY

SEQ ID NO: 13964 - protein, 7 aa, Artificial Sequence
  Synthetic construct
YVIHDLF

SEQ ID NO: 13965 - protein, 7 aa, Artificial Sequence
  Synthetic construct
YVIHDLY

SEQ ID NO: 13966 - protein, 7 aa, Artificial Sequence
  Synthetic construct
YVIHDAF

SEQ ID NO: 13967 - protein, 7 aa, Artificial Sequence
  Synthetic construct
YVIHDAY

SEQ ID NO: 13968 - protein, 7 aa, Artificial Sequence
  Synthetic construct
YVIHDQF

SEQ ID NO: 13969 - protein, 7 aa, Artificial Sequence
  Synthetic construct
YVIHDQY

SEQ ID NO: 13970 - protein, 7 aa, Artificial Sequence
  Synthetic construct
YVIHDDF

SEQ ID NO: 13971 - protein, 7 aa, Artificial Sequence
  Synthetic construct
YVIHDDY

SEQ ID NO: 13972 - protein, 7 aa, Artificial Sequence
  Synthetic construct
YVIHDVF

SEQ ID NO: 13973 - protein, 7 aa, Artificial Sequence
  Synthetic construct
YVIHDVY

SEQ ID NO: 13974 - protein, 7 aa, Artificial Sequence
  Synthetic construct
YVIHYFF

SEQ ID NO: 13975 - protein, 7 aa, Artificial Sequence
  Synthetic construct
YVIHYFY

SEQ ID NO: 13976 - protein, 7 aa, Artificial Sequence
  Synthetic construct
YVIHYRF

SEQ ID NO: 13977 - protein, 7 aa, Artificial Sequence
  Synthetic construct
YVIHYRY

SEQ ID NO: 13978 - protein, 7 aa, Artificial Sequence
  Synthetic construct
YVIHYCF

SEQ ID NO: 13979 - protein, 7 aa, Artificial Sequence
  Synthetic construct
YVIHYCY

SEQ ID NO: 13980 - protein, 7 aa, Artificial Sequence
  Synthetic construct
YVIHYLF

SEQ ID NO: 13981 - protein, 7 aa, Artificial Sequence
  Synthetic construct
YVIHYLY

SEQ ID NO: 13982 - protein, 7 aa, Artificial Sequence
  Synthetic construct
YVIHYAF

SEQ ID NO: 13983 - protein, 7 aa, Artificial Sequence
  Synthetic construct
YVIHYAY

SEQ ID NO: 13984 - protein, 7 aa, Artificial Sequence
  Synthetic construct
YVIHYQF

SEQ ID NO: 13985 - protein, 7 aa, Artificial Sequence
  Synthetic construct
YVIHYQY

SEQ ID NO: 13986 - protein, 7 aa, Artificial Sequence
  Synthetic construct
YVIHYDF

SEQ ID NO: 13987 - protein, 7 aa, Artificial Sequence
  Synthetic construct
YVIHYDY

SEQ ID NO: 13988 - protein, 7 aa, Artificial Sequence
  Synthetic construct
YVIHYVF

SEQ ID NO: 13989 - protein, 7 aa, Artificial Sequence
  Synthetic construct
YVIHYVY

SEQ ID NO: 13990 - protein, 7 aa, Artificial Sequence
  Synthetic construct
YVIHFFF

SEQ ID NO: 13991 - protein, 7 aa, Artificial Sequence
  Synthetic construct
YVIHFFY

SEQ ID NO: 13992 - protein, 7 aa, Artificial Sequence
  Synthetic construct
YVIHFRF

SEQ ID NO: 13993 - protein, 7 aa, Artificial Sequence
  Synthetic construct
YVIHFRY

SEQ ID NO: 13994 - protein, 7 aa, Artificial Sequence
  Synthetic construct
YVIHFCF

SEQ ID NO: 13995 - protein, 7 aa, Artificial Sequence
  Synthetic construct
YVIHFCY

SEQ ID NO: 13996 - protein, 7 aa, Artificial Sequence
  Synthetic construct
YVIHFLF

SEQ ID NO: 13997 - protein, 7 aa, Artificial Sequence
  Synthetic construct
YVIHFLY

SEQ ID NO: 13998 - protein, 7 aa, Artificial Sequence
  Synthetic construct
YVIHFAF

SEQ ID NO: 13999 - protein, 7 aa, Artificial Sequence
  Synthetic construct
YVIHFAY

SEQ ID NO: 14000 - protein, 7 aa, Artificial Sequence
  Synthetic construct
YVIHFQF

SEQ ID NO: 14001 - protein, 7 aa, Artificial Sequence
  Synthetic construct
YVIHFQY

SEQ ID NO: 14002 - protein, 7 aa, Artificial Sequence
  Synthetic construct
YVIHFDF

SEQ ID NO: 14003 - protein, 7 aa, Artificial Sequence
  Synthetic construct
YVIHFDY

SEQ ID NO: 14004 - protein, 7 aa, Artificial Sequence
  Synthetic construct
YVIHFVF

SEQ ID NO: 14005 - protein, 7 aa, Artificial Sequence
  Synthetic construct
YVIHFVY

SEQ ID NO: 14006 - protein, 7 aa, Artificial Sequence
  Synthetic construct
YVIHVFF

SEQ ID NO: 14007 - protein, 7 aa, Artificial Sequence
  Synthetic construct
YVIHVFY

SEQ ID NO: 14008 - protein, 7 aa, Artificial Sequence
  Synthetic construct
YVIHVRF

SEQ ID NO: 14009 - protein, 7 aa, Artificial Sequence
  Synthetic construct
YVIHVRY

SEQ ID NO: 14010 - protein, 7 aa, Artificial Sequence
  Synthetic construct
YVIHVCF

SEQ ID NO: 14011 - protein, 7 aa, Artificial Sequence
  Synthetic construct
YVIHVCY

SEQ ID NO: 14012 - protein, 7 aa, Artificial Sequence
  Synthetic construct
YVIHVLF

SEQ ID NO: 14013 - protein, 7 aa, Artificial Sequence
  Synthetic construct
YVIHVLY

SEQ ID NO: 14014 - protein, 7 aa, Artificial Sequence
  Synthetic construct
YVIHVAF

SEQ ID NO: 14015 - protein, 7 aa, Artificial Sequence
  Synthetic construct
YVIHVAY

SEQ ID NO: 14016 - protein, 7 aa, Artificial Sequence
  Synthetic construct
YVIHVQF

SEQ ID NO: 14017 - protein, 7 aa, Artificial Sequence
  Synthetic construct
YVIHVQY

SEQ ID NO: 14018 - protein, 7 aa, Artificial Sequence
  Synthetic construct
YVIHVDF

SEQ ID NO: 14019 - protein, 7 aa, Artificial Sequence
  Synthetic construct
YVIHVDY

SEQ ID NO: 14020 - protein, 7 aa, Artificial Sequence
  Synthetic construct
YVIHVVF

SEQ ID NO: 14021 - protein, 7 aa, Artificial Sequence
  Synthetic construct
YVIHVVY

SEQ ID NO: 14022 - protein, 7 aa, Artificial Sequence
  Synthetic construct
YVIHTFF

SEQ ID NO: 14023 - protein, 7 aa, Artificial Sequence
  Synthetic construct
YVIHTFY

SEQ ID NO: 14024 - protein, 7 aa, Artificial Sequence
  Synthetic construct
YVIHTRF

SEQ ID NO: 14025 - protein, 7 aa, Artificial Sequence
  Synthetic construct
YVIHTRY

SEQ ID NO: 14026 - protein, 7 aa, Artificial Sequence
  Synthetic construct
YVIHTCF

SEQ ID NO: 14027 - protein, 7 aa, Artificial Sequence
  Synthetic construct
YVIHTCY

SEQ ID NO: 14028 - protein, 7 aa, Artificial Sequence
  Synthetic construct
YVIHTLF

SEQ ID NO: 14029 - protein, 7 aa, Artificial Sequence
  Synthetic construct
YVIHTLY

SEQ ID NO: 14030 - protein, 7 aa, Artificial Sequence
  Synthetic construct
YVIHTAF

SEQ ID NO: 14031 - protein, 7 aa, Artificial Sequence
  Synthetic construct
YVIHTAY

SEQ ID NO: 14032 - protein, 7 aa, Artificial Sequence
  Synthetic construct
YVIHTQF

SEQ ID NO: 14033 - protein, 7 aa, Artificial Sequence
  Synthetic construct
YVIHTQY

SEQ ID NO: 14034 - protein, 7 aa, Artificial Sequence
  Synthetic construct
YVIHTDF

SEQ ID NO: 14035 - protein, 7 aa, Artificial Sequence
  Synthetic construct
YVIHTDY

SEQ ID NO: 14036 - protein, 7 aa, Artificial Sequence
  Synthetic construct
YVIHTVF

SEQ ID NO: 14037 - protein, 7 aa, Artificial Sequence
  Synthetic construct
YVIHTVY

SEQ ID NO: 14038 - protein, 7 aa, Artificial Sequence
  Synthetic construct
YVIHGFF

SEQ ID NO: 14039 - protein, 7 aa, Artificial Sequence
  Synthetic construct
YVIHGFY

SEQ ID NO: 14040 - protein, 7 aa, Artificial Sequence
  Synthetic construct
YVIHGRF

SEQ ID NO: 14041 - protein, 7 aa, Artificial Sequence
  Synthetic construct
YVIHGRY

SEQ ID NO: 14042 - protein, 7 aa, Artificial Sequence
  Synthetic construct
YVIHGCF

SEQ ID NO: 14043 - protein, 7 aa, Artificial Sequence
  Synthetic construct
YVIHGCY

SEQ ID NO: 14044 - protein, 7 aa, Artificial Sequence
  Synthetic construct
YVIHGLF

SEQ ID NO: 14045 - protein, 7 aa, Artificial Sequence
  Synthetic construct
YVIHGLY

SEQ ID NO: 14046 - protein, 7 aa, Artificial Sequence
  Synthetic construct
YVIHGAF

SEQ ID NO: 14047 - protein, 7 aa, Artificial Sequence
  Synthetic construct
YVIHGAY

SEQ ID NO: 14048 - protein, 7 aa, Artificial Sequence
  Synthetic construct
YVIHGQF

SEQ ID NO: 14049 - protein, 7 aa, Artificial Sequence
  Synthetic construct
YVIHGQY

SEQ ID NO: 14050 - protein, 7 aa, Artificial Sequence
  Synthetic construct
YVIHGDF

SEQ ID NO: 14051 - protein, 7 aa, Artificial Sequence
  Synthetic construct
YVIHGDY

SEQ ID NO: 14052 - protein, 7 aa, Artificial Sequence
  Synthetic construct
YVIHGVF

SEQ ID NO: 14053 - protein, 7 aa, Artificial Sequence
  Synthetic construct
YVIHGVY

SEQ ID NO: 14054 - protein, 7 aa, Artificial Sequence
  Synthetic construct
YVIHAFF

SEQ ID NO: 14055 - protein, 7 aa, Artificial Sequence
  Synthetic construct
YVIHAFY

SEQ ID NO: 14056 - protein, 7 aa, Artificial Sequence
  Synthetic construct
YVIHARF

SEQ ID NO: 14057 - protein, 7 aa, Artificial Sequence
  Synthetic construct
YVIHARY

SEQ ID NO: 14058 - protein, 7 aa, Artificial Sequence
  Synthetic construct
YVIHACF

SEQ ID NO: 14059 - protein, 7 aa, Artificial Sequence
  Synthetic construct
YVIHACY

SEQ ID NO: 14060 - protein, 7 aa, Artificial Sequence
  Synthetic construct
YVIHALF

SEQ ID NO: 14061 - protein, 7 aa, Artificial Sequence
  Synthetic construct
YVIHALY

SEQ ID NO: 14062 - protein, 7 aa, Artificial Sequence
  Synthetic construct
YVIHAAF

SEQ ID NO: 14063 - protein, 7 aa, Artificial Sequence
  Synthetic construct
YVIHAAY

SEQ ID NO: 14064 - protein, 7 aa, Artificial Sequence
  Synthetic construct
YVIHAQF

SEQ ID NO: 14065 - protein, 7 aa, Artificial Sequence
  Synthetic construct
YVIHAQY

SEQ ID NO: 14066 - protein, 7 aa, Artificial Sequence
  Synthetic construct
YVIHADF

SEQ ID NO: 14067 - protein, 7 aa, Artificial Sequence
  Synthetic construct
YVIHADY

SEQ ID NO: 14068 - protein, 7 aa, Artificial Sequence
  Synthetic construct
YVIHAVF

SEQ ID NO: 14069 - protein, 7 aa, Artificial Sequence
  Synthetic construct
YVIHAVY

SEQ ID NO: 14070 - protein, 7 aa, Artificial Sequence
  Synthetic construct
YVIHQFF

SEQ ID NO: 14071 - protein, 7 aa, Artificial Sequence
  Synthetic construct
YVIHQFY

SEQ ID NO: 14072 - protein, 7 aa, Artificial Sequence
  Synthetic construct
YVIHQRF

SEQ ID NO: 14073 - protein, 7 aa, Artificial Sequence
  Synthetic construct
YVIHQRY

SEQ ID NO: 14074 - protein, 7 aa, Artificial Sequence
  Synthetic construct
YVIHQCF

SEQ ID NO: 14075 - protein, 7 aa, Artificial Sequence
  Synthetic construct
YVIHQCY

SEQ ID NO: 14076 - protein, 7 aa, Artificial Sequence
  Synthetic construct
YVIHQLF

SEQ ID NO: 14077 - protein, 7 aa, Artificial Sequence
  Synthetic construct
YVIHQLY

SEQ ID NO: 14078 - protein, 7 aa, Artificial Sequence
  Synthetic construct
YVIHQAF

SEQ ID NO: 14079 - protein, 7 aa, Artificial Sequence
  Synthetic construct
YVIHQAY

SEQ ID NO: 14080 - protein, 7 aa, Artificial Sequence
  Synthetic construct
YVIHQQF

SEQ ID NO: 14081 - protein, 7 aa, Artificial Sequence
  Synthetic construct
YVIHQQY

SEQ ID NO: 14082 - protein, 7 aa, Artificial Sequence
  Synthetic construct
YVIHQDF

SEQ ID NO: 14083 - protein, 7 aa, Artificial Sequence
  Synthetic construct
YVIHQDY

SEQ ID NO: 14084 - protein, 7 aa, Artificial Sequence
  Synthetic construct
YVIHQVF

SEQ ID NO: 14085 - protein, 7 aa, Artificial Sequence
  Synthetic construct
YVIHQVY

SEQ ID NO: 14086 - protein, 7 aa, Artificial Sequence
  Synthetic construct
YVILIFF

SEQ ID NO: 14087 - protein, 7 aa, Artificial Sequence
  Synthetic construct
YVILIFY

SEQ ID NO: 14088 - protein, 7 aa, Artificial Sequence
  Synthetic construct
YVILIRF

SEQ ID NO: 14089 - protein, 7 aa, Artificial Sequence
  Synthetic construct
YVILIRY

SEQ ID NO: 14090 - protein, 7 aa, Artificial Sequence
  Synthetic construct
YVILICF

SEQ ID NO: 14091 - protein, 7 aa, Artificial Sequence
  Synthetic construct
YVILICY

SEQ ID NO: 14092 - protein, 7 aa, Artificial Sequence
  Synthetic construct
YVILILF

SEQ ID NO: 14093 - protein, 7 aa, Artificial Sequence
  Synthetic construct
YVILILY

SEQ ID NO: 14094 - protein, 7 aa, Artificial Sequence
  Synthetic construct
YVILIAF

SEQ ID NO: 14095 - protein, 7 aa, Artificial Sequence
  Synthetic construct
YVILIAY

SEQ ID NO: 14096 - protein, 7 aa, Artificial Sequence
  Synthetic construct
YVILIQF

SEQ ID NO: 14097 - protein, 7 aa, Artificial Sequence
  Synthetic construct
YVILIQY

SEQ ID NO: 14098 - protein, 7 aa, Artificial Sequence
  Synthetic construct
YVILIDF

SEQ ID NO: 14099 - protein, 7 aa, Artificial Sequence
  Synthetic construct
YVILIDY

SEQ ID NO: 14100 - protein, 7 aa, Artificial Sequence
  Synthetic construct
YVILIVF

SEQ ID NO: 14101 - protein, 7 aa, Artificial Sequence
  Synthetic construct
YVILIVY

SEQ ID NO: 14102 - protein, 7 aa, Artificial Sequence
  Synthetic construct
YVILDFF

SEQ ID NO: 14103 - protein, 7 aa, Artificial Sequence
  Synthetic construct
YVILDFY

SEQ ID NO: 14104 - protein, 7 aa, Artificial Sequence
  Synthetic construct
YVILDRF

SEQ ID NO: 14105 - protein, 7 aa, Artificial Sequence
  Synthetic construct
YVILDRY

SEQ ID NO: 14106 - protein, 7 aa, Artificial Sequence
  Synthetic construct
YVILDCF

SEQ ID NO: 14107 - protein, 7 aa, Artificial Sequence
  Synthetic construct
YVILDCY

SEQ ID NO: 14108 - protein, 7 aa, Artificial Sequence
  Synthetic construct
YVILDLF

SEQ ID NO: 14109 - protein, 7 aa, Artificial Sequence
  Synthetic construct
YVILDLY

SEQ ID NO: 14110 - protein, 7 aa, Artificial Sequence
  Synthetic construct
YVILDAF

SEQ ID NO: 14111 - protein, 7 aa, Artificial Sequence
  Synthetic construct
YVILDAY

SEQ ID NO: 14112 - protein, 7 aa, Artificial Sequence
  Synthetic construct
YVILDQF

SEQ ID NO: 14113 - protein, 7 aa, Artificial Sequence
  Synthetic construct
YVILDQY

SEQ ID NO: 14114 - protein, 7 aa, Artificial Sequence
  Synthetic construct
YVILDDF

SEQ ID NO: 14115 - protein, 7 aa, Artificial Sequence
  Synthetic construct
YVILDDY

SEQ ID NO: 14116 - protein, 7 aa, Artificial Sequence
  Synthetic construct
YVILDVF

SEQ ID NO: 14117 - protein, 7 aa, Artificial Sequence
  Synthetic construct
YVILDVY

SEQ ID NO: 14118 - protein, 7 aa, Artificial Sequence
  Synthetic construct
YVILYFF

SEQ ID NO: 14119 - protein, 7 aa, Artificial Sequence
  Synthetic construct
YVILYFY

SEQ ID NO: 14120 - protein, 7 aa, Artificial Sequence
  Synthetic construct
YVILYRF

SEQ ID NO: 14121 - protein, 7 aa, Artificial Sequence
  Synthetic construct
YVILYRY

SEQ ID NO: 14122 - protein, 7 aa, Artificial Sequence
  Synthetic construct
YVILYCF

SEQ ID NO: 14123 - protein, 7 aa, Artificial Sequence
  Synthetic construct
YVILYCY

SEQ ID NO: 14124 - protein, 7 aa, Artificial Sequence
  Synthetic construct
YVILYLF

SEQ ID NO: 14125 - protein, 7 aa, Artificial Sequence
  Synthetic construct
YVILYLY

SEQ ID NO: 14126 - protein, 7 aa, Artificial Sequence
  Synthetic construct
YVILYAF

SEQ ID NO: 14127 - protein, 7 aa, Artificial Sequence
  Synthetic construct
YVILYAY

SEQ ID NO: 14128 - protein, 7 aa, Artificial Sequence
  Synthetic construct
YVILYQF

SEQ ID NO: 14129 - protein, 7 aa, Artificial Sequence
  Synthetic construct
YVILYQY

SEQ ID NO: 14130 - protein, 7 aa, Artificial Sequence
  Synthetic construct
YVILYDF

SEQ ID NO: 14131 - protein, 7 aa, Artificial Sequence
  Synthetic construct
YVILYDY

SEQ ID NO: 14132 - protein, 7 aa, Artificial Sequence
  Synthetic construct
YVILYVF

SEQ ID NO: 14133 - protein, 7 aa, Artificial Sequence
  Synthetic construct
YVILYVY

SEQ ID NO: 14134 - protein, 7 aa, Artificial Sequence
  Synthetic construct
YVILFFF

SEQ ID NO: 14135 - protein, 7 aa, Artificial Sequence
  Synthetic construct
YVILFFY

SEQ ID NO: 14136 - protein, 7 aa, Artificial Sequence
  Synthetic construct
YVILFRF

SEQ ID NO: 14137 - protein, 7 aa, Artificial Sequence
  Synthetic construct
YVILFRY

SEQ ID NO: 14138 - protein, 7 aa, Artificial Sequence
  Synthetic construct
YVILFCF

SEQ ID NO: 14139 - protein, 7 aa, Artificial Sequence
  Synthetic construct
YVILFCY

SEQ ID NO: 14140 - protein, 7 aa, Artificial Sequence
  Synthetic construct
YVILFLF

SEQ ID NO: 14141 - protein, 7 aa, Artificial Sequence
  Synthetic construct
YVILFLY

SEQ ID NO: 14142 - protein, 7 aa, Artificial Sequence
  Synthetic construct
YVILFAF

SEQ ID NO: 14143 - protein, 7 aa, Artificial Sequence
  Synthetic construct
YVILFAY

SEQ ID NO: 14144 - protein, 7 aa, Artificial Sequence
  Synthetic construct
YVILFQF

SEQ ID NO: 14145 - protein, 7 aa, Artificial Sequence
  Synthetic construct
YVILFQY

SEQ ID NO: 14146 - protein, 7 aa, Artificial Sequence
  Synthetic construct
YVILFDF

SEQ ID NO: 14147 - protein, 7 aa, Artificial Sequence
  Synthetic construct
YVILFDY

SEQ ID NO: 14148 - protein, 7 aa, Artificial Sequence
  Synthetic construct
YVILFVF

SEQ ID NO: 14149 - protein, 7 aa, Artificial Sequence
  Synthetic construct
YVILFVY

SEQ ID NO: 14150 - protein, 7 aa, Artificial Sequence
  Synthetic construct
YVILVFF

SEQ ID NO: 14151 - protein, 7 aa, Artificial Sequence
  Synthetic construct
YVILVFY

SEQ ID NO: 14152 - protein, 7 aa, Artificial Sequence
  Synthetic construct
YVILVRF

SEQ ID NO: 14153 - protein, 7 aa, Artificial Sequence
  Synthetic construct
YVILVRY

SEQ ID NO: 14154 - protein, 7 aa, Artificial Sequence
  Synthetic construct
YVILVCF

SEQ ID NO: 14155 - protein, 7 aa, Artificial Sequence
  Synthetic construct
YVILVCY

SEQ ID NO: 14156 - protein, 7 aa, Artificial Sequence
  Synthetic construct
YVILVLF

SEQ ID NO: 14157 - protein, 7 aa, Artificial Sequence
  Synthetic construct
YVILVLY

SEQ ID NO: 14158 - protein, 7 aa, Artificial Sequence
  Synthetic construct
YVILVAF

SEQ ID NO: 14159 - protein, 7 aa, Artificial Sequence
  Synthetic construct
YVILVAY

SEQ ID NO: 14160 - protein, 7 aa, Artificial Sequence
  Synthetic construct
YVILVQF

SEQ ID NO: 14161 - protein, 7 aa, Artificial Sequence
  Synthetic construct
YVILVQY

SEQ ID NO: 14162 - protein, 7 aa, Artificial Sequence
  Synthetic construct
YVILVDF

SEQ ID NO: 14163 - protein, 7 aa, Artificial Sequence
  Synthetic construct
YVILVDY

SEQ ID NO: 14164 - protein, 7 aa, Artificial Sequence
  Synthetic construct
YVILVVF

SEQ ID NO: 14165 - protein, 7 aa, Artificial Sequence
  Synthetic construct
YVILVVY

SEQ ID NO: 14166 - protein, 7 aa, Artificial Sequence
  Synthetic construct
YVILTFF

SEQ ID NO: 14167 - protein, 7 aa, Artificial Sequence
  Synthetic construct
YVILTFY

SEQ ID NO: 14168 - protein, 7 aa, Artificial Sequence
  Synthetic construct
YVILTRF

SEQ ID NO: 14169 - protein, 7 aa, Artificial Sequence
  Synthetic construct
YVILTRY

SEQ ID NO: 14170 - protein, 7 aa, Artificial Sequence
  Synthetic construct
YVILTCF

SEQ ID NO: 14171 - protein, 7 aa, Artificial Sequence
  Synthetic construct
YVILTCY

SEQ ID NO: 14172 - protein, 7 aa, Artificial Sequence
  Synthetic construct
YVILTLF

SEQ ID NO: 14173 - protein, 7 aa, Artificial Sequence
  Synthetic construct
YVILTLY

SEQ ID NO: 14174 - protein, 7 aa, Artificial Sequence
  Synthetic construct
YVILTAF

SEQ ID NO: 14175 - protein, 7 aa, Artificial Sequence
  Synthetic construct
YVILTAY

SEQ ID NO: 14176 - protein, 7 aa, Artificial Sequence
  Synthetic construct
YVILTQF

SEQ ID NO: 14177 - protein, 7 aa, Artificial Sequence
  Synthetic construct
YVILTQY

SEQ ID NO: 14178 - protein, 7 aa, Artificial Sequence
  Synthetic construct
YVILTDF

SEQ ID NO: 14179 - protein, 7 aa, Artificial Sequence
  Synthetic construct
YVILTDY

SEQ ID NO: 14180 - protein, 7 aa, Artificial Sequence
  Synthetic construct
YVILTVF

SEQ ID NO: 14181 - protein, 7 aa, Artificial Sequence
  Synthetic construct
YVILTVY

SEQ ID NO: 14182 - protein, 7 aa, Artificial Sequence
  Synthetic construct
YVILGFF

SEQ ID NO: 14183 - protein, 7 aa, Artificial Sequence
  Synthetic construct
YVILGFY

SEQ ID NO: 14184 - protein, 7 aa, Artificial Sequence
  Synthetic construct
YVILGRF

SEQ ID NO: 14185 - protein, 7 aa, Artificial Sequence
  Synthetic construct
YVILGRY

SEQ ID NO: 14186 - protein, 7 aa, Artificial Sequence
  Synthetic construct
YVILGCF

SEQ ID NO: 14187 - protein, 7 aa, Artificial Sequence
  Synthetic construct
YVILGCY

SEQ ID NO: 14188 - protein, 7 aa, Artificial Sequence
  Synthetic construct
YVILGLF

SEQ ID NO: 14189 - protein, 7 aa, Artificial Sequence
  Synthetic construct
YVILGLY

SEQ ID NO: 14190 - protein, 7 aa, Artificial Sequence
  Synthetic construct
YVILGAF

SEQ ID NO: 14191 - protein, 7 aa, Artificial Sequence
  Synthetic construct
YVILGAY

SEQ ID NO: 14192 - protein, 7 aa, Artificial Sequence
  Synthetic construct
YVILGQF

SEQ ID NO: 14193 - protein, 7 aa, Artificial Sequence
  Synthetic construct
YVILGQY

SEQ ID NO: 14194 - protein, 7 aa, Artificial Sequence
  Synthetic construct
YVILGDF

SEQ ID NO: 14195 - protein, 7 aa, Artificial Sequence
  Synthetic construct
YVILGDY

SEQ ID NO: 14196 - protein, 7 aa, Artificial Sequence
  Synthetic construct
YVILGVF

SEQ ID NO: 14197 - protein, 7 aa, Artificial Sequence
  Synthetic construct
YVILGVY

SEQ ID NO: 14198 - protein, 7 aa, Artificial Sequence
  Synthetic construct
YVILAFF

SEQ ID NO: 14199 - protein, 7 aa, Artificial Sequence
  Synthetic construct
YVILAFY

SEQ ID NO: 14200 - protein, 7 aa, Artificial Sequence
  Synthetic construct
YVILARF

SEQ ID NO: 14201 - protein, 7 aa, Artificial Sequence
  Synthetic construct
YVILARY

SEQ ID NO: 14202 - protein, 7 aa, Artificial Sequence
  Synthetic construct
YVILACF

SEQ ID NO: 14203 - protein, 7 aa, Artificial Sequence
  Synthetic construct
YVILACY

SEQ ID NO: 14204 - protein, 7 aa, Artificial Sequence
  Synthetic construct
YVILALF

SEQ ID NO: 14205 - protein, 7 aa, Artificial Sequence
  Synthetic construct
YVILALY

SEQ ID NO: 14206 - protein, 7 aa, Artificial Sequence
  Synthetic construct
YVILAAF

SEQ ID NO: 14207 - protein, 7 aa, Artificial Sequence
  Synthetic construct
YVILAAY

SEQ ID NO: 14208 - protein, 7 aa, Artificial Sequence
  Synthetic construct
YVILAQF

SEQ ID NO: 14209 - protein, 7 aa, Artificial Sequence
  Synthetic construct
YVILAQY

SEQ ID NO: 14210 - protein, 7 aa, Artificial Sequence
  Synthetic construct
YVILADF

SEQ ID NO: 14211 - protein, 7 aa, Artificial Sequence
  Synthetic construct
YVILADY

SEQ ID NO: 14212 - protein, 7 aa, Artificial Sequence
  Synthetic construct
YVILAVF

SEQ ID NO: 14213 - protein, 7 aa, Artificial Sequence
  Synthetic construct
YVILAVY

SEQ ID NO: 14214 - protein, 7 aa, Artificial Sequence
  Synthetic construct
YVILQFF

SEQ ID NO: 14215 - protein, 7 aa, Artificial Sequence
  Synthetic construct
YVILQFY

SEQ ID NO: 14216 - protein, 7 aa, Artificial Sequence
  Synthetic construct
YVILQRF

SEQ ID NO: 14217 - protein, 7 aa, Artificial Sequence
  Synthetic construct
YVILQRY

SEQ ID NO: 14218 - protein, 7 aa, Artificial Sequence
  Synthetic construct
YVILQCF

SEQ ID NO: 14219 - protein, 7 aa, Artificial Sequence
  Synthetic construct
YVILQCY

SEQ ID NO: 14220 - protein, 7 aa, Artificial Sequence
  Synthetic construct
YVILQLF

SEQ ID NO: 14221 - protein, 7 aa, Artificial Sequence
  Synthetic construct
YVILQLY

SEQ ID NO: 14222 - protein, 7 aa, Artificial Sequence
  Synthetic construct
YVILQAF

SEQ ID NO: 14223 - protein, 7 aa, Artificial Sequence
  Synthetic construct
YVILQAY

SEQ ID NO: 14224 - protein, 7 aa, Artificial Sequence
  Synthetic construct
YVILQQF

SEQ ID NO: 14225 - protein, 7 aa, Artificial Sequence
  Synthetic construct
YVILQQY

SEQ ID NO: 14226 - protein, 7 aa, Artificial Sequence
  Synthetic construct
YVILQDF

SEQ ID NO: 14227 - protein, 7 aa, Artificial Sequence
  Synthetic construct
YVILQDY

SEQ ID NO: 14228 - protein, 7 aa, Artificial Sequence
  Synthetic construct
YVILQVF

SEQ ID NO: 14229 - protein, 7 aa, Artificial Sequence
  Synthetic construct
YVILQVY

SEQ ID NO: 14230 - protein, 7 aa, Artificial Sequence
  Synthetic construct
YVIFIFF

SEQ ID NO: 14231 - protein, 7 aa, Artificial Sequence
  Synthetic construct
YVIFIFY

SEQ ID NO: 14232 - protein, 7 aa, Artificial Sequence
  Synthetic construct
YVIFIRF

SEQ ID NO: 14233 - protein, 7 aa, Artificial Sequence
  Synthetic construct
YVIFIRY

SEQ ID NO: 14234 - protein, 7 aa, Artificial Sequence
  Synthetic construct
YVIFICF

SEQ ID NO: 14235 - protein, 7 aa, Artificial Sequence
  Synthetic construct
YVIFICY

SEQ ID NO: 14236 - protein, 7 aa, Artificial Sequence
  Synthetic construct
YVIFILF

SEQ ID NO: 14237 - protein, 7 aa, Artificial Sequence
  Synthetic construct
YVIFILY

SEQ ID NO: 14238 - protein, 7 aa, Artificial Sequence
  Synthetic construct
YVIFIAF

SEQ ID NO: 14239 - protein, 7 aa, Artificial Sequence
  Synthetic construct
YVIFIAY

SEQ ID NO: 14240 - protein, 7 aa, Artificial Sequence
  Synthetic construct
YVIFIQF

SEQ ID NO: 14241 - protein, 7 aa, Artificial Sequence
  Synthetic construct
YVIFIQY

SEQ ID NO: 14242 - protein, 7 aa, Artificial Sequence
  Synthetic construct
YVIFIDF

SEQ ID NO: 14243 - protein, 7 aa, Artificial Sequence
  Synthetic construct
YVIFIDY

SEQ ID NO: 14244 - protein, 7 aa, Artificial Sequence
  Synthetic construct
YVIFIVF

SEQ ID NO: 14245 - protein, 7 aa, Artificial Sequence
  Synthetic construct
YVIFIVY

SEQ ID NO: 14246 - protein, 7 aa, Artificial Sequence
  Synthetic construct
YVIFDFF

SEQ ID NO: 14247 - protein, 7 aa, Artificial Sequence
  Synthetic construct
YVIFDFY

SEQ ID NO: 14248 - protein, 7 aa, Artificial Sequence
  Synthetic construct
YVIFDRF

SEQ ID NO: 14249 - protein, 7 aa, Artificial Sequence
  Synthetic construct
YVIFDRY

SEQ ID NO: 14250 - protein, 7 aa, Artificial Sequence
  Synthetic construct
YVIFDCF

SEQ ID NO: 14251 - protein, 7 aa, Artificial Sequence
  Synthetic construct
YVIFDCY

SEQ ID NO: 14252 - protein, 7 aa, Artificial Sequence
  Synthetic construct
YVIFDLF

SEQ ID NO: 14253 - protein, 7 aa, Artificial Sequence
  Synthetic construct
YVIFDLY

SEQ ID NO: 14254 - protein, 7 aa, Artificial Sequence
  Synthetic construct
YVIFDAF

SEQ ID NO: 14255 - protein, 7 aa, Artificial Sequence
  Synthetic construct
YVIFDAY

SEQ ID NO: 14256 - protein, 7 aa, Artificial Sequence
  Synthetic construct
YVIFDQF

SEQ ID NO: 14257 - protein, 7 aa, Artificial Sequence
  Synthetic construct
YVIFDQY

SEQ ID NO: 14258 - protein, 7 aa, Artificial Sequence
  Synthetic construct
YVIFDDF

SEQ ID NO: 14259 - protein, 7 aa, Artificial Sequence
  Synthetic construct
YVIFDDY

SEQ ID NO: 14260 - protein, 7 aa, Artificial Sequence
  Synthetic construct
YVIFDVF

SEQ ID NO: 14261 - protein, 7 aa, Artificial Sequence
  Synthetic construct
YVIFDVY

SEQ ID NO: 14262 - protein, 7 aa, Artificial Sequence
  Synthetic construct
YVIFYFF

SEQ ID NO: 14263 - protein, 7 aa, Artificial Sequence
  Synthetic construct
YVIFYFY

SEQ ID NO: 14264 - protein, 7 aa, Artificial Sequence
  Synthetic construct
YVIFYRF

SEQ ID NO: 14265 - protein, 7 aa, Artificial Sequence
  Synthetic construct
YVIFYRY

SEQ ID NO: 14266 - protein, 7 aa, Artificial Sequence
  Synthetic construct
YVIFYCF

SEQ ID NO: 14267 - protein, 7 aa, Artificial Sequence
  Synthetic construct
YVIFYCY

SEQ ID NO: 14268 - protein, 7 aa, Artificial Sequence
  Synthetic construct
YVIFYLF

SEQ ID NO: 14269 - protein, 7 aa, Artificial Sequence
  Synthetic construct
YVIFYLY

SEQ ID NO: 14270 - protein, 7 aa, Artificial Sequence
  Synthetic construct
YVIFYAF

SEQ ID NO: 14271 - protein, 7 aa, Artificial Sequence
  Synthetic construct
YVIFYAY

SEQ ID NO: 14272 - protein, 7 aa, Artificial Sequence
  Synthetic construct
YVIFYQF

SEQ ID NO: 14273 - protein, 7 aa, Artificial Sequence
  Synthetic construct
YVIFYQY

SEQ ID NO: 14274 - protein, 7 aa, Artificial Sequence
  Synthetic construct
YVIFYDF

SEQ ID NO: 14275 - protein, 7 aa, Artificial Sequence
  Synthetic construct
YVIFYDY

SEQ ID NO: 14276 - protein, 7 aa, Artificial Sequence
  Synthetic construct
YVIFYVF

SEQ ID NO: 14277 - protein, 7 aa, Artificial Sequence
  Synthetic construct
YVIFYVY

SEQ ID NO: 14278 - protein, 7 aa, Artificial Sequence
  Synthetic construct
YVIFFFF

SEQ ID NO: 14279 - protein, 7 aa, Artificial Sequence
  Synthetic construct
YVIFFFY

SEQ ID NO: 14280 - protein, 7 aa, Artificial Sequence
  Synthetic construct
YVIFFRF

SEQ ID NO: 14281 - protein, 7 aa, Artificial Sequence
  Synthetic construct
YVIFFRY

SEQ ID NO: 14282 - protein, 7 aa, Artificial Sequence
  Synthetic construct
YVIFFCF

SEQ ID NO: 14283 - protein, 7 aa, Artificial Sequence
  Synthetic construct
YVIFFCY

SEQ ID NO: 14284 - protein, 7 aa, Artificial Sequence
  Synthetic construct
YVIFFLF

SEQ ID NO: 14285 - protein, 7 aa, Artificial Sequence
  Synthetic construct
YVIFFLY

SEQ ID NO: 14286 - protein, 7 aa, Artificial Sequence
  Synthetic construct
YVIFFAF

SEQ ID NO: 14287 - protein, 7 aa, Artificial Sequence
  Synthetic construct
YVIFFAY

SEQ ID NO: 14288 - protein, 7 aa, Artificial Sequence
  Synthetic construct
YVIFFQF

SEQ ID NO: 14289 - protein, 7 aa, Artificial Sequence
  Synthetic construct
YVIFFQY

SEQ ID NO: 14290 - protein, 7 aa, Artificial Sequence
  Synthetic construct
YVIFFDF

SEQ ID NO: 14291 - protein, 7 aa, Artificial Sequence
  Synthetic construct
YVIFFDY

SEQ ID NO: 14292 - protein, 7 aa, Artificial Sequence
  Synthetic construct
YVIFFVF

SEQ ID NO: 14293 - protein, 7 aa, Artificial Sequence
  Synthetic construct
YVIFFVY

SEQ ID NO: 14294 - protein, 7 aa, Artificial Sequence
  Synthetic construct
YVIFVFF

SEQ ID NO: 14295 - protein, 7 aa, Artificial Sequence
  Synthetic construct
YVIFVFY

SEQ ID NO: 14296 - protein, 7 aa, Artificial Sequence
  Synthetic construct
YVIFVRF

SEQ ID NO: 14297 - protein, 7 aa, Artificial Sequence
  Synthetic construct
YVIFVRY

SEQ ID NO: 14298 - protein, 7 aa, Artificial Sequence
  Synthetic construct
YVIFVCF

SEQ ID NO: 14299 - protein, 7 aa, Artificial Sequence
  Synthetic construct
YVIFVCY

SEQ ID NO: 14300 - protein, 7 aa, Artificial Sequence
  Synthetic construct
YVIFVLF

SEQ ID NO: 14301 - protein, 7 aa, Artificial Sequence
  Synthetic construct
YVIFVLY

SEQ ID NO: 14302 - protein, 7 aa, Artificial Sequence
  Synthetic construct
YVIFVAF

SEQ ID NO: 14303 - protein, 7 aa, Artificial Sequence
  Synthetic construct
YVIFVAY

SEQ ID NO: 14304 - protein, 7 aa, Artificial Sequence
  Synthetic construct
YVIFVQF

SEQ ID NO: 14305 - protein, 7 aa, Artificial Sequence
  Synthetic construct
YVIFVQY

SEQ ID NO: 14306 - protein, 7 aa, Artificial Sequence
  Synthetic construct
YVIFVDF

SEQ ID NO: 14307 - protein, 7 aa, Artificial Sequence
  Synthetic construct
YVIFVDY

SEQ ID NO: 14308 - protein, 7 aa, Artificial Sequence
  Synthetic construct
YVIFVVF

SEQ ID NO: 14309 - protein, 7 aa, Artificial Sequence
  Synthetic construct
YVIFVVY

SEQ ID NO: 14310 - protein, 7 aa, Artificial Sequence
  Synthetic construct
YVIFTFF

SEQ ID NO: 14311 - protein, 7 aa, Artificial Sequence
  Synthetic construct
YVIFTFY

SEQ ID NO: 14312 - protein, 7 aa, Artificial Sequence
  Synthetic construct
YVIFTRF

SEQ ID NO: 14313 - protein, 7 aa, Artificial Sequence
  Synthetic construct
YVIFTRY

SEQ ID NO: 14314 - protein, 7 aa, Artificial Sequence
  Synthetic construct
YVIFTCF

SEQ ID NO: 14315 - protein, 7 aa, Artificial Sequence
  Synthetic construct
YVIFTCY

SEQ ID NO: 14316 - protein, 7 aa, Artificial Sequence
  Synthetic construct
YVIFTLF

SEQ ID NO: 14317 - protein, 7 aa, Artificial Sequence
  Synthetic construct
YVIFTLY

SEQ ID NO: 14318 - protein, 7 aa, Artificial Sequence
  Synthetic construct
YVIFTAF

SEQ ID NO: 14319 - protein, 7 aa, Artificial Sequence
  Synthetic construct
YVIFTAY

SEQ ID NO: 14320 - protein, 7 aa, Artificial Sequence
  Synthetic construct
YVIFTQF

SEQ ID NO: 14321 - protein, 7 aa, Artificial Sequence
  Synthetic construct
YVIFTQY

SEQ ID NO: 14322 - protein, 7 aa, Artificial Sequence
  Synthetic construct
YVIFTDF

SEQ ID NO: 14323 - protein, 7 aa, Artificial Sequence
  Synthetic construct
YVIFTDY

SEQ ID NO: 14324 - protein, 7 aa, Artificial Sequence
  Synthetic construct
YVIFTVF

SEQ ID NO: 14325 - protein, 7 aa, Artificial Sequence
  Synthetic construct
YVIFTVY

SEQ ID NO: 14326 - protein, 7 aa, Artificial Sequence
  Synthetic construct
YVIFGFF

SEQ ID NO: 14327 - protein, 7 aa, Artificial Sequence
  Synthetic construct
YVIFGFY

SEQ ID NO: 14328 - protein, 7 aa, Artificial Sequence
  Synthetic construct
YVIFGRF

SEQ ID NO: 14329 - protein, 7 aa, Artificial Sequence
  Synthetic construct
YVIFGRY

SEQ ID NO: 14330 - protein, 7 aa, Artificial Sequence
  Synthetic construct
YVIFGCF

SEQ ID NO: 14331 - protein, 7 aa, Artificial Sequence
  Synthetic construct
YVIFGCY

SEQ ID NO: 14332 - protein, 7 aa, Artificial Sequence
  Synthetic construct
YVIFGLF

SEQ ID NO: 14333 - protein, 7 aa, Artificial Sequence
  Synthetic construct
YVIFGLY

SEQ ID NO: 14334 - protein, 7 aa, Artificial Sequence
  Synthetic construct
YVIFGAF

SEQ ID NO: 14335 - protein, 7 aa, Artificial Sequence
  Synthetic construct
YVIFGAY

SEQ ID NO: 14336 - protein, 7 aa, Artificial Sequence
  Synthetic construct
YVIFGQF

SEQ ID NO: 14337 - protein, 7 aa, Artificial Sequence
  Synthetic construct
YVIFGQY

SEQ ID NO: 14338 - protein, 7 aa, Artificial Sequence
  Synthetic construct
YVIFGDF

SEQ ID NO: 14339 - protein, 7 aa, Artificial Sequence
  Synthetic construct
YVIFGDY

SEQ ID NO: 14340 - protein, 7 aa, Artificial Sequence
  Synthetic construct
YVIFGVF

SEQ ID NO: 14341 - protein, 7 aa, Artificial Sequence
  Synthetic construct
YVIFGVY

SEQ ID NO: 14342 - protein, 7 aa, Artificial Sequence
  Synthetic construct
YVIFAFF

SEQ ID NO: 14343 - protein, 7 aa, Artificial Sequence
  Synthetic construct
YVIFAFY

SEQ ID NO: 14344 - protein, 7 aa, Artificial Sequence
  Synthetic construct
YVIFARF

SEQ ID NO: 14345 - protein, 7 aa, Artificial Sequence
  Synthetic construct
YVIFARY

SEQ ID NO: 14346 - protein, 7 aa, Artificial Sequence
  Synthetic construct
YVIFACF

SEQ ID NO: 14347 - protein, 7 aa, Artificial Sequence
  Synthetic construct
YVIFACY

SEQ ID NO: 14348 - protein, 7 aa, Artificial Sequence
  Synthetic construct
YVIFALF

SEQ ID NO: 14349 - protein, 7 aa, Artificial Sequence
  Synthetic construct
YVIFALY

SEQ ID NO: 14350 - protein, 7 aa, Artificial Sequence
  Synthetic construct
YVIFAAF

SEQ ID NO: 14351 - protein, 7 aa, Artificial Sequence
  Synthetic construct
YVIFAAY

SEQ ID NO: 14352 - protein, 7 aa, Artificial Sequence
  Synthetic construct
YVIFAQF

SEQ ID NO: 14353 - protein, 7 aa, Artificial Sequence
  Synthetic construct
YVIFAQY

SEQ ID NO: 14354 - protein, 7 aa, Artificial Sequence
  Synthetic construct
YVIFADF

SEQ ID NO: 14355 - protein, 7 aa, Artificial Sequence
  Synthetic construct
YVIFADY

SEQ ID NO: 14356 - protein, 7 aa, Artificial Sequence
  Synthetic construct
YVIFAVF

SEQ ID NO: 14357 - protein, 7 aa, Artificial Sequence
  Synthetic construct
YVIFAVY

SEQ ID NO: 14358 - protein, 7 aa, Artificial Sequence
  Synthetic construct
YVIFQFF

SEQ ID NO: 14359 - protein, 7 aa, Artificial Sequence
  Synthetic construct
YVIFQFY

SEQ ID NO: 14360 - protein, 7 aa, Artificial Sequence
  Synthetic construct
YVIFQRF

SEQ ID NO: 14361 - protein, 7 aa, Artificial Sequence
  Synthetic construct
YVIFQRY

SEQ ID NO: 14362 - protein, 7 aa, Artificial Sequence
  Synthetic construct
YVIFQCF

SEQ ID NO: 14363 - protein, 7 aa, Artificial Sequence
  Synthetic construct
YVIFQCY

SEQ ID NO: 14364 - protein, 7 aa, Artificial Sequence
  Synthetic construct
YVIFQLF

SEQ ID NO: 14365 - protein, 7 aa, Artificial Sequence
  Synthetic construct
YVIFQLY

SEQ ID NO: 14366 - protein, 7 aa, Artificial Sequence
  Synthetic construct
YVIFQAF

SEQ ID NO: 14367 - protein, 7 aa, Artificial Sequence
  Synthetic construct
YVIFQAY

SEQ ID NO: 14368 - protein, 7 aa, Artificial Sequence
  Synthetic construct
YVIFQQF

SEQ ID NO: 14369 - protein, 7 aa, Artificial Sequence
  Synthetic construct
YVIFQQY

SEQ ID NO: 14370 - protein, 7 aa, Artificial Sequence
  Synthetic construct
YVIFQDF

SEQ ID NO: 14371 - protein, 7 aa, Artificial Sequence
  Synthetic construct
YVIFQDY

SEQ ID NO: 14372 - protein, 7 aa, Artificial Sequence
  Synthetic construct
YVIFQVF

SEQ ID NO: 14373 - protein, 7 aa, Artificial Sequence
  Synthetic construct
YVIFQVY

SEQ ID NO: 14374 - protein, 7 aa, Artificial Sequence
  Synthetic construct
YVGYIFF

SEQ ID NO: 14375 - protein, 7 aa, Artificial Sequence
  Synthetic construct
YVGYIFY

SEQ ID NO: 14376 - protein, 7 aa, Artificial Sequence
  Synthetic construct
YVGYIRF

SEQ ID NO: 14377 - protein, 7 aa, Artificial Sequence
  Synthetic construct
YVGYIRY

SEQ ID NO: 14378 - protein, 7 aa, Artificial Sequence
  Synthetic construct
YVGYICF

SEQ ID NO: 14379 - protein, 7 aa, Artificial Sequence
  Synthetic construct
YVGYICY

SEQ ID NO: 14380 - protein, 7 aa, Artificial Sequence
  Synthetic construct
YVGYILF

SEQ ID NO: 14381 - protein, 7 aa, Artificial Sequence
  Synthetic construct
YVGYILY

SEQ ID NO: 14382 - protein, 7 aa, Artificial Sequence
  Synthetic construct
YVGYIAF

SEQ ID NO: 14383 - protein, 7 aa, Artificial Sequence
  Synthetic construct
YVGYIAY

SEQ ID NO: 14384 - protein, 7 aa, Artificial Sequence
  Synthetic construct
YVGYIQF

SEQ ID NO: 14385 - protein, 7 aa, Artificial Sequence
  Synthetic construct
YVGYIQY

SEQ ID NO: 14386 - protein, 7 aa, Artificial Sequence
  Synthetic construct
YVGYIDF

SEQ ID NO: 14387 - protein, 7 aa, Artificial Sequence
  Synthetic construct
YVGYIDY

SEQ ID NO: 14388 - protein, 7 aa, Artificial Sequence
  Synthetic construct
YVGYIVF

SEQ ID NO: 14389 - protein, 7 aa, Artificial Sequence
  Synthetic construct
YVGYIVY

SEQ ID NO: 14390 - protein, 7 aa, Artificial Sequence
  Synthetic construct
YVGYDFF

SEQ ID NO: 14391 - protein, 7 aa, Artificial Sequence
  Synthetic construct
YVGYDFY

SEQ ID NO: 14392 - protein, 7 aa, Artificial Sequence
  Synthetic construct
YVGYDRF

SEQ ID NO: 14393 - protein, 7 aa, Artificial Sequence
  Synthetic construct
YVGYDRY

SEQ ID NO: 14394 - protein, 7 aa, Artificial Sequence
  Synthetic construct
YVGYDCF

SEQ ID NO: 14395 - protein, 7 aa, Artificial Sequence
  Synthetic construct
YVGYDCY

SEQ ID NO: 14396 - protein, 7 aa, Artificial Sequence
  Synthetic construct
YVGYDLF

SEQ ID NO: 14397 - protein, 7 aa, Artificial Sequence
  Synthetic construct
YVGYDLY

SEQ ID NO: 14398 - protein, 7 aa, Artificial Sequence
  Synthetic construct
YVGYDAF

SEQ ID NO: 14399 - protein, 7 aa, Artificial Sequence
  Synthetic construct
YVGYDAY

SEQ ID NO: 14400 - protein, 7 aa, Artificial Sequence
  Synthetic construct
YVGYDQF

SEQ ID NO: 14401 - protein, 7 aa, Artificial Sequence
  Synthetic construct
YVGYDQY

SEQ ID NO: 14402 - protein, 7 aa, Artificial Sequence
  Synthetic construct
YVGYDDF

SEQ ID NO: 14403 - protein, 7 aa, Artificial Sequence
  Synthetic construct
YVGYDDY

SEQ ID NO: 14404 - protein, 7 aa, Artificial Sequence
  Synthetic construct
YVGYDVF

SEQ ID NO: 14405 - protein, 7 aa, Artificial Sequence
  Synthetic construct
YVGYDVY

SEQ ID NO: 14406 - protein, 7 aa, Artificial Sequence
  Synthetic construct
YVGYYFF

SEQ ID NO: 14407 - protein, 7 aa, Artificial Sequence
  Synthetic construct
YVGYYFY

SEQ ID NO: 14408 - protein, 7 aa, Artificial Sequence
  Synthetic construct
YVGYYRF

SEQ ID NO: 14409 - protein, 7 aa, Artificial Sequence
  Synthetic construct
YVGYYRY

SEQ ID NO: 14410 - protein, 7 aa, Artificial Sequence
  Synthetic construct
YVGYYCF

SEQ ID NO: 14411 - protein, 7 aa, Artificial Sequence
  Synthetic construct
YVGYYCY

SEQ ID NO: 14412 - protein, 7 aa, Artificial Sequence
  Synthetic construct
YVGYYLF

SEQ ID NO: 14413 - protein, 7 aa, Artificial Sequence
  Synthetic construct
YVGYYLY

SEQ ID NO: 14414 - protein, 7 aa, Artificial Sequence
  Synthetic construct
YVGYYAF

SEQ ID NO: 14415 - protein, 7 aa, Artificial Sequence
  Synthetic construct
YVGYYAY

SEQ ID NO: 14416 - protein, 7 aa, Artificial Sequence
  Synthetic construct
YVGYYQF

SEQ ID NO: 14417 - protein, 7 aa, Artificial Sequence
  Synthetic construct
YVGYYQY

SEQ ID NO: 14418 - protein, 7 aa, Artificial Sequence
  Synthetic construct
YVGYYDF

SEQ ID NO: 14419 - protein, 7 aa, Artificial Sequence
  Synthetic construct
YVGYYDY

SEQ ID NO: 14420 - protein, 7 aa, Artificial Sequence
  Synthetic construct
YVGYYVF

SEQ ID NO: 14421 - protein, 7 aa, Artificial Sequence
  Synthetic construct
YVGYYVY

SEQ ID NO: 14422 - protein, 7 aa, Artificial Sequence
  Synthetic construct
YVGYFFF

SEQ ID NO: 14423 - protein, 7 aa, Artificial Sequence
  Synthetic construct
YVGYFFY

SEQ ID NO: 14424 - protein, 7 aa, Artificial Sequence
  Synthetic construct
YVGYFRF

SEQ ID NO: 14425 - protein, 7 aa, Artificial Sequence
  Synthetic construct
YVGYFRY

SEQ ID NO: 14426 - protein, 7 aa, Artificial Sequence
  Synthetic construct
YVGYFCF

SEQ ID NO: 14427 - protein, 7 aa, Artificial Sequence
  Synthetic construct
YVGYFCY

SEQ ID NO: 14428 - protein, 7 aa, Artificial Sequence
  Synthetic construct
YVGYFLF

SEQ ID NO: 14429 - protein, 7 aa, Artificial Sequence
  Synthetic construct
YVGYFLY

SEQ ID NO: 14430 - protein, 7 aa, Artificial Sequence
  Synthetic construct
YVGYFAF

SEQ ID NO: 14431 - protein, 7 aa, Artificial Sequence
  Synthetic construct
YVGYFAY

SEQ ID NO: 14432 - protein, 7 aa, Artificial Sequence
  Synthetic construct
YVGYFQF

SEQ ID NO: 14433 - protein, 7 aa, Artificial Sequence
  Synthetic construct
YVGYFQY

SEQ ID NO: 14434 - protein, 7 aa, Artificial Sequence
  Synthetic construct
YVGYFDF

SEQ ID NO: 14435 - protein, 7 aa, Artificial Sequence
  Synthetic construct
YVGYFDY

SEQ ID NO: 14436 - protein, 7 aa, Artificial Sequence
  Synthetic construct
YVGYFVF

SEQ ID NO: 14437 - protein, 7 aa, Artificial Sequence
  Synthetic construct
YVGYFVY

SEQ ID NO: 14438 - protein, 7 aa, Artificial Sequence
  Synthetic construct
YVGYVFF

SEQ ID NO: 14439 - protein, 7 aa, Artificial Sequence
  Synthetic construct
YVGYVFY

SEQ ID NO: 14440 - protein, 7 aa, Artificial Sequence
  Synthetic construct
YVGYVRF

SEQ ID NO: 14441 - protein, 7 aa, Artificial Sequence
  Synthetic construct
YVGYVRY

SEQ ID NO: 14442 - protein, 7 aa, Artificial Sequence
  Synthetic construct
YVGYVCF

SEQ ID NO: 14443 - protein, 7 aa, Artificial Sequence
  Synthetic construct
YVGYVCY

SEQ ID NO: 14444 - protein, 7 aa, Artificial Sequence
  Synthetic construct
YVGYVLF

SEQ ID NO: 14445 - protein, 7 aa, Artificial Sequence
  Synthetic construct
YVGYVLY

SEQ ID NO: 14446 - protein, 7 aa, Artificial Sequence
  Synthetic construct
YVGYVAF

SEQ ID NO: 14447 - protein, 7 aa, Artificial Sequence
  Synthetic construct
YVGYVAY

SEQ ID NO: 14448 - protein, 7 aa, Artificial Sequence
  Synthetic construct
YVGYVQF

SEQ ID NO: 14449 - protein, 7 aa, Artificial Sequence
  Synthetic construct
YVGYVQY

SEQ ID NO: 14450 - protein, 7 aa, Artificial Sequence
  Synthetic construct
YVGYVDF

SEQ ID NO: 14451 - protein, 7 aa, Artificial Sequence
  Synthetic construct
YVGYVDY

SEQ ID NO: 14452 - protein, 7 aa, Artificial Sequence
  Synthetic construct
YVGYVVF

SEQ ID NO: 14453 - protein, 7 aa, Artificial Sequence
  Synthetic construct
YVGYVVY

SEQ ID NO: 14454 - protein, 7 aa, Artificial Sequence
  Synthetic construct
YVGYTFF

SEQ ID NO: 14455 - protein, 7 aa, Artificial Sequence
  Synthetic construct
YVGYTFY

SEQ ID NO: 14456 - protein, 7 aa, Artificial Sequence
  Synthetic construct
YVGYTRF

SEQ ID NO: 14457 - protein, 7 aa, Artificial Sequence
  Synthetic construct
YVGYTRY

SEQ ID NO: 14458 - protein, 7 aa, Artificial Sequence
  Synthetic construct
YVGYTCF

SEQ ID NO: 14459 - protein, 7 aa, Artificial Sequence
  Synthetic construct
YVGYTCY

SEQ ID NO: 14460 - protein, 7 aa, Artificial Sequence
  Synthetic construct
YVGYTLF

SEQ ID NO: 14461 - protein, 7 aa, Artificial Sequence
  Synthetic construct
YVGYTLY

SEQ ID NO: 14462 - protein, 7 aa, Artificial Sequence
  Synthetic construct
YVGYTAF

SEQ ID NO: 14463 - protein, 7 aa, Artificial Sequence
  Synthetic construct
YVGYTAY

SEQ ID NO: 14464 - protein, 7 aa, Artificial Sequence
  Synthetic construct
YVGYTQF

SEQ ID NO: 14465 - protein, 7 aa, Artificial Sequence
  Synthetic construct
YVGYTQY

SEQ ID NO: 14466 - protein, 7 aa, Artificial Sequence
  Synthetic construct
YVGYTDF

SEQ ID NO: 14467 - protein, 7 aa, Artificial Sequence
  Synthetic construct
YVGYTDY

SEQ ID NO: 14468 - protein, 7 aa, Artificial Sequence
  Synthetic construct
YVGYTVF

SEQ ID NO: 14469 - protein, 7 aa, Artificial Sequence
  Synthetic construct
YVGYTVY

SEQ ID NO: 14470 - protein, 7 aa, Artificial Sequence
  Synthetic construct
YVGYGFF

SEQ ID NO: 14471 - protein, 7 aa, Artificial Sequence
  Synthetic construct
YVGYGFY

SEQ ID NO: 14472 - protein, 7 aa, Artificial Sequence
  Synthetic construct
YVGYGRF

SEQ ID NO: 14473 - protein, 7 aa, Artificial Sequence
  Synthetic construct
YVGYGRY

SEQ ID NO: 14474 - protein, 7 aa, Artificial Sequence
  Synthetic construct
YVGYGCF

SEQ ID NO: 14475 - protein, 7 aa, Artificial Sequence
  Synthetic construct
YVGYGCY

SEQ ID NO: 14476 - protein, 7 aa, Artificial Sequence
  Synthetic construct
YVGYGLF

SEQ ID NO: 14477 - protein, 7 aa, Artificial Sequence
  Synthetic construct
YVGYGLY

SEQ ID NO: 14478 - protein, 7 aa, Artificial Sequence
  Synthetic construct
YVGYGAF

SEQ ID NO: 14479 - protein, 7 aa, Artificial Sequence
  Synthetic construct
YVGYGAY

SEQ ID NO: 14480 - protein, 7 aa, Artificial Sequence
  Synthetic construct
YVGYGQF

SEQ ID NO: 14481 - protein, 7 aa, Artificial Sequence
  Synthetic construct
YVGYGQY

SEQ ID NO: 14482 - protein, 7 aa, Artificial Sequence
  Synthetic construct
YVGYGDF

SEQ ID NO: 14483 - protein, 7 aa, Artificial Sequence
  Synthetic construct
YVGYGDY

SEQ ID NO: 14484 - protein, 7 aa, Artificial Sequence
  Synthetic construct
YVGYGVF

SEQ ID NO: 14485 - protein, 7 aa, Artificial Sequence
  Synthetic construct
YVGYGVY

SEQ ID NO: 14486 - protein, 7 aa, Artificial Sequence
  Synthetic construct
YVGYAFF

SEQ ID NO: 14487 - protein, 7 aa, Artificial Sequence
  Synthetic construct
YVGYAFY

SEQ ID NO: 14488 - protein, 7 aa, Artificial Sequence
  Synthetic construct
YVGYARF

SEQ ID NO: 14489 - protein, 7 aa, Artificial Sequence
  Synthetic construct
YVGYARY

SEQ ID NO: 14490 - protein, 7 aa, Artificial Sequence
  Synthetic construct
YVGYACF

SEQ ID NO: 14491 - protein, 7 aa, Artificial Sequence
  Synthetic construct
YVGYACY

SEQ ID NO: 14492 - protein, 7 aa, Artificial Sequence
  Synthetic construct
YVGYALF

SEQ ID NO: 14493 - protein, 7 aa, Artificial Sequence
  Synthetic construct
YVGYALY

SEQ ID NO: 14494 - protein, 7 aa, Artificial Sequence
  Synthetic construct
YVGYAAF

SEQ ID NO: 14495 - protein, 7 aa, Artificial Sequence
  Synthetic construct
YVGYAAY

SEQ ID NO: 14496 - protein, 7 aa, Artificial Sequence
  Synthetic construct
YVGYAQF

SEQ ID NO: 14497 - protein, 7 aa, Artificial Sequence
  Synthetic construct
YVGYAQY

SEQ ID NO: 14498 - protein, 7 aa, Artificial Sequence
  Synthetic construct
YVGYADF

SEQ ID NO: 14499 - protein, 7 aa, Artificial Sequence
  Synthetic construct
YVGYADY

SEQ ID NO: 14500 - protein, 7 aa, Artificial Sequence
  Synthetic construct
YVGYAVF

SEQ ID NO: 14501 - protein, 7 aa, Artificial Sequence
  Synthetic construct
YVGYAVY

SEQ ID NO: 14502 - protein, 7 aa, Artificial Sequence
  Synthetic construct
YVGYQFF

SEQ ID NO: 14503 - protein, 7 aa, Artificial Sequence
  Synthetic construct
YVGYQFY

SEQ ID NO: 14504 - protein, 7 aa, Artificial Sequence
  Synthetic construct
YVGYQRF

SEQ ID NO: 14505 - protein, 7 aa, Artificial Sequence
  Synthetic construct
YVGYQRY

SEQ ID NO: 14506 - protein, 7 aa, Artificial Sequence
  Synthetic construct
YVGYQCF

SEQ ID NO: 14507 - protein, 7 aa, Artificial Sequence
  Synthetic construct
YVGYQCY

SEQ ID NO: 14508 - protein, 7 aa, Artificial Sequence
  Synthetic construct
YVGYQLF

SEQ ID NO: 14509 - protein, 7 aa, Artificial Sequence
  Synthetic construct
YVGYQLY

SEQ ID NO: 14510 - protein, 7 aa, Artificial Sequence
  Synthetic construct
YVGYQAF

SEQ ID NO: 14511 - protein, 7 aa, Artificial Sequence
  Synthetic construct
YVGYQAY

SEQ ID NO: 14512 - protein, 7 aa, Artificial Sequence
  Synthetic construct
YVGYQQF

SEQ ID NO: 14513 - protein, 7 aa, Artificial Sequence
  Synthetic construct
YVGYQQY

SEQ ID NO: 14514 - protein, 7 aa, Artificial Sequence
  Synthetic construct
YVGYQDF

SEQ ID NO: 14515 - protein, 7 aa, Artificial Sequence
  Synthetic construct
YVGYQDY

SEQ ID NO: 14516 - protein, 7 aa, Artificial Sequence
  Synthetic construct
YVGYQVF

SEQ ID NO: 14517 - protein, 7 aa, Artificial Sequence
  Synthetic construct
YVGYQVY

SEQ ID NO: 14518 - protein, 7 aa, Artificial Sequence
  Synthetic construct
YVGPIFF

SEQ ID NO: 14519 - protein, 7 aa, Artificial Sequence
  Synthetic construct
YVGPIFY

SEQ ID NO: 14520 - protein, 7 aa, Artificial Sequence
  Synthetic construct
YVGPIRF

SEQ ID NO: 14521 - protein, 7 aa, Artificial Sequence
  Synthetic construct
YVGPIRY

SEQ ID NO: 14522 - protein, 7 aa, Artificial Sequence
  Synthetic construct
YVGPICF

SEQ ID NO: 14523 - protein, 7 aa, Artificial Sequence
  Synthetic construct
YVGPICY

SEQ ID NO: 14524 - protein, 7 aa, Artificial Sequence
  Synthetic construct
YVGPILF

SEQ ID NO: 14525 - protein, 7 aa, Artificial Sequence
  Synthetic construct
YVGPILY

SEQ ID NO: 14526 - protein, 7 aa, Artificial Sequence
  Synthetic construct
YVGPIAF

SEQ ID NO: 14527 - protein, 7 aa, Artificial Sequence
  Synthetic construct
YVGPIAY

SEQ ID NO: 14528 - protein, 7 aa, Artificial Sequence
  Synthetic construct
YVGPIQF

SEQ ID NO: 14529 - protein, 7 aa, Artificial Sequence
  Synthetic construct
YVGPIQY

SEQ ID NO: 14530 - protein, 7 aa, Artificial Sequence
  Synthetic construct
YVGPIDF

SEQ ID NO: 14531 - protein, 7 aa, Artificial Sequence
  Synthetic construct
YVGPIDY

SEQ ID NO: 14532 - protein, 7 aa, Artificial Sequence
  Synthetic construct
YVGPIVF

SEQ ID NO: 14533 - protein, 7 aa, Artificial Sequence
  Synthetic construct
YVGPIVY

SEQ ID NO: 14534 - protein, 7 aa, Artificial Sequence
  Synthetic construct
YVGPDFF

SEQ ID NO: 14535 - protein, 7 aa, Artificial Sequence
  Synthetic construct
YVGPDFY

SEQ ID NO: 14536 - protein, 7 aa, Artificial Sequence
  Synthetic construct
YVGPDRF

SEQ ID NO: 14537 - protein, 7 aa, Artificial Sequence
  Synthetic construct
YVGPDRY

SEQ ID NO: 14538 - protein, 7 aa, Artificial Sequence
  Synthetic construct
YVGPDCF

SEQ ID NO: 14539 - protein, 7 aa, Artificial Sequence
  Synthetic construct
YVGPDCY

SEQ ID NO: 14540 - protein, 7 aa, Artificial Sequence
  Synthetic construct
YVGPDLF

SEQ ID NO: 14541 - protein, 7 aa, Artificial Sequence
  Synthetic construct
YVGPDLY

SEQ ID NO: 14542 - protein, 7 aa, Artificial Sequence
  Synthetic construct
YVGPDAF

SEQ ID NO: 14543 - protein, 7 aa, Artificial Sequence
  Synthetic construct
YVGPDAY

SEQ ID NO: 14544 - protein, 7 aa, Artificial Sequence
  Synthetic construct
YVGPDQF

SEQ ID NO: 14545 - protein, 7 aa, Artificial Sequence
  Synthetic construct
YVGPDQY

SEQ ID NO: 14546 - protein, 7 aa, Artificial Sequence
  Synthetic construct
YVGPDDF

SEQ ID NO: 14547 - protein, 7 aa, Artificial Sequence
  Synthetic construct
YVGPDDY

SEQ ID NO: 14548 - protein, 7 aa, Artificial Sequence
  Synthetic construct
YVGPDVF

SEQ ID NO: 14549 - protein, 7 aa, Artificial Sequence
  Synthetic construct
YVGPDVY

SEQ ID NO: 14550 - protein, 7 aa, Artificial Sequence
  Synthetic construct
YVGPYFF

SEQ ID NO: 14551 - protein, 7 aa, Artificial Sequence
  Synthetic construct
YVGPYFY

SEQ ID NO: 14552 - protein, 7 aa, Artificial Sequence
  Synthetic construct
YVGPYRF

SEQ ID NO: 14553 - protein, 7 aa, Artificial Sequence
  Synthetic construct
YVGPYRY

SEQ ID NO: 14554 - protein, 7 aa, Artificial Sequence
  Synthetic construct
YVGPYCF

SEQ ID NO: 14555 - protein, 7 aa, Artificial Sequence
  Synthetic construct
YVGPYCY

SEQ ID NO: 14556 - protein, 7 aa, Artificial Sequence
  Synthetic construct
YVGPYLF

SEQ ID NO: 14557 - protein, 7 aa, Artificial Sequence
  Synthetic construct
YVGPYLY

SEQ ID NO: 14558 - protein, 7 aa, Artificial Sequence
  Synthetic construct
YVGPYAF

SEQ ID NO: 14559 - protein, 7 aa, Artificial Sequence
  Synthetic construct
YVGPYAY

SEQ ID NO: 14560 - protein, 7 aa, Artificial Sequence
  Synthetic construct
YVGPYQF

SEQ ID NO: 14561 - protein, 7 aa, Artificial Sequence
  Synthetic construct
YVGPYQY

SEQ ID NO: 14562 - protein, 7 aa, Artificial Sequence
  Synthetic construct
YVGPYDF

SEQ ID NO: 14563 - protein, 7 aa, Artificial Sequence
  Synthetic construct
YVGPYDY

SEQ ID NO: 14564 - protein, 7 aa, Artificial Sequence
  Synthetic construct
YVGPYVF

SEQ ID NO: 14565 - protein, 7 aa, Artificial Sequence
  Synthetic construct
YVGPYVY

SEQ ID NO: 14566 - protein, 7 aa, Artificial Sequence
  Synthetic construct
YVGPFFF

SEQ ID NO: 14567 - protein, 7 aa, Artificial Sequence
  Synthetic construct
YVGPFFY

SEQ ID NO: 14568 - protein, 7 aa, Artificial Sequence
  Synthetic construct
YVGPFRF

SEQ ID NO: 14569 - protein, 7 aa, Artificial Sequence
  Synthetic construct
YVGPFRY

SEQ ID NO: 14570 - protein, 7 aa, Artificial Sequence
  Synthetic construct
YVGPFCF

SEQ ID NO: 14571 - protein, 7 aa, Artificial Sequence
  Synthetic construct
YVGPFCY

SEQ ID NO: 14572 - protein, 7 aa, Artificial Sequence
  Synthetic construct
YVGPFLF

SEQ ID NO: 14573 - protein, 7 aa, Artificial Sequence
  Synthetic construct
YVGPFLY

SEQ ID NO: 14574 - protein, 7 aa, Artificial Sequence
  Synthetic construct
YVGPFAF

SEQ ID NO: 14575 - protein, 7 aa, Artificial Sequence
  Synthetic construct
YVGPFAY

SEQ ID NO: 14576 - protein, 7 aa, Artificial Sequence
  Synthetic construct
YVGPFQF

SEQ ID NO: 14577 - protein, 7 aa, Artificial Sequence
  Synthetic construct
YVGPFQY

SEQ ID NO: 14578 - protein, 7 aa, Artificial Sequence
  Synthetic construct
YVGPFDF

SEQ ID NO: 14579 - protein, 7 aa, Artificial Sequence
  Synthetic construct
YVGPFDY

SEQ ID NO: 14580 - protein, 7 aa, Artificial Sequence
  Synthetic construct
YVGPFVF

SEQ ID NO: 14581 - protein, 7 aa, Artificial Sequence
  Synthetic construct
YVGPFVY

SEQ ID NO: 14582 - protein, 7 aa, Artificial Sequence
  Synthetic construct
YVGPVFF

SEQ ID NO: 14583 - protein, 7 aa, Artificial Sequence
  Synthetic construct
YVGPVFY

SEQ ID NO: 14584 - protein, 7 aa, Artificial Sequence
  Synthetic construct
YVGPVRF

SEQ ID NO: 14585 - protein, 7 aa, Artificial Sequence
  Synthetic construct
YVGPVRY

SEQ ID NO: 14586 - protein, 7 aa, Artificial Sequence
  Synthetic construct
YVGPVCF

SEQ ID NO: 14587 - protein, 7 aa, Artificial Sequence
  Synthetic construct
YVGPVCY

SEQ ID NO: 14588 - protein, 7 aa, Artificial Sequence
  Synthetic construct
YVGPVLF

SEQ ID NO: 14589 - protein, 7 aa, Artificial Sequence
  Synthetic construct
YVGPVLY

SEQ ID NO: 14590 - protein, 7 aa, Artificial Sequence
  Synthetic construct
YVGPVAF

SEQ ID NO: 14591 - protein, 7 aa, Artificial Sequence
  Synthetic construct
YVGPVAY

SEQ ID NO: 14592 - protein, 7 aa, Artificial Sequence
  Synthetic construct
YVGPVQF

SEQ ID NO: 14593 - protein, 7 aa, Artificial Sequence
  Synthetic construct
YVGPVQY

SEQ ID NO: 14594 - protein, 7 aa, Artificial Sequence
  Synthetic construct
YVGPVDF

SEQ ID NO: 14595 - protein, 7 aa, Artificial Sequence
  Synthetic construct
YVGPVDY

SEQ ID NO: 14596 - protein, 7 aa, Artificial Sequence
  Synthetic construct
YVGPVVF

SEQ ID NO: 14597 - protein, 7 aa, Artificial Sequence
  Synthetic construct
YVGPVVY

SEQ ID NO: 14598 - protein, 7 aa, Artificial Sequence
  Synthetic construct
YVGPTFF

SEQ ID NO: 14599 - protein, 7 aa, Artificial Sequence
  Synthetic construct
YVGPTFY

SEQ ID NO: 14600 - protein, 7 aa, Artificial Sequence
  Synthetic construct
YVGPTRF

SEQ ID NO: 14601 - protein, 7 aa, Artificial Sequence
  Synthetic construct
YVGPTRY

SEQ ID NO: 14602 - protein, 7 aa, Artificial Sequence
  Synthetic construct
YVGPTCF

SEQ ID NO: 14603 - protein, 7 aa, Artificial Sequence
  Synthetic construct
YVGPTCY

SEQ ID NO: 14604 - protein, 7 aa, Artificial Sequence
  Synthetic construct
YVGPTLF

SEQ ID NO: 14605 - protein, 7 aa, Artificial Sequence
  Synthetic construct
YVGPTLY

SEQ ID NO: 14606 - protein, 7 aa, Artificial Sequence
  Synthetic construct
YVGPTAF

SEQ ID NO: 14607 - protein, 7 aa, Artificial Sequence
  Synthetic construct
YVGPTAY

SEQ ID NO: 14608 - protein, 7 aa, Artificial Sequence
  Synthetic construct
YVGPTQF

SEQ ID NO: 14609 - protein, 7 aa, Artificial Sequence
  Synthetic construct
YVGPTQY

SEQ ID NO: 14610 - protein, 7 aa, Artificial Sequence
  Synthetic construct
YVGPTDF

SEQ ID NO: 14611 - protein, 7 aa, Artificial Sequence
  Synthetic construct
YVGPTDY

SEQ ID NO: 14612 - protein, 7 aa, Artificial Sequence
  Synthetic construct
YVGPTVF

SEQ ID NO: 14613 - protein, 7 aa, Artificial Sequence
  Synthetic construct
YVGPTVY

SEQ ID NO: 14614 - protein, 7 aa, Artificial Sequence
  Synthetic construct
YVGPGFF

SEQ ID NO: 14615 - protein, 7 aa, Artificial Sequence
  Synthetic construct
YVGPGFY

SEQ ID NO: 14616 - protein, 7 aa, Artificial Sequence
  Synthetic construct
YVGPGRF

SEQ ID NO: 14617 - protein, 7 aa, Artificial Sequence
  Synthetic construct
YVGPGRY

SEQ ID NO: 14618 - protein, 7 aa, Artificial Sequence
  Synthetic construct
YVGPGCF

SEQ ID NO: 14619 - protein, 7 aa, Artificial Sequence
  Synthetic construct
YVGPGCY

SEQ ID NO: 14620 - protein, 7 aa, Artificial Sequence
  Synthetic construct
YVGPGLF

SEQ ID NO: 14621 - protein, 7 aa, Artificial Sequence
  Synthetic construct
YVGPGLY

SEQ ID NO: 14622 - protein, 7 aa, Artificial Sequence
  Synthetic construct
YVGPGAF

SEQ ID NO: 14623 - protein, 7 aa, Artificial Sequence
  Synthetic construct
YVGPGAY

SEQ ID NO: 14624 - protein, 7 aa, Artificial Sequence
  Synthetic construct
YVGPGQF

SEQ ID NO: 14625 - protein, 7 aa, Artificial Sequence
  Synthetic construct
YVGPGQY

SEQ ID NO: 14626 - protein, 7 aa, Artificial Sequence
  Synthetic construct
YVGPGDF

SEQ ID NO: 14627 - protein, 7 aa, Artificial Sequence
  Synthetic construct
YVGPGDY

SEQ ID NO: 14628 - protein, 7 aa, Artificial Sequence
  Synthetic construct
YVGPGVF

SEQ ID NO: 14629 - protein, 7 aa, Artificial Sequence
  Synthetic construct
YVGPGVY

SEQ ID NO: 14630 - protein, 7 aa, Artificial Sequence
  Synthetic construct
YVGPAFF

SEQ ID NO: 14631 - protein, 7 aa, Artificial Sequence
  Synthetic construct
YVGPAFY

SEQ ID NO: 14632 - protein, 7 aa, Artificial Sequence
  Synthetic construct
YVGPARF

SEQ ID NO: 14633 - protein, 7 aa, Artificial Sequence
  Synthetic construct
YVGPARY

SEQ ID NO: 14634 - protein, 7 aa, Artificial Sequence
  Synthetic construct
YVGPACF

SEQ ID NO: 14635 - protein, 7 aa, Artificial Sequence
  Synthetic construct
YVGPACY

SEQ ID NO: 14636 - protein, 7 aa, Artificial Sequence
  Synthetic construct
YVGPALF

SEQ ID NO: 14637 - protein, 7 aa, Artificial Sequence
  Synthetic construct
YVGPALY

SEQ ID NO: 14638 - protein, 7 aa, Artificial Sequence
  Synthetic construct
YVGPAAF

SEQ ID NO: 14639 - protein, 7 aa, Artificial Sequence
  Synthetic construct
YVGPAAY

SEQ ID NO: 14640 - protein, 7 aa, Artificial Sequence
  Synthetic construct
YVGPAQF

SEQ ID NO: 14641 - protein, 7 aa, Artificial Sequence
  Synthetic construct
YVGPAQY

SEQ ID NO: 14642 - protein, 7 aa, Artificial Sequence
  Synthetic construct
YVGPADF

SEQ ID NO: 14643 - protein, 7 aa, Artificial Sequence
  Synthetic construct
YVGPADY

SEQ ID NO: 14644 - protein, 7 aa, Artificial Sequence
  Synthetic construct
YVGPAVF

SEQ ID NO: 14645 - protein, 7 aa, Artificial Sequence
  Synthetic construct
YVGPAVY

SEQ ID NO: 14646 - protein, 7 aa, Artificial Sequence
  Synthetic construct
YVGPQFF

SEQ ID NO: 14647 - protein, 7 aa, Artificial Sequence
  Synthetic construct
YVGPQFY

SEQ ID NO: 14648 - protein, 7 aa, Artificial Sequence
  Synthetic construct
YVGPQRF

SEQ ID NO: 14649 - protein, 7 aa, Artificial Sequence
  Synthetic construct
YVGPQRY

SEQ ID NO: 14650 - protein, 7 aa, Artificial Sequence
  Synthetic construct
YVGPQCF

SEQ ID NO: 14651 - protein, 7 aa, Artificial Sequence
  Synthetic construct
YVGPQCY

SEQ ID NO: 14652 - protein, 7 aa, Artificial Sequence
  Synthetic construct
YVGPQLF

SEQ ID NO: 14653 - protein, 7 aa, Artificial Sequence
  Synthetic construct
YVGPQLY

SEQ ID NO: 14654 - protein, 7 aa, Artificial Sequence
  Synthetic construct
YVGPQAF

SEQ ID NO: 14655 - protein, 7 aa, Artificial Sequence
  Synthetic construct
YVGPQAY

SEQ ID NO: 14656 - protein, 7 aa, Artificial Sequence
  Synthetic construct
YVGPQQF

SEQ ID NO: 14657 - protein, 7 aa, Artificial Sequence
  Synthetic construct
YVGPQQY

SEQ ID NO: 14658 - protein, 7 aa, Artificial Sequence
  Synthetic construct
YVGPQDF

SEQ ID NO: 14659 - protein, 7 aa, Artificial Sequence
  Synthetic construct
YVGPQDY

SEQ ID NO: 14660 - protein, 7 aa, Artificial Sequence
  Synthetic construct
YVGPQVF

SEQ ID NO: 14661 - protein, 7 aa, Artificial Sequence
  Synthetic construct
YVGPQVY

SEQ ID NO: 14662 - protein, 7 aa, Artificial Sequence
  Synthetic construct
YVGHIFF

SEQ ID NO: 14663 - protein, 7 aa, Artificial Sequence
  Synthetic construct
YVGHIFY

SEQ ID NO: 14664 - protein, 7 aa, Artificial Sequence
  Synthetic construct
YVGHIRF

SEQ ID NO: 14665 - protein, 7 aa, Artificial Sequence
  Synthetic construct
YVGHIRY

SEQ ID NO: 14666 - protein, 7 aa, Artificial Sequence
  Synthetic construct
YVGHICF

SEQ ID NO: 14667 - protein, 7 aa, Artificial Sequence
  Synthetic construct
YVGHICY

SEQ ID NO: 14668 - protein, 7 aa, Artificial Sequence
  Synthetic construct
YVGHILF

SEQ ID NO: 14669 - protein, 7 aa, Artificial Sequence
  Synthetic construct
YVGHILY

SEQ ID NO: 14670 - protein, 7 aa, Artificial Sequence
  Synthetic construct
YVGHIAF

SEQ ID NO: 14671 - protein, 7 aa, Artificial Sequence
  Synthetic construct
YVGHIAY

SEQ ID NO: 14672 - protein, 7 aa, Artificial Sequence
  Synthetic construct
YVGHIQF

SEQ ID NO: 14673 - protein, 7 aa, Artificial Sequence
  Synthetic construct
YVGHIQY

SEQ ID NO: 14674 - protein, 7 aa, Artificial Sequence
  Synthetic construct
YVGHIDF

SEQ ID NO: 14675 - protein, 7 aa, Artificial Sequence
  Synthetic construct
YVGHIDY

SEQ ID NO: 14676 - protein, 7 aa, Artificial Sequence
  Synthetic construct
YVGHIVF

SEQ ID NO: 14677 - protein, 7 aa, Artificial Sequence
  Synthetic construct
YVGHIVY

SEQ ID NO: 14678 - protein, 7 aa, Artificial Sequence
  Synthetic construct
YVGHDFF

SEQ ID NO: 14679 - protein, 7 aa, Artificial Sequence
  Synthetic construct
YVGHDFY

SEQ ID NO: 14680 - protein, 7 aa, Artificial Sequence
  Synthetic construct
YVGHDRF

SEQ ID NO: 14681 - protein, 7 aa, Artificial Sequence
  Synthetic construct
YVGHDRY

SEQ ID NO: 14682 - protein, 7 aa, Artificial Sequence
  Synthetic construct
YVGHDCF

SEQ ID NO: 14683 - protein, 7 aa, Artificial Sequence
  Synthetic construct
YVGHDCY

SEQ ID NO: 14684 - protein, 7 aa, Artificial Sequence
  Synthetic construct
YVGHDLF

SEQ ID NO: 14685 - protein, 7 aa, Artificial Sequence
  Synthetic construct
YVGHDLY

SEQ ID NO: 14686 - protein, 7 aa, Artificial Sequence
  Synthetic construct
YVGHDAF

SEQ ID NO: 14687 - protein, 7 aa, Artificial Sequence
  Synthetic construct
YVGHDAY

SEQ ID NO: 14688 - protein, 7 aa, Artificial Sequence
  Synthetic construct
YVGHDQF

SEQ ID NO: 14689 - protein, 7 aa, Artificial Sequence
  Synthetic construct
YVGHDQY

SEQ ID NO: 14690 - protein, 7 aa, Artificial Sequence
  Synthetic construct
YVGHDDF

SEQ ID NO: 14691 - protein, 7 aa, Artificial Sequence
  Synthetic construct
YVGHDDY

SEQ ID NO: 14692 - protein, 7 aa, Artificial Sequence
  Synthetic construct
YVGHDVF

SEQ ID NO: 14693 - protein, 7 aa, Artificial Sequence
  Synthetic construct
YVGHDVY

SEQ ID NO: 14694 - protein, 7 aa, Artificial Sequence
  Synthetic construct
YVGHYFF

SEQ ID NO: 14695 - protein, 7 aa, Artificial Sequence
  Synthetic construct
YVGHYFY

SEQ ID NO: 14696 - protein, 7 aa, Artificial Sequence
  Synthetic construct
YVGHYRF

SEQ ID NO: 14697 - protein, 7 aa, Artificial Sequence
  Synthetic construct
YVGHYRY

SEQ ID NO: 14698 - protein, 7 aa, Artificial Sequence
  Synthetic construct
YVGHYCF

SEQ ID NO: 14699 - protein, 7 aa, Artificial Sequence
  Synthetic construct
YVGHYCY

SEQ ID NO: 14700 - protein, 7 aa, Artificial Sequence
  Synthetic construct
YVGHYLF

SEQ ID NO: 14701 - protein, 7 aa, Artificial Sequence
  Synthetic construct
YVGHYLY

SEQ ID NO: 14702 - protein, 7 aa, Artificial Sequence
  Synthetic construct
YVGHYAF

SEQ ID NO: 14703 - protein, 7 aa, Artificial Sequence
  Synthetic construct
YVGHYAY

SEQ ID NO: 14704 - protein, 7 aa, Artificial Sequence
  Synthetic construct
YVGHYQF

SEQ ID NO: 14705 - protein, 7 aa, Artificial Sequence
  Synthetic construct
YVGHYQY

SEQ ID NO: 14706 - protein, 7 aa, Artificial Sequence
  Synthetic construct
YVGHYDF

SEQ ID NO: 14707 - protein, 7 aa, Artificial Sequence
  Synthetic construct
YVGHYDY

SEQ ID NO: 14708 - protein, 7 aa, Artificial Sequence
  Synthetic construct
YVGHYVF

SEQ ID NO: 14709 - protein, 7 aa, Artificial Sequence
  Synthetic construct
YVGHYVY

SEQ ID NO: 14710 - protein, 7 aa, Artificial Sequence
  Synthetic construct
YVGHFFF

SEQ ID NO: 14711 - protein, 7 aa, Artificial Sequence
  Synthetic construct
YVGHFFY

SEQ ID NO: 14712 - protein, 7 aa, Artificial Sequence
  Synthetic construct
YVGHFRF

SEQ ID NO: 14713 - protein, 7 aa, Artificial Sequence
  Synthetic construct
YVGHFRY

SEQ ID NO: 14714 - protein, 7 aa, Artificial Sequence
  Synthetic construct
YVGHFCF

SEQ ID NO: 14715 - protein, 7 aa, Artificial Sequence
  Synthetic construct
YVGHFCY

SEQ ID NO: 14716 - protein, 7 aa, Artificial Sequence
  Synthetic construct
YVGHFLF

SEQ ID NO: 14717 - protein, 7 aa, Artificial Sequence
  Synthetic construct
YVGHFLY

SEQ ID NO: 14718 - protein, 7 aa, Artificial Sequence
  Synthetic construct
YVGHFAF

SEQ ID NO: 14719 - protein, 7 aa, Artificial Sequence
  Synthetic construct
YVGHFAY

SEQ ID NO: 14720 - protein, 7 aa, Artificial Sequence
  Synthetic construct
YVGHFQF

SEQ ID NO: 14721 - protein, 7 aa, Artificial Sequence
  Synthetic construct
YVGHFQY

SEQ ID NO: 14722 - protein, 7 aa, Artificial Sequence
  Synthetic construct
YVGHFDF

SEQ ID NO: 14723 - protein, 7 aa, Artificial Sequence
  Synthetic construct
YVGHFDY

SEQ ID NO: 14724 - protein, 7 aa, Artificial Sequence
  Synthetic construct
YVGHFVF

SEQ ID NO: 14725 - protein, 7 aa, Artificial Sequence
  Synthetic construct
YVGHFVY

SEQ ID NO: 14726 - protein, 7 aa, Artificial Sequence
  Synthetic construct
YVGHVFF

SEQ ID NO: 14727 - protein, 7 aa, Artificial Sequence
  Synthetic construct
YVGHVFY

SEQ ID NO: 14728 - protein, 7 aa, Artificial Sequence
  Synthetic construct
YVGHVRF

SEQ ID NO: 14729 - protein, 7 aa, Artificial Sequence
  Synthetic construct
YVGHVRY

SEQ ID NO: 14730 - protein, 7 aa, Artificial Sequence
  Synthetic construct
YVGHVCF

SEQ ID NO: 14731 - protein, 7 aa, Artificial Sequence
  Synthetic construct
YVGHVCY

SEQ ID NO: 14732 - protein, 7 aa, Artificial Sequence
  Synthetic construct
YVGHVLF

SEQ ID NO: 14733 - protein, 7 aa, Artificial Sequence
  Synthetic construct
YVGHVLY

SEQ ID NO: 14734 - protein, 7 aa, Artificial Sequence
  Synthetic construct
YVGHVAF

SEQ ID NO: 14735 - protein, 7 aa, Artificial Sequence
  Synthetic construct
YVGHVAY

SEQ ID NO: 14736 - protein, 7 aa, Artificial Sequence
  Synthetic construct
YVGHVQF

SEQ ID NO: 14737 - protein, 7 aa, Artificial Sequence
  Synthetic construct
YVGHVQY

SEQ ID NO: 14738 - protein, 7 aa, Artificial Sequence
  Synthetic construct
YVGHVDF

SEQ ID NO: 14739 - protein, 7 aa, Artificial Sequence
  Synthetic construct
YVGHVDY

SEQ ID NO: 14740 - protein, 7 aa, Artificial Sequence
  Synthetic construct
YVGHVVF

SEQ ID NO: 14741 - protein, 7 aa, Artificial Sequence
  Synthetic construct
YVGHVVY

SEQ ID NO: 14742 - protein, 7 aa, Artificial Sequence
  Synthetic construct
YVGHTFF

SEQ ID NO: 14743 - protein, 7 aa, Artificial Sequence
  Synthetic construct
YVGHTFY

SEQ ID NO: 14744 - protein, 7 aa, Artificial Sequence
  Synthetic construct
YVGHTRF

SEQ ID NO: 14745 - protein, 7 aa, Artificial Sequence
  Synthetic construct
YVGHTRY

SEQ ID NO: 14746 - protein, 7 aa, Artificial Sequence
  Synthetic construct
YVGHTCF

SEQ ID NO: 14747 - protein, 7 aa, Artificial Sequence
  Synthetic construct
YVGHTCY

SEQ ID NO: 14748 - protein, 7 aa, Artificial Sequence
  Synthetic construct
YVGHTLF

SEQ ID NO: 14749 - protein, 7 aa, Artificial Sequence
  Synthetic construct
YVGHTLY

SEQ ID NO: 14750 - protein, 7 aa, Artificial Sequence
  Synthetic construct
YVGHTAF

SEQ ID NO: 14751 - protein, 7 aa, Artificial Sequence
  Synthetic construct
YVGHTAY

SEQ ID NO: 14752 - protein, 7 aa, Artificial Sequence
  Synthetic construct
YVGHTQF

SEQ ID NO: 14753 - protein, 7 aa, Artificial Sequence
  Synthetic construct
YVGHTQY

SEQ ID NO: 14754 - protein, 7 aa, Artificial Sequence
  Synthetic construct
YVGHTDF

SEQ ID NO: 14755 - protein, 7 aa, Artificial Sequence
  Synthetic construct
YVGHTDY

SEQ ID NO: 14756 - protein, 7 aa, Artificial Sequence
  Synthetic construct
YVGHTVF

SEQ ID NO: 14757 - protein, 7 aa, Artificial Sequence
  Synthetic construct
YVGHTVY

SEQ ID NO: 14758 - protein, 7 aa, Artificial Sequence
  Synthetic construct
YVGHGFF

SEQ ID NO: 14759 - protein, 7 aa, Artificial Sequence
  Synthetic construct
YVGHGFY

SEQ ID NO: 14760 - protein, 7 aa, Artificial Sequence
  Synthetic construct
YVGHGRF

SEQ ID NO: 14761 - protein, 7 aa, Artificial Sequence
  Synthetic construct
YVGHGRY

SEQ ID NO: 14762 - protein, 7 aa, Artificial Sequence
  Synthetic construct
YVGHGCF

SEQ ID NO: 14763 - protein, 7 aa, Artificial Sequence
  Synthetic construct
YVGHGCY

SEQ ID NO: 14764 - protein, 7 aa, Artificial Sequence
  Synthetic construct
YVGHGLF

SEQ ID NO: 14765 - protein, 7 aa, Artificial Sequence
  Synthetic construct
YVGHGLY

SEQ ID NO: 14766 - protein, 7 aa, Artificial Sequence
  Synthetic construct
YVGHGAF

SEQ ID NO: 14767 - protein, 7 aa, Artificial Sequence
  Synthetic construct
YVGHGAY

SEQ ID NO: 14768 - protein, 7 aa, Artificial Sequence
  Synthetic construct
YVGHGQF

SEQ ID NO: 14769 - protein, 7 aa, Artificial Sequence
  Synthetic construct
YVGHGQY

SEQ ID NO: 14770 - protein, 7 aa, Artificial Sequence
  Synthetic construct
YVGHGDF

SEQ ID NO: 14771 - protein, 7 aa, Artificial Sequence
  Synthetic construct
YVGHGDY

SEQ ID NO: 14772 - protein, 7 aa, Artificial Sequence
  Synthetic construct
YVGHGVF

SEQ ID NO: 14773 - protein, 7 aa, Artificial Sequence
  Synthetic construct
YVGHGVY

SEQ ID NO: 14774 - protein, 7 aa, Artificial Sequence
  Synthetic construct
YVGHAFF

SEQ ID NO: 14775 - protein, 7 aa, Artificial Sequence
  Synthetic construct
YVGHAFY

SEQ ID NO: 14776 - protein, 7 aa, Artificial Sequence
  Synthetic construct
YVGHARF

SEQ ID NO: 14777 - protein, 7 aa, Artificial Sequence
  Synthetic construct
YVGHARY

SEQ ID NO: 14778 - protein, 7 aa, Artificial Sequence
  Synthetic construct
YVGHACF

SEQ ID NO: 14779 - protein, 7 aa, Artificial Sequence
  Synthetic construct
YVGHACY

SEQ ID NO: 14780 - protein, 7 aa, Artificial Sequence
  Synthetic construct
YVGHALF

SEQ ID NO: 14781 - protein, 7 aa, Artificial Sequence
  Synthetic construct
YVGHALY

SEQ ID NO: 14782 - protein, 7 aa, Artificial Sequence
  Synthetic construct
YVGHAAF

SEQ ID NO: 14783 - protein, 7 aa, Artificial Sequence
  Synthetic construct
YVGHAAY

SEQ ID NO: 14784 - protein, 7 aa, Artificial Sequence
  Synthetic construct
YVGHAQF

SEQ ID NO: 14785 - protein, 7 aa, Artificial Sequence
  Synthetic construct
YVGHAQY

SEQ ID NO: 14786 - protein, 7 aa, Artificial Sequence
  Synthetic construct
YVGHADF

SEQ ID NO: 14787 - protein, 7 aa, Artificial Sequence
  Synthetic construct
YVGHADY

SEQ ID NO: 14788 - protein, 7 aa, Artificial Sequence
  Synthetic construct
YVGHAVF

SEQ ID NO: 14789 - protein, 7 aa, Artificial Sequence
  Synthetic construct
YVGHAVY

SEQ ID NO: 14790 - protein, 7 aa, Artificial Sequence
  Synthetic construct
YVGHQFF

SEQ ID NO: 14791 - protein, 7 aa, Artificial Sequence
  Synthetic construct
YVGHQFY

SEQ ID NO: 14792 - protein, 7 aa, Artificial Sequence
  Synthetic construct
YVGHQRF

SEQ ID NO: 14793 - protein, 7 aa, Artificial Sequence
  Synthetic construct
YVGHQRY

SEQ ID NO: 14794 - protein, 7 aa, Artificial Sequence
  Synthetic construct
YVGHQCF

SEQ ID NO: 14795 - protein, 7 aa, Artificial Sequence
  Synthetic construct
YVGHQCY

SEQ ID NO: 14796 - protein, 7 aa, Artificial Sequence
  Synthetic construct
YVGHQLF

SEQ ID NO: 14797 - protein, 7 aa, Artificial Sequence
  Synthetic construct
YVGHQLY

SEQ ID NO: 14798 - protein, 7 aa, Artificial Sequence
  Synthetic construct
YVGHQAF

SEQ ID NO: 14799 - protein, 7 aa, Artificial Sequence
  Synthetic construct
YVGHQAY

SEQ ID NO: 14800 - protein, 7 aa, Artificial Sequence
  Synthetic construct
YVGHQQF

SEQ ID NO: 14801 - protein, 7 aa, Artificial Sequence
  Synthetic construct
YVGHQQY

SEQ ID NO: 14802 - protein, 7 aa, Artificial Sequence
  Synthetic construct
YVGHQDF

SEQ ID NO: 14803 - protein, 7 aa, Artificial Sequence
  Synthetic construct
YVGHQDY

SEQ ID NO: 14804 - protein, 7 aa, Artificial Sequence
  Synthetic construct
YVGHQVF

SEQ ID NO: 14805 - protein, 7 aa, Artificial Sequence
  Synthetic construct
YVGHQVY

SEQ ID NO: 14806 - protein, 7 aa, Artificial Sequence
  Synthetic construct
YVGLIFF

SEQ ID NO: 14807 - protein, 7 aa, Artificial Sequence
  Synthetic construct
YVGLIFY

SEQ ID NO: 14808 - protein, 7 aa, Artificial Sequence
  Synthetic construct
YVGLIRF

SEQ ID NO: 14809 - protein, 7 aa, Artificial Sequence
  Synthetic construct
YVGLIRY

SEQ ID NO: 14810 - protein, 7 aa, Artificial Sequence
  Synthetic construct
YVGLICF

SEQ ID NO: 14811 - protein, 7 aa, Artificial Sequence
  Synthetic construct
YVGLICY

SEQ ID NO: 14812 - protein, 7 aa, Artificial Sequence
  Synthetic construct
YVGLILF

SEQ ID NO: 14813 - protein, 7 aa, Artificial Sequence
  Synthetic construct
YVGLILY

SEQ ID NO: 14814 - protein, 7 aa, Artificial Sequence
  Synthetic construct
YVGLIAF

SEQ ID NO: 14815 - protein, 7 aa, Artificial Sequence
  Synthetic construct
YVGLIAY

SEQ ID NO: 14816 - protein, 7 aa, Artificial Sequence
  Synthetic construct
YVGLIQF

SEQ ID NO: 14817 - protein, 7 aa, Artificial Sequence
  Synthetic construct
YVGLIQY

SEQ ID NO: 14818 - protein, 7 aa, Artificial Sequence
  Synthetic construct
YVGLIDF

SEQ ID NO: 14819 - protein, 7 aa, Artificial Sequence
  Synthetic construct
YVGLIDY

SEQ ID NO: 14820 - protein, 7 aa, Artificial Sequence
  Synthetic construct
YVGLIVF

SEQ ID NO: 14821 - protein, 7 aa, Artificial Sequence
  Synthetic construct
YVGLIVY

SEQ ID NO: 14822 - protein, 7 aa, Artificial Sequence
  Synthetic construct
YVGLDFF

SEQ ID NO: 14823 - protein, 7 aa, Artificial Sequence
  Synthetic construct
YVGLDFY

SEQ ID NO: 14824 - protein, 7 aa, Artificial Sequence
  Synthetic construct
YVGLDRF

SEQ ID NO: 14825 - protein, 7 aa, Artificial Sequence
  Synthetic construct
YVGLDRY

SEQ ID NO: 14826 - protein, 7 aa, Artificial Sequence
  Synthetic construct
YVGLDCF

SEQ ID NO: 14827 - protein, 7 aa, Artificial Sequence
  Synthetic construct
YVGLDCY

SEQ ID NO: 14828 - protein, 7 aa, Artificial Sequence
  Synthetic construct
YVGLDLF

SEQ ID NO: 14829 - protein, 7 aa, Artificial Sequence
  Synthetic construct
YVGLDLY

SEQ ID NO: 14830 - protein, 7 aa, Artificial Sequence
  Synthetic construct
YVGLDAF

SEQ ID NO: 14831 - protein, 7 aa, Artificial Sequence
  Synthetic construct
YVGLDAY

SEQ ID NO: 14832 - protein, 7 aa, Artificial Sequence
  Synthetic construct
YVGLDQF

SEQ ID NO: 14833 - protein, 7 aa, Artificial Sequence
  Synthetic construct
YVGLDQY

SEQ ID NO: 14834 - protein, 7 aa, Artificial Sequence
  Synthetic construct
YVGLDDF

SEQ ID NO: 14835 - protein, 7 aa, Artificial Sequence
  Synthetic construct
YVGLDDY

SEQ ID NO: 14836 - protein, 7 aa, Artificial Sequence
  Synthetic construct
YVGLDVF

SEQ ID NO: 14837 - protein, 7 aa, Artificial Sequence
  Synthetic construct
YVGLDVY

SEQ ID NO: 14838 - protein, 7 aa, Artificial Sequence
  Synthetic construct
YVGLYFF

SEQ ID NO: 14839 - protein, 7 aa, Artificial Sequence
  Synthetic construct
YVGLYFY

SEQ ID NO: 14840 - protein, 7 aa, Artificial Sequence
  Synthetic construct
YVGLYRF

SEQ ID NO: 14841 - protein, 7 aa, Artificial Sequence
  Synthetic construct
YVGLYRY

SEQ ID NO: 14842 - protein, 7 aa, Artificial Sequence
  Synthetic construct
YVGLYCF

SEQ ID NO: 14843 - protein, 7 aa, Artificial Sequence
  Synthetic construct
YVGLYCY

SEQ ID NO: 14844 - protein, 7 aa, Artificial Sequence
  Synthetic construct
YVGLYLF

SEQ ID NO: 14845 - protein, 7 aa, Artificial Sequence
  Synthetic construct
YVGLYLY

SEQ ID NO: 14846 - protein, 7 aa, Artificial Sequence
  Synthetic construct
YVGLYAF

SEQ ID NO: 14847 - protein, 7 aa, Artificial Sequence
  Synthetic construct
YVGLYAY

SEQ ID NO: 14848 - protein, 7 aa, Artificial Sequence
  Synthetic construct
YVGLYQF

SEQ ID NO: 14849 - protein, 7 aa, Artificial Sequence
  Synthetic construct
YVGLYQY

SEQ ID NO: 14850 - protein, 7 aa, Artificial Sequence
  Synthetic construct
YVGLYDF

SEQ ID NO: 14851 - protein, 7 aa, Artificial Sequence
  Synthetic construct
YVGLYDY

SEQ ID NO: 14852 - protein, 7 aa, Artificial Sequence
  Synthetic construct
YVGLYVF

SEQ ID NO: 14853 - protein, 7 aa, Artificial Sequence
  Synthetic construct
YVGLYVY

SEQ ID NO: 14854 - protein, 7 aa, Artificial Sequence
  Synthetic construct
YVGLFFF

SEQ ID NO: 14855 - protein, 7 aa, Artificial Sequence
  Synthetic construct
YVGLFFY

SEQ ID NO: 14856 - protein, 7 aa, Artificial Sequence
  Synthetic construct
YVGLFRF

SEQ ID NO: 14857 - protein, 7 aa, Artificial Sequence
  Synthetic construct
YVGLFRY

SEQ ID NO: 14858 - protein, 7 aa, Artificial Sequence
  Synthetic construct
YVGLFCF

SEQ ID NO: 14859 - protein, 7 aa, Artificial Sequence
  Synthetic construct
YVGLFCY

SEQ ID NO: 14860 - protein, 7 aa, Artificial Sequence
  Synthetic construct
YVGLFLF

SEQ ID NO: 14861 - protein, 7 aa, Artificial Sequence
  Synthetic construct
YVGLFLY

SEQ ID NO: 14862 - protein, 7 aa, Artificial Sequence
  Synthetic construct
YVGLFAF

SEQ ID NO: 14863 - protein, 7 aa, Artificial Sequence
  Synthetic construct
YVGLFAY

SEQ ID NO: 14864 - protein, 7 aa, Artificial Sequence
  Synthetic construct
YVGLFQF

SEQ ID NO: 14865 - protein, 7 aa, Artificial Sequence
  Synthetic construct
YVGLFQY

SEQ ID NO: 14866 - protein, 7 aa, Artificial Sequence
  Synthetic construct
YVGLFDF

SEQ ID NO: 14867 - protein, 7 aa, Artificial Sequence
  Synthetic construct
YVGLFDY

SEQ ID NO: 14868 - protein, 7 aa, Artificial Sequence
  Synthetic construct
YVGLFVF

SEQ ID NO: 14869 - protein, 7 aa, Artificial Sequence
  Synthetic construct
YVGLFVY

SEQ ID NO: 14870 - protein, 7 aa, Artificial Sequence
  Synthetic construct
YVGLVFF

SEQ ID NO: 14871 - protein, 7 aa, Artificial Sequence
  Synthetic construct
YVGLVFY

SEQ ID NO: 14872 - protein, 7 aa, Artificial Sequence
  Synthetic construct
YVGLVRF

SEQ ID NO: 14873 - protein, 7 aa, Artificial Sequence
  Synthetic construct
YVGLVRY

SEQ ID NO: 14874 - protein, 7 aa, Artificial Sequence
  Synthetic construct
YVGLVCF

SEQ ID NO: 14875 - protein, 7 aa, Artificial Sequence
  Synthetic construct
YVGLVCY

SEQ ID NO: 14876 - protein, 7 aa, Artificial Sequence
  Synthetic construct
YVGLVLF

SEQ ID NO: 14877 - protein, 7 aa, Artificial Sequence
  Synthetic construct
YVGLVLY

SEQ ID NO: 14878 - protein, 7 aa, Artificial Sequence
  Synthetic construct
YVGLVAF

SEQ ID NO: 14879 - protein, 7 aa, Artificial Sequence
  Synthetic construct
YVGLVAY

SEQ ID NO: 14880 - protein, 7 aa, Artificial Sequence
  Synthetic construct
YVGLVQF

SEQ ID NO: 14881 - protein, 7 aa, Artificial Sequence
  Synthetic construct
YVGLVQY

SEQ ID NO: 14882 - protein, 7 aa, Artificial Sequence
  Synthetic construct
YVGLVDF

SEQ ID NO: 14883 - protein, 7 aa, Artificial Sequence
  Synthetic construct
YVGLVDY

SEQ ID NO: 14884 - protein, 7 aa, Artificial Sequence
  Synthetic construct
YVGLVVF

SEQ ID NO: 14885 - protein, 7 aa, Artificial Sequence
  Synthetic construct
YVGLVVY

SEQ ID NO: 14886 - protein, 7 aa, Artificial Sequence
  Synthetic construct
YVGLTFF

SEQ ID NO: 14887 - protein, 7 aa, Artificial Sequence
  Synthetic construct
YVGLTFY

SEQ ID NO: 14888 - protein, 7 aa, Artificial Sequence
  Synthetic construct
YVGLTRF

SEQ ID NO: 14889 - protein, 7 aa, Artificial Sequence
  Synthetic construct
YVGLTRY

SEQ ID NO: 14890 - protein, 7 aa, Artificial Sequence
  Synthetic construct
YVGLTCF

SEQ ID NO: 14891 - protein, 7 aa, Artificial Sequence
  Synthetic construct
YVGLTCY

SEQ ID NO: 14892 - protein, 7 aa, Artificial Sequence
  Synthetic construct
YVGLTLF

SEQ ID NO: 14893 - protein, 7 aa, Artificial Sequence
  Synthetic construct
YVGLTLY

SEQ ID NO: 14894 - protein, 7 aa, Artificial Sequence
  Synthetic construct
YVGLTAF

SEQ ID NO: 14895 - protein, 7 aa, Artificial Sequence
  Synthetic construct
YVGLTAY

SEQ ID NO: 14896 - protein, 7 aa, Artificial Sequence
  Synthetic construct
YVGLTQF

SEQ ID NO: 14897 - protein, 7 aa, Artificial Sequence
  Synthetic construct
YVGLTQY

SEQ ID NO: 14898 - protein, 7 aa, Artificial Sequence
  Synthetic construct
YVGLTDF

SEQ ID NO: 14899 - protein, 7 aa, Artificial Sequence
  Synthetic construct
YVGLTDY

SEQ ID NO: 14900 - protein, 7 aa, Artificial Sequence
  Synthetic construct
YVGLTVF

SEQ ID NO: 14901 - protein, 7 aa, Artificial Sequence
  Synthetic construct
YVGLTVY

SEQ ID NO: 14902 - protein, 7 aa, Artificial Sequence
  Synthetic construct
YVGLGFF

SEQ ID NO: 14903 - protein, 7 aa, Artificial Sequence
  Synthetic construct
YVGLGFY

SEQ ID NO: 14904 - protein, 7 aa, Artificial Sequence
  Synthetic construct
YVGLGRF

SEQ ID NO: 14905 - protein, 7 aa, Artificial Sequence
  Synthetic construct
YVGLGRY

SEQ ID NO: 14906 - protein, 7 aa, Artificial Sequence
  Synthetic construct
YVGLGCF

SEQ ID NO: 14907 - protein, 7 aa, Artificial Sequence
  Synthetic construct
YVGLGCY

SEQ ID NO: 14908 - protein, 7 aa, Artificial Sequence
  Synthetic construct
YVGLGLF

SEQ ID NO: 14909 - protein, 7 aa, Artificial Sequence
  Synthetic construct
YVGLGLY

SEQ ID NO: 14910 - protein, 7 aa, Artificial Sequence
  Synthetic construct
YVGLGAF

SEQ ID NO: 14911 - protein, 7 aa, Artificial Sequence
  Synthetic construct
YVGLGAY

SEQ ID NO: 14912 - protein, 7 aa, Artificial Sequence
  Synthetic construct
YVGLGQF

SEQ ID NO: 14913 - protein, 7 aa, Artificial Sequence
  Synthetic construct
YVGLGQY

SEQ ID NO: 14914 - protein, 7 aa, Artificial Sequence
  Synthetic construct
YVGLGDF

SEQ ID NO: 14915 - protein, 7 aa, Artificial Sequence
  Synthetic construct
YVGLGDY

SEQ ID NO: 14916 - protein, 7 aa, Artificial Sequence
  Synthetic construct
YVGLGVF

SEQ ID NO: 14917 - protein, 7 aa, Artificial Sequence
  Synthetic construct
YVGLGVY

SEQ ID NO: 14918 - protein, 7 aa, Artificial Sequence
  Synthetic construct
YVGLAFF

SEQ ID NO: 14919 - protein, 7 aa, Artificial Sequence
  Synthetic construct
YVGLAFY

SEQ ID NO: 14920 - protein, 7 aa, Artificial Sequence
  Synthetic construct
YVGLARF

SEQ ID NO: 14921 - protein, 7 aa, Artificial Sequence
  Synthetic construct
YVGLARY

SEQ ID NO: 14922 - protein, 7 aa, Artificial Sequence
  Synthetic construct
YVGLACF

SEQ ID NO: 14923 - protein, 7 aa, Artificial Sequence
  Synthetic construct
YVGLACY

SEQ ID NO: 14924 - protein, 7 aa, Artificial Sequence
  Synthetic construct
YVGLALF

SEQ ID NO: 14925 - protein, 7 aa, Artificial Sequence
  Synthetic construct
YVGLALY

SEQ ID NO: 14926 - protein, 7 aa, Artificial Sequence
  Synthetic construct
YVGLAAF

SEQ ID NO: 14927 - protein, 7 aa, Artificial Sequence
  Synthetic construct
YVGLAAY

SEQ ID NO: 14928 - protein, 7 aa, Artificial Sequence
  Synthetic construct
YVGLAQF

SEQ ID NO: 14929 - protein, 7 aa, Artificial Sequence
  Synthetic construct
YVGLAQY

SEQ ID NO: 14930 - protein, 7 aa, Artificial Sequence
  Synthetic construct
YVGLADF

SEQ ID NO: 14931 - protein, 7 aa, Artificial Sequence
  Synthetic construct
YVGLADY

SEQ ID NO: 14932 - protein, 7 aa, Artificial Sequence
  Synthetic construct
YVGLAVF

SEQ ID NO: 14933 - protein, 7 aa, Artificial Sequence
  Synthetic construct
YVGLAVY

SEQ ID NO: 14934 - protein, 7 aa, Artificial Sequence
  Synthetic construct
YVGLQFF

SEQ ID NO: 14935 - protein, 7 aa, Artificial Sequence
  Synthetic construct
YVGLQFY

SEQ ID NO: 14936 - protein, 7 aa, Artificial Sequence
  Synthetic construct
YVGLQRF

SEQ ID NO: 14937 - protein, 7 aa, Artificial Sequence
  Synthetic construct
YVGLQRY

SEQ ID NO: 14938 - protein, 7 aa, Artificial Sequence
  Synthetic construct
YVGLQCF

SEQ ID NO: 14939 - protein, 7 aa, Artificial Sequence
  Synthetic construct
YVGLQCY

SEQ ID NO: 14940 - protein, 7 aa, Artificial Sequence
  Synthetic construct
YVGLQLF

SEQ ID NO: 14941 - protein, 7 aa, Artificial Sequence
  Synthetic construct
YVGLQLY

SEQ ID NO: 14942 - protein, 7 aa, Artificial Sequence
  Synthetic construct
YVGLQAF

SEQ ID NO: 14943 - protein, 7 aa, Artificial Sequence
  Synthetic construct
YVGLQAY

SEQ ID NO: 14944 - protein, 7 aa, Artificial Sequence
  Synthetic construct
YVGLQQF

SEQ ID NO: 14945 - protein, 7 aa, Artificial Sequence
  Synthetic construct
YVGLQQY

SEQ ID NO: 14946 - protein, 7 aa, Artificial Sequence
  Synthetic construct
YVGLQDF

SEQ ID NO: 14947 - protein, 7 aa, Artificial Sequence
  Synthetic construct
YVGLQDY

SEQ ID NO: 14948 - protein, 7 aa, Artificial Sequence
  Synthetic construct
YVGLQVF

SEQ ID NO: 14949 - protein, 7 aa, Artificial Sequence
  Synthetic construct
YVGLQVY

SEQ ID NO: 14950 - protein, 7 aa, Artificial Sequence
  Synthetic construct
YVGFIFF

SEQ ID NO: 14951 - protein, 7 aa, Artificial Sequence
  Synthetic construct
YVGFIFY

SEQ ID NO: 14952 - protein, 7 aa, Artificial Sequence
  Synthetic construct
YVGFIRF

SEQ ID NO: 14953 - protein, 7 aa, Artificial Sequence
  Synthetic construct
YVGFIRY

SEQ ID NO: 14954 - protein, 7 aa, Artificial Sequence
  Synthetic construct
YVGFICF

SEQ ID NO: 14955 - protein, 7 aa, Artificial Sequence
  Synthetic construct
YVGFICY

SEQ ID NO: 14956 - protein, 7 aa, Artificial Sequence
  Synthetic construct
YVGFILF

SEQ ID NO: 14957 - protein, 7 aa, Artificial Sequence
  Synthetic construct
YVGFILY

SEQ ID NO: 14958 - protein, 7 aa, Artificial Sequence
  Synthetic construct
YVGFIAF

SEQ ID NO: 14959 - protein, 7 aa, Artificial Sequence
  Synthetic construct
YVGFIAY

SEQ ID NO: 14960 - protein, 7 aa, Artificial Sequence
  Synthetic construct
YVGFIQF

SEQ ID NO: 14961 - protein, 7 aa, Artificial Sequence
  Synthetic construct
YVGFIQY

SEQ ID NO: 14962 - protein, 7 aa, Artificial Sequence
  Synthetic construct
YVGFIDF

SEQ ID NO: 14963 - protein, 7 aa, Artificial Sequence
  Synthetic construct
YVGFIDY

SEQ ID NO: 14964 - protein, 7 aa, Artificial Sequence
  Synthetic construct
YVGFIVF

SEQ ID NO: 14965 - protein, 7 aa, Artificial Sequence
  Synthetic construct
YVGFIVY

SEQ ID NO: 14966 - protein, 7 aa, Artificial Sequence
  Synthetic construct
YVGFDFF

SEQ ID NO: 14967 - protein, 7 aa, Artificial Sequence
  Synthetic construct
YVGFDFY

SEQ ID NO: 14968 - protein, 7 aa, Artificial Sequence
  Synthetic construct
YVGFDRF

SEQ ID NO: 14969 - protein, 7 aa, Artificial Sequence
  Synthetic construct
YVGFDRY

SEQ ID NO: 14970 - protein, 7 aa, Artificial Sequence
  Synthetic construct
YVGFDCF

SEQ ID NO: 14971 - protein, 7 aa, Artificial Sequence
  Synthetic construct
YVGFDCY

SEQ ID NO: 14972 - protein, 7 aa, Artificial Sequence
  Synthetic construct
YVGFDLF

SEQ ID NO: 14973 - protein, 7 aa, Artificial Sequence
  Synthetic construct
YVGFDLY

SEQ ID NO: 14974 - protein, 7 aa, Artificial Sequence
  Synthetic construct
YVGFDAF

SEQ ID NO: 14975 - protein, 7 aa, Artificial Sequence
  Synthetic construct
YVGFDAY

SEQ ID NO: 14976 - protein, 7 aa, Artificial Sequence
  Synthetic construct
YVGFDQF

SEQ ID NO: 14977 - protein, 7 aa, Artificial Sequence
  Synthetic construct
YVGFDQY

SEQ ID NO: 14978 - protein, 7 aa, Artificial Sequence
  Synthetic construct
YVGFDDF

SEQ ID NO: 14979 - protein, 7 aa, Artificial Sequence
  Synthetic construct
YVGFDDY

SEQ ID NO: 14980 - protein, 7 aa, Artificial Sequence
  Synthetic construct
YVGFDVF

SEQ ID NO: 14981 - protein, 7 aa, Artificial Sequence
  Synthetic construct
YVGFDVY

SEQ ID NO: 14982 - protein, 7 aa, Artificial Sequence
  Synthetic construct
YVGFYFF

SEQ ID NO: 14983 - protein, 7 aa, Artificial Sequence
  Synthetic construct
YVGFYFY

SEQ ID NO: 14984 - protein, 7 aa, Artificial Sequence
  Synthetic construct
YVGFYRF

SEQ ID NO: 14985 - protein, 7 aa, Artificial Sequence
  Synthetic construct
YVGFYRY

SEQ ID NO: 14986 - protein, 7 aa, Artificial Sequence
  Synthetic construct
YVGFYCF

SEQ ID NO: 14987 - protein, 7 aa, Artificial Sequence
  Synthetic construct
YVGFYCY

SEQ ID NO: 14988 - protein, 7 aa, Artificial Sequence
  Synthetic construct
YVGFYLF

SEQ ID NO: 14989 - protein, 7 aa, Artificial Sequence
  Synthetic construct
YVGFYLY

SEQ ID NO: 14990 - protein, 7 aa, Artificial Sequence
  Synthetic construct
YVGFYAF

SEQ ID NO: 14991 - protein, 7 aa, Artificial Sequence
  Synthetic construct
YVGFYAY

SEQ ID NO: 14992 - protein, 7 aa, Artificial Sequence
  Synthetic construct
YVGFYQF

SEQ ID NO: 14993 - protein, 7 aa, Artificial Sequence
  Synthetic construct
YVGFYQY

SEQ ID NO: 14994 - protein, 7 aa, Artificial Sequence
  Synthetic construct
YVGFYDF

SEQ ID NO: 14995 - protein, 7 aa, Artificial Sequence
  Synthetic construct
YVGFYDY

SEQ ID NO: 14996 - protein, 7 aa, Artificial Sequence
  Synthetic construct
YVGFYVF

SEQ ID NO: 14997 - protein, 7 aa, Artificial Sequence
  Synthetic construct
YVGFYVY

SEQ ID NO: 14998 - protein, 7 aa, Artificial Sequence
  Synthetic construct
YVGFFFF

SEQ ID NO: 14999 - protein, 7 aa, Artificial Sequence
  Synthetic construct
YVGFFFY

SEQ ID NO: 15000 - protein, 7 aa, Artificial Sequence
  Synthetic construct
YVGFFRF

SEQ ID NO: 15001 - protein, 7 aa, Artificial Sequence
  Synthetic construct
YVGFFRY

SEQ ID NO: 15002 - protein, 7 aa, Artificial Sequence
  Synthetic construct
YVGFFCF

SEQ ID NO: 15003 - protein, 7 aa, Artificial Sequence
  Synthetic construct
YVGFFCY

SEQ ID NO: 15004 - protein, 7 aa, Artificial Sequence
  Synthetic construct
YVGFFLF

SEQ ID NO: 15005 - protein, 7 aa, Artificial Sequence
  Synthetic construct
YVGFFLY

SEQ ID NO: 15006 - protein, 7 aa, Artificial Sequence
  Synthetic construct
YVGFFAF

SEQ ID NO: 15007 - protein, 7 aa, Artificial Sequence
  Synthetic construct
YVGFFAY

SEQ ID NO: 15008 - protein, 7 aa, Artificial Sequence
  Synthetic construct
YVGFFQF

SEQ ID NO: 15009 - protein, 7 aa, Artificial Sequence
  Synthetic construct
YVGFFQY

SEQ ID NO: 15010 - protein, 7 aa, Artificial Sequence
  Synthetic construct
YVGFFDF

SEQ ID NO: 15011 - protein, 7 aa, Artificial Sequence
  Synthetic construct
YVGFFDY

SEQ ID NO: 15012 - protein, 7 aa, Artificial Sequence
  Synthetic construct
YVGFFVF

SEQ ID NO: 15013 - protein, 7 aa, Artificial Sequence
  Synthetic construct
YVGFFVY

SEQ ID NO: 15014 - protein, 7 aa, Artificial Sequence
  Synthetic construct
YVGFVFF

SEQ ID NO: 15015 - protein, 7 aa, Artificial Sequence
  Synthetic construct
YVGFVFY

SEQ ID NO: 15016 - protein, 7 aa, Artificial Sequence
  Synthetic construct
YVGFVRF

SEQ ID NO: 15017 - protein, 7 aa, Artificial Sequence
  Synthetic construct
YVGFVRY

SEQ ID NO: 15018 - protein, 7 aa, Artificial Sequence
  Synthetic construct
YVGFVCF

SEQ ID NO: 15019 - protein, 7 aa, Artificial Sequence
  Synthetic construct
YVGFVCY

SEQ ID NO: 15020 - protein, 7 aa, Artificial Sequence
  Synthetic construct
YVGFVLF

SEQ ID NO: 15021 - protein, 7 aa, Artificial Sequence
  Synthetic construct
YVGFVLY

SEQ ID NO: 15022 - protein, 7 aa, Artificial Sequence
  Synthetic construct
YVGFVAF

SEQ ID NO: 15023 - protein, 7 aa, Artificial Sequence
  Synthetic construct
YVGFVAY

SEQ ID NO: 15024 - protein, 7 aa, Artificial Sequence
  Synthetic construct
YVGFVQF

SEQ ID NO: 15025 - protein, 7 aa, Artificial Sequence
  Synthetic construct
YVGFVQY

SEQ ID NO: 15026 - protein, 7 aa, Artificial Sequence
  Synthetic construct
YVGFVDF

SEQ ID NO: 15027 - protein, 7 aa, Artificial Sequence
  Synthetic construct
YVGFVDY

SEQ ID NO: 15028 - protein, 7 aa, Artificial Sequence
  Synthetic construct
YVGFVVF

SEQ ID NO: 15029 - protein, 7 aa, Artificial Sequence
  Synthetic construct
YVGFVVY

SEQ ID NO: 15030 - protein, 7 aa, Artificial Sequence
  Synthetic construct
YVGFTFF

SEQ ID NO: 15031 - protein, 7 aa, Artificial Sequence
  Synthetic construct
YVGFTFY

SEQ ID NO: 15032 - protein, 7 aa, Artificial Sequence
  Synthetic construct
YVGFTRF

SEQ ID NO: 15033 - protein, 7 aa, Artificial Sequence
  Synthetic construct
YVGFTRY

SEQ ID NO: 15034 - protein, 7 aa, Artificial Sequence
  Synthetic construct
YVGFTCF

SEQ ID NO: 15035 - protein, 7 aa, Artificial Sequence
  Synthetic construct
YVGFTCY

SEQ ID NO: 15036 - protein, 7 aa, Artificial Sequence
  Synthetic construct
YVGFTLF

SEQ ID NO: 15037 - protein, 7 aa, Artificial Sequence
  Synthetic construct
YVGFTLY

SEQ ID NO: 15038 - protein, 7 aa, Artificial Sequence
  Synthetic construct
YVGFTAF

SEQ ID NO: 15039 - protein, 7 aa, Artificial Sequence
  Synthetic construct
YVGFTAY

SEQ ID NO: 15040 - protein, 7 aa, Artificial Sequence
  Synthetic construct
YVGFTQF

SEQ ID NO: 15041 - protein, 7 aa, Artificial Sequence
  Synthetic construct
YVGFTQY

SEQ ID NO: 15042 - protein, 7 aa, Artificial Sequence
  Synthetic construct
YVGFTDF

SEQ ID NO: 15043 - protein, 7 aa, Artificial Sequence
  Synthetic construct
YVGFTDY

SEQ ID NO: 15044 - protein, 7 aa, Artificial Sequence
  Synthetic construct
YVGFTVF

SEQ ID NO: 15045 - protein, 7 aa, Artificial Sequence
  Synthetic construct
YVGFTVY

SEQ ID NO: 15046 - protein, 7 aa, Artificial Sequence
  Synthetic construct
YVGFGFF

SEQ ID NO: 15047 - protein, 7 aa, Artificial Sequence
  Synthetic construct
YVGFGFY

SEQ ID NO: 15048 - protein, 7 aa, Artificial Sequence
  Synthetic construct
YVGFGRF

SEQ ID NO: 15049 - protein, 7 aa, Artificial Sequence
  Synthetic construct
YVGFGRY

SEQ ID NO: 15050 - protein, 7 aa, Artificial Sequence
  Synthetic construct
YVGFGCF

SEQ ID NO: 15051 - protein, 7 aa, Artificial Sequence
  Synthetic construct
YVGFGCY

SEQ ID NO: 15052 - protein, 7 aa, Artificial Sequence
  Synthetic construct
YVGFGLF

SEQ ID NO: 15053 - protein, 7 aa, Artificial Sequence
  Synthetic construct
YVGFGLY

SEQ ID NO: 15054 - protein, 7 aa, Artificial Sequence
  Synthetic construct
YVGFGAF

SEQ ID NO: 15055 - protein, 7 aa, Artificial Sequence
  Synthetic construct
YVGFGAY

SEQ ID NO: 15056 - protein, 7 aa, Artificial Sequence
  Synthetic construct
YVGFGQF

SEQ ID NO: 15057 - protein, 7 aa, Artificial Sequence
  Synthetic construct
YVGFGQY

SEQ ID NO: 15058 - protein, 7 aa, Artificial Sequence
  Synthetic construct
YVGFGDF

SEQ ID NO: 15059 - protein, 7 aa, Artificial Sequence
  Synthetic construct
YVGFGDY

SEQ ID NO: 15060 - protein, 7 aa, Artificial Sequence
  Synthetic construct
YVGFGVF

SEQ ID NO: 15061 - protein, 7 aa, Artificial Sequence
  Synthetic construct
YVGFGVY

SEQ ID NO: 15062 - protein, 7 aa, Artificial Sequence
  Synthetic construct
YVGFAFF

SEQ ID NO: 15063 - protein, 7 aa, Artificial Sequence
  Synthetic construct
YVGFAFY

SEQ ID NO: 15064 - protein, 7 aa, Artificial Sequence
  Synthetic construct
YVGFARF

SEQ ID NO: 15065 - protein, 7 aa, Artificial Sequence
  Synthetic construct
YVGFARY

SEQ ID NO: 15066 - protein, 7 aa, Artificial Sequence
  Synthetic construct
YVGFACF

SEQ ID NO: 15067 - protein, 7 aa, Artificial Sequence
  Synthetic construct
YVGFACY

SEQ ID NO: 15068 - protein, 7 aa, Artificial Sequence
  Synthetic construct
YVGFALF

SEQ ID NO: 15069 - protein, 7 aa, Artificial Sequence
  Synthetic construct
YVGFALY

SEQ ID NO: 15070 - protein, 7 aa, Artificial Sequence
  Synthetic construct
YVGFAAF

SEQ ID NO: 15071 - protein, 7 aa, Artificial Sequence
  Synthetic construct
YVGFAAY

SEQ ID NO: 15072 - protein, 7 aa, Artificial Sequence
  Synthetic construct
YVGFAQF

SEQ ID NO: 15073 - protein, 7 aa, Artificial Sequence
  Synthetic construct
YVGFAQY

SEQ ID NO: 15074 - protein, 7 aa, Artificial Sequence
  Synthetic construct
YVGFADF

SEQ ID NO: 15075 - protein, 7 aa, Artificial Sequence
  Synthetic construct
YVGFADY

SEQ ID NO: 15076 - protein, 7 aa, Artificial Sequence
  Synthetic construct
YVGFAVF

SEQ ID NO: 15077 - protein, 7 aa, Artificial Sequence
  Synthetic construct
YVGFAVY

SEQ ID NO: 15078 - protein, 7 aa, Artificial Sequence
  Synthetic construct
YVGFQFF

SEQ ID NO: 15079 - protein, 7 aa, Artificial Sequence
  Synthetic construct
YVGFQFY

SEQ ID NO: 15080 - protein, 7 aa, Artificial Sequence
  Synthetic construct
YVGFQRF

SEQ ID NO: 15081 - protein, 7 aa, Artificial Sequence
  Synthetic construct
YVGFQRY

SEQ ID NO: 15082 - protein, 7 aa, Artificial Sequence
  Synthetic construct
YVGFQCF

SEQ ID NO: 15083 - protein, 7 aa, Artificial Sequence
  Synthetic construct
YVGFQCY

SEQ ID NO: 15084 - protein, 7 aa, Artificial Sequence
  Synthetic construct
YVGFQLF

SEQ ID NO: 15085 - protein, 7 aa, Artificial Sequence
  Synthetic construct
YVGFQLY

SEQ ID NO: 15086 - protein, 7 aa, Artificial Sequence
  Synthetic construct
YVGFQAF

SEQ ID NO: 15087 - protein, 7 aa, Artificial Sequence
  Synthetic construct
YVGFQAY

SEQ ID NO: 15088 - protein, 7 aa, Artificial Sequence
  Synthetic construct
YVGFQQF

SEQ ID NO: 15089 - protein, 7 aa, Artificial Sequence
  Synthetic construct
YVGFQQY

SEQ ID NO: 15090 - protein, 7 aa, Artificial Sequence
  Synthetic construct
YVGFQDF

SEQ ID NO: 15091 - protein, 7 aa, Artificial Sequence
  Synthetic construct
YVGFQDY

SEQ ID NO: 15092 - protein, 7 aa, Artificial Sequence
  Synthetic construct
YVGFQVF

SEQ ID NO: 15093 - protein, 7 aa, Artificial Sequence
  Synthetic construct
YVGFQVY

SEQ ID NO: 15094 - protein, 7 aa, Artificial Sequence
  Synthetic construct
YIIYIFF

SEQ ID NO: 15095 - protein, 7 aa, Artificial Sequence
  Synthetic construct
YIIYIFY

SEQ ID NO: 15096 - protein, 7 aa, Artificial Sequence
  Synthetic construct
YIIYIRF

SEQ ID NO: 15097 - protein, 7 aa, Artificial Sequence
  Synthetic construct
YIIYIRY

SEQ ID NO: 15098 - protein, 7 aa, Artificial Sequence
  Synthetic construct
YIIYICF

SEQ ID NO: 15099 - protein, 7 aa, Artificial Sequence
  Synthetic construct
YIIYICY

SEQ ID NO: 15100 - protein, 7 aa, Artificial Sequence
  Synthetic construct
YIIYILF

SEQ ID NO: 15101 - protein, 7 aa, Artificial Sequence
  Synthetic construct
YIIYILY

SEQ ID NO: 15102 - protein, 7 aa, Artificial Sequence
  Synthetic construct
YIIYIAF

SEQ ID NO: 15103 - protein, 7 aa, Artificial Sequence
  Synthetic construct
YIIYIAY

SEQ ID NO: 15104 - protein, 7 aa, Artificial Sequence
  Synthetic construct
YIIYIQF

SEQ ID NO: 15105 - protein, 7 aa, Artificial Sequence
  Synthetic construct
YIIYIQY

SEQ ID NO: 15106 - protein, 7 aa, Artificial Sequence
  Synthetic construct
YIIYIDF

SEQ ID NO: 15107 - protein, 7 aa, Artificial Sequence
  Synthetic construct
YIIYIDY

SEQ ID NO: 15108 - protein, 7 aa, Artificial Sequence
  Synthetic construct
YIIYIVF

SEQ ID NO: 15109 - protein, 7 aa, Artificial Sequence
  Synthetic construct
YIIYIVY

SEQ ID NO: 15110 - protein, 7 aa, Artificial Sequence
  Synthetic construct
YIIYDFF

SEQ ID NO: 15111 - protein, 7 aa, Artificial Sequence
  Synthetic construct
YIIYDFY

SEQ ID NO: 15112 - protein, 7 aa, Artificial Sequence
  Synthetic construct
YIIYDRF

SEQ ID NO: 15113 - protein, 7 aa, Artificial Sequence
  Synthetic construct
YIIYDRY

SEQ ID NO: 15114 - protein, 7 aa, Artificial Sequence
  Synthetic construct
YIIYDCF

SEQ ID NO: 15115 - protein, 7 aa, Artificial Sequence
  Synthetic construct
YIIYDCY

SEQ ID NO: 15116 - protein, 7 aa, Artificial Sequence
  Synthetic construct
YIIYDLF

SEQ ID NO: 15117 - protein, 7 aa, Artificial Sequence
  Synthetic construct
YIIYDLY

SEQ ID NO: 15118 - protein, 7 aa, Artificial Sequence
  Synthetic construct
YIIYDAF

SEQ ID NO: 15119 - protein, 7 aa, Artificial Sequence
  Synthetic construct
YIIYDAY

SEQ ID NO: 15120 - protein, 7 aa, Artificial Sequence
  Synthetic construct
YIIYDQF

SEQ ID NO: 15121 - protein, 7 aa, Artificial Sequence
  Synthetic construct
YIIYDQY

SEQ ID NO: 15122 - protein, 7 aa, Artificial Sequence
  Synthetic construct
YIIYDDF

SEQ ID NO: 15123 - protein, 7 aa, Artificial Sequence
  Synthetic construct
YIIYDDY

SEQ ID NO: 15124 - protein, 7 aa, Artificial Sequence
  Synthetic construct
YIIYDVF

SEQ ID NO: 15125 - protein, 7 aa, Artificial Sequence
  Synthetic construct
YIIYDVY

SEQ ID NO: 15126 - protein, 7 aa, Artificial Sequence
  Synthetic construct
YIIYYFF

SEQ ID NO: 15127 - protein, 7 aa, Artificial Sequence
  Synthetic construct
YIIYYFY

SEQ ID NO: 15128 - protein, 7 aa, Artificial Sequence
  Synthetic construct
YIIYYRF

SEQ ID NO: 15129 - protein, 7 aa, Artificial Sequence
  Synthetic construct
YIIYYRY

SEQ ID NO: 15130 - protein, 7 aa, Artificial Sequence
  Synthetic construct
YIIYYCF

SEQ ID NO: 15131 - protein, 7 aa, Artificial Sequence
  Synthetic construct
YIIYYCY

SEQ ID NO: 15132 - protein, 7 aa, Artificial Sequence
  Synthetic construct
YIIYYLF

SEQ ID NO: 15133 - protein, 7 aa, Artificial Sequence
  Synthetic construct
YIIYYLY

SEQ ID NO: 15134 - protein, 7 aa, Artificial Sequence
  Synthetic construct
YIIYYAF

SEQ ID NO: 15135 - protein, 7 aa, Artificial Sequence
  Synthetic construct
YIIYYAY

SEQ ID NO: 15136 - protein, 7 aa, Artificial Sequence
  Synthetic construct
YIIYYQF

SEQ ID NO: 15137 - protein, 7 aa, Artificial Sequence
  Synthetic construct
YIIYYQY

SEQ ID NO: 15138 - protein, 7 aa, Artificial Sequence
  Synthetic construct
YIIYYDF

SEQ ID NO: 15139 - protein, 7 aa, Artificial Sequence
  Synthetic construct
YIIYYDY

SEQ ID NO: 15140 - protein, 7 aa, Artificial Sequence
  Synthetic construct
YIIYYVF

SEQ ID NO: 15141 - protein, 7 aa, Artificial Sequence
  Synthetic construct
YIIYYVY

SEQ ID NO: 15142 - protein, 7 aa, Artificial Sequence
  Synthetic construct
YIIYFFF

SEQ ID NO: 15143 - protein, 7 aa, Artificial Sequence
  Synthetic construct
YIIYFFY

SEQ ID NO: 15144 - protein, 7 aa, Artificial Sequence
  Synthetic construct
YIIYFRF

SEQ ID NO: 15145 - protein, 7 aa, Artificial Sequence
  Synthetic construct
YIIYFRY

SEQ ID NO: 15146 - protein, 7 aa, Artificial Sequence
  Synthetic construct
YIIYFCF

SEQ ID NO: 15147 - protein, 7 aa, Artificial Sequence
  Synthetic construct
YIIYFCY

SEQ ID NO: 15148 - protein, 7 aa, Artificial Sequence
  Synthetic construct
YIIYFLF

SEQ ID NO: 15149 - protein, 7 aa, Artificial Sequence
  Synthetic construct
YIIYFLY

SEQ ID NO: 15150 - protein, 7 aa, Artificial Sequence
  Synthetic construct
YIIYFAF

SEQ ID NO: 15151 - protein, 7 aa, Artificial Sequence
  Synthetic construct
YIIYFAY

SEQ ID NO: 15152 - protein, 7 aa, Artificial Sequence
  Synthetic construct
YIIYFQF

SEQ ID NO: 15153 - protein, 7 aa, Artificial Sequence
  Synthetic construct
YIIYFQY

SEQ ID NO: 15154 - protein, 7 aa, Artificial Sequence
  Synthetic construct
YIIYFDF

SEQ ID NO: 15155 - protein, 7 aa, Artificial Sequence
  Synthetic construct
YIIYFDY

SEQ ID NO: 15156 - protein, 7 aa, Artificial Sequence
  Synthetic construct
YIIYFVF

SEQ ID NO: 15157 - protein, 7 aa, Artificial Sequence
  Synthetic construct
YIIYFVY

SEQ ID NO: 15158 - protein, 7 aa, Artificial Sequence
  Synthetic construct
YIIYVFF

SEQ ID NO: 15159 - protein, 7 aa, Artificial Sequence
  Synthetic construct
YIIYVFY

SEQ ID NO: 15160 - protein, 7 aa, Artificial Sequence
  Synthetic construct
YIIYVRF

SEQ ID NO: 15161 - protein, 7 aa, Artificial Sequence
  Synthetic construct
YIIYVRY

SEQ ID NO: 15162 - protein, 7 aa, Artificial Sequence
  Synthetic construct
YIIYVCF

SEQ ID NO: 15163 - protein, 7 aa, Artificial Sequence
  Synthetic construct
YIIYVCY

SEQ ID NO: 15164 - protein, 7 aa, Artificial Sequence
  Synthetic construct
YIIYVLF

SEQ ID NO: 15165 - protein, 7 aa, Artificial Sequence
  Synthetic construct
YIIYVLY

SEQ ID NO: 15166 - protein, 7 aa, Artificial Sequence
  Synthetic construct
YIIYVAF

SEQ ID NO: 15167 - protein, 7 aa, Artificial Sequence
  Synthetic construct
YIIYVAY

SEQ ID NO: 15168 - protein, 7 aa, Artificial Sequence
  Synthetic construct
YIIYVQF

SEQ ID NO: 15169 - protein, 7 aa, Artificial Sequence
  Synthetic construct
YIIYVQY

SEQ ID NO: 15170 - protein, 7 aa, Artificial Sequence
  Synthetic construct
YIIYVDF

SEQ ID NO: 15171 - protein, 7 aa, Artificial Sequence
  Synthetic construct
YIIYVDY

SEQ ID NO: 15172 - protein, 7 aa, Artificial Sequence
  Synthetic construct
YIIYVVF

SEQ ID NO: 15173 - protein, 7 aa, Artificial Sequence
  Synthetic construct
YIIYVVY

SEQ ID NO: 15174 - protein, 7 aa, Artificial Sequence
  Synthetic construct
YIIYTFF

SEQ ID NO: 15175 - protein, 7 aa, Artificial Sequence
  Synthetic construct
YIIYTFY

SEQ ID NO: 15176 - protein, 7 aa, Artificial Sequence
  Synthetic construct
YIIYTRF

SEQ ID NO: 15177 - protein, 7 aa, Artificial Sequence
  Synthetic construct
YIIYTRY

SEQ ID NO: 15178 - protein, 7 aa, Artificial Sequence
  Synthetic construct
YIIYTCF

SEQ ID NO: 15179 - protein, 7 aa, Artificial Sequence
  Synthetic construct
YIIYTCY

SEQ ID NO: 15180 - protein, 7 aa, Artificial Sequence
  Synthetic construct
YIIYTLF

SEQ ID NO: 15181 - protein, 7 aa, Artificial Sequence
  Synthetic construct
YIIYTLY

SEQ ID NO: 15182 - protein, 7 aa, Artificial Sequence
  Synthetic construct
YIIYTAF

SEQ ID NO: 15183 - protein, 7 aa, Artificial Sequence
  Synthetic construct
YIIYTAY

SEQ ID NO: 15184 - protein, 7 aa, Artificial Sequence
  Synthetic construct
YIIYTQF

SEQ ID NO: 15185 - protein, 7 aa, Artificial Sequence
  Synthetic construct
YIIYTQY

SEQ ID NO: 15186 - protein, 7 aa, Artificial Sequence
  Synthetic construct
YIIYTDF

SEQ ID NO: 15187 - protein, 7 aa, Artificial Sequence
  Synthetic construct
YIIYTDY

SEQ ID NO: 15188 - protein, 7 aa, Artificial Sequence
  Synthetic construct
YIIYTVF

SEQ ID NO: 15189 - protein, 7 aa, Artificial Sequence
  Synthetic construct
YIIYTVY

SEQ ID NO: 15190 - protein, 7 aa, Artificial Sequence
  Synthetic construct
YIIYGFF

SEQ ID NO: 15191 - protein, 7 aa, Artificial Sequence
  Synthetic construct
YIIYGFY

SEQ ID NO: 15192 - protein, 7 aa, Artificial Sequence
  Synthetic construct
YIIYGRF

SEQ ID NO: 15193 - protein, 7 aa, Artificial Sequence
  Synthetic construct
YIIYGRY

SEQ ID NO: 15194 - protein, 7 aa, Artificial Sequence
  Synthetic construct
YIIYGCF

SEQ ID NO: 15195 - protein, 7 aa, Artificial Sequence
  Synthetic construct
YIIYGCY

SEQ ID NO: 15196 - protein, 7 aa, Artificial Sequence
  Synthetic construct
YIIYGLF

SEQ ID NO: 15197 - protein, 7 aa, Artificial Sequence
  Synthetic construct
YIIYGLY

SEQ ID NO: 15198 - protein, 7 aa, Artificial Sequence
  Synthetic construct
YIIYGAF

SEQ ID NO: 15199 - protein, 7 aa, Artificial Sequence
  Synthetic construct
YIIYGAY

SEQ ID NO: 15200 - protein, 7 aa, Artificial Sequence
  Synthetic construct
YIIYGQF

SEQ ID NO: 15201 - protein, 7 aa, Artificial Sequence
  Synthetic construct
YIIYGQY

SEQ ID NO: 15202 - protein, 7 aa, Artificial Sequence
  Synthetic construct
YIIYGDF

SEQ ID NO: 15203 - protein, 7 aa, Artificial Sequence
  Synthetic construct
YIIYGDY

SEQ ID NO: 15204 - protein, 7 aa, Artificial Sequence
  Synthetic construct
YIIYGVF

SEQ ID NO: 15205 - protein, 7 aa, Artificial Sequence
  Synthetic construct
YIIYGVY

SEQ ID NO: 15206 - protein, 7 aa, Artificial Sequence
  Synthetic construct
YIIYAFF

SEQ ID NO: 15207 - protein, 7 aa, Artificial Sequence
  Synthetic construct
YIIYAFY

SEQ ID NO: 15208 - protein, 7 aa, Artificial Sequence
  Synthetic construct
YIIYARF

SEQ ID NO: 15209 - protein, 7 aa, Artificial Sequence
  Synthetic construct
YIIYARY

SEQ ID NO: 15210 - protein, 7 aa, Artificial Sequence
  Synthetic construct
YIIYACF

SEQ ID NO: 15211 - protein, 7 aa, Artificial Sequence
  Synthetic construct
YIIYACY

SEQ ID NO: 15212 - protein, 7 aa, Artificial Sequence
  Synthetic construct
YIIYALF

SEQ ID NO: 15213 - protein, 7 aa, Artificial Sequence
  Synthetic construct
YIIYALY

SEQ ID NO: 15214 - protein, 7 aa, Artificial Sequence
  Synthetic construct
YIIYAAF

SEQ ID NO: 15215 - protein, 7 aa, Artificial Sequence
  Synthetic construct
YIIYAAY

SEQ ID NO: 15216 - protein, 7 aa, Artificial Sequence
  Synthetic construct
YIIYAQF

SEQ ID NO: 15217 - protein, 7 aa, Artificial Sequence
  Synthetic construct
YIIYAQY

SEQ ID NO: 15218 - protein, 7 aa, Artificial Sequence
  Synthetic construct
YIIYADF

SEQ ID NO: 15219 - protein, 7 aa, Artificial Sequence
  Synthetic construct
YIIYADY

SEQ ID NO: 15220 - protein, 7 aa, Artificial Sequence
  Synthetic construct
YIIYAVF

SEQ ID NO: 15221 - protein, 7 aa, Artificial Sequence
  Synthetic construct
YIIYAVY

SEQ ID NO: 15222 - protein, 7 aa, Artificial Sequence
  Synthetic construct
YIIYQFF

SEQ ID NO: 15223 - protein, 7 aa, Artificial Sequence
  Synthetic construct
YIIYQFY

SEQ ID NO: 15224 - protein, 7 aa, Artificial Sequence
  Synthetic construct
YIIYQRF

SEQ ID NO: 15225 - protein, 7 aa, Artificial Sequence
  Synthetic construct
YIIYQRY

SEQ ID NO: 15226 - protein, 7 aa, Artificial Sequence
  Synthetic construct
YIIYQCF

SEQ ID NO: 15227 - protein, 7 aa, Artificial Sequence
  Synthetic construct
YIIYQCY

SEQ ID NO: 15228 - protein, 7 aa, Artificial Sequence
  Synthetic construct
YIIYQLF

SEQ ID NO: 15229 - protein, 7 aa, Artificial Sequence
  Synthetic construct
YIIYQLY

SEQ ID NO: 15230 - protein, 7 aa, Artificial Sequence
  Synthetic construct
YIIYQAF

SEQ ID NO: 15231 - protein, 7 aa, Artificial Sequence
  Synthetic construct
YIIYQAY

SEQ ID NO: 15232 - protein, 7 aa, Artificial Sequence
  Synthetic construct
YIIYQQF

SEQ ID NO: 15233 - protein, 7 aa, Artificial Sequence
  Synthetic construct
YIIYQQY

SEQ ID NO: 15234 - protein, 7 aa, Artificial Sequence
  Synthetic construct
YIIYQDF

SEQ ID NO: 15235 - protein, 7 aa, Artificial Sequence
  Synthetic construct
YIIYQDY

SEQ ID NO: 15236 - protein, 7 aa, Artificial Sequence
  Synthetic construct
YIIYQVF

SEQ ID NO: 15237 - protein, 7 aa, Artificial Sequence
  Synthetic construct
YIIYQVY

SEQ ID NO: 15238 - protein, 7 aa, Artificial Sequence
  Synthetic construct
YIIPIFF

SEQ ID NO: 15239 - protein, 7 aa, Artificial Sequence
  Synthetic construct
YIIPIFY

SEQ ID NO: 15240 - protein, 7 aa, Artificial Sequence
  Synthetic construct
YIIPIRF

SEQ ID NO: 15241 - protein, 7 aa, Artificial Sequence
  Synthetic construct
YIIPIRY

SEQ ID NO: 15242 - protein, 7 aa, Artificial Sequence
  Synthetic construct
YIIPICF

SEQ ID NO: 15243 - protein, 7 aa, Artificial Sequence
  Synthetic construct
YIIPICY

SEQ ID NO: 15244 - protein, 7 aa, Artificial Sequence
  Synthetic construct
YIIPILF

SEQ ID NO: 15245 - protein, 7 aa, Artificial Sequence
  Synthetic construct
YIIPILY

SEQ ID NO: 15246 - protein, 7 aa, Artificial Sequence
  Synthetic construct
YIIPIAF

SEQ ID NO: 15247 - protein, 7 aa, Artificial Sequence
  Synthetic construct
YIIPIAY

SEQ ID NO: 15248 - protein, 7 aa, Artificial Sequence
  Synthetic construct
YIIPIQF

SEQ ID NO: 15249 - protein, 7 aa, Artificial Sequence
  Synthetic construct
YIIPIQY

SEQ ID NO: 15250 - protein, 7 aa, Artificial Sequence
  Synthetic construct
YIIPIDF

SEQ ID NO: 15251 - protein, 7 aa, Artificial Sequence
  Synthetic construct
YIIPIDY

SEQ ID NO: 15252 - protein, 7 aa, Artificial Sequence
  Synthetic construct
YIIPIVF

SEQ ID NO: 15253 - protein, 7 aa, Artificial Sequence
  Synthetic construct
YIIPIVY

SEQ ID NO: 15254 - protein, 7 aa, Artificial Sequence
  Synthetic construct
YIIPDFF

SEQ ID NO: 15255 - protein, 7 aa, Artificial Sequence
  Synthetic construct
YIIPDFY

SEQ ID NO: 15256 - protein, 7 aa, Artificial Sequence
  Synthetic construct
YIIPDRF

SEQ ID NO: 15257 - protein, 7 aa, Artificial Sequence
  Synthetic construct
YIIPDRY

SEQ ID NO: 15258 - protein, 7 aa, Artificial Sequence
  Synthetic construct
YIIPDCF

SEQ ID NO: 15259 - protein, 7 aa, Artificial Sequence
  Synthetic construct
YIIPDCY

SEQ ID NO: 15260 - protein, 7 aa, Artificial Sequence
  Synthetic construct
YIIPDLF

SEQ ID NO: 15261 - protein, 7 aa, Artificial Sequence
  Synthetic construct
YIIPDLY

SEQ ID NO: 15262 - protein, 7 aa, Artificial Sequence
  Synthetic construct
YIIPDAF

SEQ ID NO: 15263 - protein, 7 aa, Artificial Sequence
  Synthetic construct
YIIPDAY

SEQ ID NO: 15264 - protein, 7 aa, Artificial Sequence
  Synthetic construct
YIIPDQF

SEQ ID NO: 15265 - protein, 7 aa, Artificial Sequence
  Synthetic construct
YIIPDQY

SEQ ID NO: 15266 - protein, 7 aa, Artificial Sequence
  Synthetic construct
YIIPDDF

SEQ ID NO: 15267 - protein, 7 aa, Artificial Sequence
  Synthetic construct
YIIPDDY

SEQ ID NO: 15268 - protein, 7 aa, Artificial Sequence
  Synthetic construct
YIIPDVF

SEQ ID NO: 15269 - protein, 7 aa, Artificial Sequence
  Synthetic construct
YIIPDVY

SEQ ID NO: 15270 - protein, 7 aa, Artificial Sequence
  Synthetic construct
YIIPYFF

SEQ ID NO: 15271 - protein, 7 aa, Artificial Sequence
  Synthetic construct
YIIPYFY

SEQ ID NO: 15272 - protein, 7 aa, Artificial Sequence
  Synthetic construct
YIIPYRF

SEQ ID NO: 15273 - protein, 7 aa, Artificial Sequence
  Synthetic construct
YIIPYRY

SEQ ID NO: 15274 - protein, 7 aa, Artificial Sequence
  Synthetic construct
YIIPYCF

SEQ ID NO: 15275 - protein, 7 aa, Artificial Sequence
  Synthetic construct
YIIPYCY

SEQ ID NO: 15276 - protein, 7 aa, Artificial Sequence
  Synthetic construct
YIIPYLF

SEQ ID NO: 15277 - protein, 7 aa, Artificial Sequence
  Synthetic construct
YIIPYLY

SEQ ID NO: 15278 - protein, 7 aa, Artificial Sequence
  Synthetic construct
YIIPYAF

SEQ ID NO: 15279 - protein, 7 aa, Artificial Sequence
  Synthetic construct
YIIPYAY

SEQ ID NO: 15280 - protein, 7 aa, Artificial Sequence
  Synthetic construct
YIIPYQF

SEQ ID NO: 15281 - protein, 7 aa, Artificial Sequence
  Synthetic construct
YIIPYQY

SEQ ID NO: 15282 - protein, 7 aa, Artificial Sequence
  Synthetic construct
YIIPYDF

SEQ ID NO: 15283 - protein, 7 aa, Artificial Sequence
  Synthetic construct
YIIPYDY

SEQ ID NO: 15284 - protein, 7 aa, Artificial Sequence
  Synthetic construct
YIIPYVF

SEQ ID NO: 15285 - protein, 7 aa, Artificial Sequence
  Synthetic construct
YIIPYVY

SEQ ID NO: 15286 - protein, 7 aa, Artificial Sequence
  Synthetic construct
YIIPFFF

SEQ ID NO: 15287 - protein, 7 aa, Artificial Sequence
  Synthetic construct
YIIPFFY

SEQ ID NO: 15288 - protein, 7 aa, Artificial Sequence
  Synthetic construct
YIIPFRF

SEQ ID NO: 15289 - protein, 7 aa, Artificial Sequence
  Synthetic construct
YIIPFRY

SEQ ID NO: 15290 - protein, 7 aa, Artificial Sequence
  Synthetic construct
YIIPFCF

SEQ ID NO: 15291 - protein, 7 aa, Artificial Sequence
  Synthetic construct
YIIPFCY

SEQ ID NO: 15292 - protein, 7 aa, Artificial Sequence
  Synthetic construct
YIIPFLF

SEQ ID NO: 15293 - protein, 7 aa, Artificial Sequence
  Synthetic construct
YIIPFLY

SEQ ID NO: 15294 - protein, 7 aa, Artificial Sequence
  Synthetic construct
YIIPFAF

SEQ ID NO: 15295 - protein, 7 aa, Artificial Sequence
  Synthetic construct
YIIPFAY

SEQ ID NO: 15296 - protein, 7 aa, Artificial Sequence
  Synthetic construct
YIIPFQF

SEQ ID NO: 15297 - protein, 7 aa, Artificial Sequence
  Synthetic construct
YIIPFQY

SEQ ID NO: 15298 - protein, 7 aa, Artificial Sequence
  Synthetic construct
YIIPFDF

SEQ ID NO: 15299 - protein, 7 aa, Artificial Sequence
  Synthetic construct
YIIPFDY

SEQ ID NO: 15300 - protein, 7 aa, Artificial Sequence
  Synthetic construct
YIIPFVF

SEQ ID NO: 15301 - protein, 7 aa, Artificial Sequence
  Synthetic construct
YIIPFVY

SEQ ID NO: 15302 - protein, 7 aa, Artificial Sequence
  Synthetic construct
YIIPVFF

SEQ ID NO: 15303 - protein, 7 aa, Artificial Sequence
  Synthetic construct
YIIPVFY

SEQ ID NO: 15304 - protein, 7 aa, Artificial Sequence
  Synthetic construct
YIIPVRF

SEQ ID NO: 15305 - protein, 7 aa, Artificial Sequence
  Synthetic construct
YIIPVRY

SEQ ID NO: 15306 - protein, 7 aa, Artificial Sequence
  Synthetic construct
YIIPVCF

SEQ ID NO: 15307 - protein, 7 aa, Artificial Sequence
  Synthetic construct
YIIPVCY

SEQ ID NO: 15308 - protein, 7 aa, Artificial Sequence
  Synthetic construct
YIIPVLF

SEQ ID NO: 15309 - protein, 7 aa, Artificial Sequence
  Synthetic construct
YIIPVLY

SEQ ID NO: 15310 - protein, 7 aa, Artificial Sequence
  Synthetic construct
YIIPVAF

SEQ ID NO: 15311 - protein, 7 aa, Artificial Sequence
  Synthetic construct
YIIPVAY

SEQ ID NO: 15312 - protein, 7 aa, Artificial Sequence
  Synthetic construct
YIIPVQF

SEQ ID NO: 15313 - protein, 7 aa, Artificial Sequence
  Synthetic construct
YIIPVQY

SEQ ID NO: 15314 - protein, 7 aa, Artificial Sequence
  Synthetic construct
YIIPVDF

SEQ ID NO: 15315 - protein, 7 aa, Artificial Sequence
  Synthetic construct
YIIPVDY

SEQ ID NO: 15316 - protein, 7 aa, Artificial Sequence
  Synthetic construct
YIIPVVF

SEQ ID NO: 15317 - protein, 7 aa, Artificial Sequence
  Synthetic construct
YIIPVVY

SEQ ID NO: 15318 - protein, 7 aa, Artificial Sequence
  Synthetic construct
YIIPTFF

SEQ ID NO: 15319 - protein, 7 aa, Artificial Sequence
  Synthetic construct
YIIPTFY

SEQ ID NO: 15320 - protein, 7 aa, Artificial Sequence
  Synthetic construct
YIIPTRF

SEQ ID NO: 15321 - protein, 7 aa, Artificial Sequence
  Synthetic construct
YIIPTRY

SEQ ID NO: 15322 - protein, 7 aa, Artificial Sequence
  Synthetic construct
YIIPTCF

SEQ ID NO: 15323 - protein, 7 aa, Artificial Sequence
  Synthetic construct
YIIPTCY

SEQ ID NO: 15324 - protein, 7 aa, Artificial Sequence
  Synthetic construct
YIIPTLF

SEQ ID NO: 15325 - protein, 7 aa, Artificial Sequence
  Synthetic construct
YIIPTLY

SEQ ID NO: 15326 - protein, 7 aa, Artificial Sequence
  Synthetic construct
YIIPTAF

SEQ ID NO: 15327 - protein, 7 aa, Artificial Sequence
  Synthetic construct
YIIPTAY

SEQ ID NO: 15328 - protein, 7 aa, Artificial Sequence
  Synthetic construct
YIIPTQF

SEQ ID NO: 15329 - protein, 7 aa, Artificial Sequence
  Synthetic construct
YIIPTQY

SEQ ID NO: 15330 - protein, 7 aa, Artificial Sequence
  Synthetic construct
YIIPTDF

SEQ ID NO: 15331 - protein, 7 aa, Artificial Sequence
  Synthetic construct
YIIPTDY

SEQ ID NO: 15332 - protein, 7 aa, Artificial Sequence
  Synthetic construct
YIIPTVF

SEQ ID NO: 15333 - protein, 7 aa, Artificial Sequence
  Synthetic construct
YIIPTVY

SEQ ID NO: 15334 - protein, 7 aa, Artificial Sequence
  Synthetic construct
YIIPGFF

SEQ ID NO: 15335 - protein, 7 aa, Artificial Sequence
  Synthetic construct
YIIPGFY

SEQ ID NO: 15336 - protein, 7 aa, Artificial Sequence
  Synthetic construct
YIIPGRF

SEQ ID NO: 15337 - protein, 7 aa, Artificial Sequence
  Synthetic construct
YIIPGRY

SEQ ID NO: 15338 - protein, 7 aa, Artificial Sequence
  Synthetic construct
YIIPGCF

SEQ ID NO: 15339 - protein, 7 aa, Artificial Sequence
  Synthetic construct
YIIPGCY

SEQ ID NO: 15340 - protein, 7 aa, Artificial Sequence
  Synthetic construct
YIIPGLF

SEQ ID NO: 15341 - protein, 7 aa, Artificial Sequence
  Synthetic construct
YIIPGLY

SEQ ID NO: 15342 - protein, 7 aa, Artificial Sequence
  Synthetic construct
YIIPGAF

SEQ ID NO: 15343 - protein, 7 aa, Artificial Sequence
  Synthetic construct
YIIPGAY

SEQ ID NO: 15344 - protein, 7 aa, Artificial Sequence
  Synthetic construct
YIIPGQF

SEQ ID NO: 15345 - protein, 7 aa, Artificial Sequence
  Synthetic construct
YIIPGQY

SEQ ID NO: 15346 - protein, 7 aa, Artificial Sequence
  Synthetic construct
YIIPGDF

SEQ ID NO: 15347 - protein, 7 aa, Artificial Sequence
  Synthetic construct
YIIPGDY

SEQ ID NO: 15348 - protein, 7 aa, Artificial Sequence
  Synthetic construct
YIIPGVF

SEQ ID NO: 15349 - protein, 7 aa, Artificial Sequence
  Synthetic construct
YIIPGVY

SEQ ID NO: 15350 - protein, 7 aa, Artificial Sequence
  Synthetic construct
YIIPAFF

SEQ ID NO: 15351 - protein, 7 aa, Artificial Sequence
  Synthetic construct
YIIPAFY

SEQ ID NO: 15352 - protein, 7 aa, Artificial Sequence
  Synthetic construct
YIIPARF

SEQ ID NO: 15353 - protein, 7 aa, Artificial Sequence
  Synthetic construct
YIIPARY

SEQ ID NO: 15354 - protein, 7 aa, Artificial Sequence
  Synthetic construct
YIIPACF

SEQ ID NO: 15355 - protein, 7 aa, Artificial Sequence
  Synthetic construct
YIIPACY

SEQ ID NO: 15356 - protein, 7 aa, Artificial Sequence
  Synthetic construct
YIIPALF

SEQ ID NO: 15357 - protein, 7 aa, Artificial Sequence
  Synthetic construct
YIIPALY

SEQ ID NO: 15358 - protein, 7 aa, Artificial Sequence
  Synthetic construct
YIIPAAF

SEQ ID NO: 15359 - protein, 7 aa, Artificial Sequence
  Synthetic construct
YIIPAAY

SEQ ID NO: 15360 - protein, 7 aa, Artificial Sequence
  Synthetic construct
YIIPAQF

SEQ ID NO: 15361 - protein, 7 aa, Artificial Sequence
  Synthetic construct
YIIPAQY

SEQ ID NO: 15362 - protein, 7 aa, Artificial Sequence
  Synthetic construct
YIIPADF

SEQ ID NO: 15363 - protein, 7 aa, Artificial Sequence
  Synthetic construct
YIIPADY

SEQ ID NO: 15364 - protein, 7 aa, Artificial Sequence
  Synthetic construct
YIIPAVF

SEQ ID NO: 15365 - protein, 7 aa, Artificial Sequence
  Synthetic construct
YIIPAVY

SEQ ID NO: 15366 - protein, 7 aa, Artificial Sequence
  Synthetic construct
YIIPQFF

SEQ ID NO: 15367 - protein, 7 aa, Artificial Sequence
  Synthetic construct
YIIPQFY

SEQ ID NO: 15368 - protein, 7 aa, Artificial Sequence
  Synthetic construct
YIIPQRF

SEQ ID NO: 15369 - protein, 7 aa, Artificial Sequence
  Synthetic construct
YIIPQRY

SEQ ID NO: 15370 - protein, 7 aa, Artificial Sequence
  Synthetic construct
YIIPQCF

SEQ ID NO: 15371 - protein, 7 aa, Artificial Sequence
  Synthetic construct
YIIPQCY

SEQ ID NO: 15372 - protein, 7 aa, Artificial Sequence
  Synthetic construct
YIIPQLF

SEQ ID NO: 15373 - protein, 7 aa, Artificial Sequence
  Synthetic construct
YIIPQLY

SEQ ID NO: 15374 - protein, 7 aa, Artificial Sequence
  Synthetic construct
YIIPQAF

SEQ ID NO: 15375 - protein, 7 aa, Artificial Sequence
  Synthetic construct
YIIPQAY

SEQ ID NO: 15376 - protein, 7 aa, Artificial Sequence
  Synthetic construct
YIIPQQF

SEQ ID NO: 15377 - protein, 7 aa, Artificial Sequence
  Synthetic construct
YIIPQQY

SEQ ID NO: 15378 - protein, 7 aa, Artificial Sequence
  Synthetic construct
YIIPQDF

SEQ ID NO: 15379 - protein, 7 aa, Artificial Sequence
  Synthetic construct
YIIPQDY

SEQ ID NO: 15380 - protein, 7 aa, Artificial Sequence
  Synthetic construct
YIIPQVF

SEQ ID NO: 15381 - protein, 7 aa, Artificial Sequence
  Synthetic construct
YIIPQVY

SEQ ID NO: 15382 - protein, 7 aa, Artificial Sequence
  Synthetic construct
YIIHIFF

SEQ ID NO: 15383 - protein, 7 aa, Artificial Sequence
  Synthetic construct
YIIHIFY

SEQ ID NO: 15384 - protein, 7 aa, Artificial Sequence
  Synthetic construct
YIIHIRF

SEQ ID NO: 15385 - protein, 7 aa, Artificial Sequence
  Synthetic construct
YIIHIRY

SEQ ID NO: 15386 - protein, 7 aa, Artificial Sequence
  Synthetic construct
YIIHICF

SEQ ID NO: 15387 - protein, 7 aa, Artificial Sequence
  Synthetic construct
YIIHICY

SEQ ID NO: 15388 - protein, 7 aa, Artificial Sequence
  Synthetic construct
YIIHILF

SEQ ID NO: 15389 - protein, 7 aa, Artificial Sequence
  Synthetic construct
YIIHILY

SEQ ID NO: 15390 - protein, 7 aa, Artificial Sequence
  Synthetic construct
YIIHIAF

SEQ ID NO: 15391 - protein, 7 aa, Artificial Sequence
  Synthetic construct
YIIHIAY

SEQ ID NO: 15392 - protein, 7 aa, Artificial Sequence
  Synthetic construct
YIIHIQF

SEQ ID NO: 15393 - protein, 7 aa, Artificial Sequence
  Synthetic construct
YIIHIQY

SEQ ID NO: 15394 - protein, 7 aa, Artificial Sequence
  Synthetic construct
YIIHIDF

SEQ ID NO: 15395 - protein, 7 aa, Artificial Sequence
  Synthetic construct
YIIHIDY

SEQ ID NO: 15396 - protein, 7 aa, Artificial Sequence
  Synthetic construct
YIIHIVF

SEQ ID NO: 15397 - protein, 7 aa, Artificial Sequence
  Synthetic construct
YIIHIVY

SEQ ID NO: 15398 - protein, 7 aa, Artificial Sequence
  Synthetic construct
YIIHDFF

SEQ ID NO: 15399 - protein, 7 aa, Artificial Sequence
  Synthetic construct
YIIHDFY

SEQ ID NO: 15400 - protein, 7 aa, Artificial Sequence
  Synthetic construct
YIIHDRF

SEQ ID NO: 15401 - protein, 7 aa, Artificial Sequence
  Synthetic construct
YIIHDRY

SEQ ID NO: 15402 - protein, 7 aa, Artificial Sequence
  Synthetic construct
YIIHDCF

SEQ ID NO: 15403 - protein, 7 aa, Artificial Sequence
  Synthetic construct
YIIHDCY

SEQ ID NO: 15404 - protein, 7 aa, Artificial Sequence
  Synthetic construct
YIIHDLF

SEQ ID NO: 15405 - protein, 7 aa, Artificial Sequence
  Synthetic construct
YIIHDLY

SEQ ID NO: 15406 - protein, 7 aa, Artificial Sequence
  Synthetic construct
YIIHDAF

SEQ ID NO: 15407 - protein, 7 aa, Artificial Sequence
  Synthetic construct
YIIHDAY

SEQ ID NO: 15408 - protein, 7 aa, Artificial Sequence
  Synthetic construct
YIIHDQF

SEQ ID NO: 15409 - protein, 7 aa, Artificial Sequence
  Synthetic construct
YIIHDQY

SEQ ID NO: 15410 - protein, 7 aa, Artificial Sequence
  Synthetic construct
YIIHDDF

SEQ ID NO: 15411 - protein, 7 aa, Artificial Sequence
  Synthetic construct
YIIHDDY

SEQ ID NO: 15412 - protein, 7 aa, Artificial Sequence
  Synthetic construct
YIIHDVF

SEQ ID NO: 15413 - protein, 7 aa, Artificial Sequence
  Synthetic construct
YIIHDVY

SEQ ID NO: 15414 - protein, 7 aa, Artificial Sequence
  Synthetic construct
YIIHYFF

SEQ ID NO: 15415 - protein, 7 aa, Artificial Sequence
  Synthetic construct
YIIHYFY

SEQ ID NO: 15416 - protein, 7 aa, Artificial Sequence
  Synthetic construct
YIIHYRF

SEQ ID NO: 15417 - protein, 7 aa, Artificial Sequence
  Synthetic construct
YIIHYRY

SEQ ID NO: 15418 - protein, 7 aa, Artificial Sequence
  Synthetic construct
YIIHYCF

SEQ ID NO: 15419 - protein, 7 aa, Artificial Sequence
  Synthetic construct
YIIHYCY

SEQ ID NO: 15420 - protein, 7 aa, Artificial Sequence
  Synthetic construct
YIIHYLF

SEQ ID NO: 15421 - protein, 7 aa, Artificial Sequence
  Synthetic construct
YIIHYLY

SEQ ID NO: 15422 - protein, 7 aa, Artificial Sequence
  Synthetic construct
YIIHYAF

SEQ ID NO: 15423 - protein, 7 aa, Artificial Sequence
  Synthetic construct
YIIHYAY

SEQ ID NO: 15424 - protein, 7 aa, Artificial Sequence
  Synthetic construct
YIIHYQF

SEQ ID NO: 15425 - protein, 7 aa, Artificial Sequence
  Synthetic construct
YIIHYQY

SEQ ID NO: 15426 - protein, 7 aa, Artificial Sequence
  Synthetic construct
YIIHYDF

SEQ ID NO: 15427 - protein, 7 aa, Artificial Sequence
  Synthetic construct
YIIHYDY

SEQ ID NO: 15428 - protein, 7 aa, Artificial Sequence
  Synthetic construct
YIIHYVF

SEQ ID NO: 15429 - protein, 7 aa, Artificial Sequence
  Synthetic construct
YIIHYVY

SEQ ID NO: 15430 - protein, 7 aa, Artificial Sequence
  Synthetic construct
YIIHFFF

SEQ ID NO: 15431 - protein, 7 aa, Artificial Sequence
  Synthetic construct
YIIHFFY

SEQ ID NO: 15432 - protein, 7 aa, Artificial Sequence
  Synthetic construct
YIIHFRF

SEQ ID NO: 15433 - protein, 7 aa, Artificial Sequence
  Synthetic construct
YIIHFRY

SEQ ID NO: 15434 - protein, 7 aa, Artificial Sequence
  Synthetic construct
YIIHFCF

SEQ ID NO: 15435 - protein, 7 aa, Artificial Sequence
  Synthetic construct
YIIHFCY

SEQ ID NO: 15436 - protein, 7 aa, Artificial Sequence
  Synthetic construct
YIIHFLF

SEQ ID NO: 15437 - protein, 7 aa, Artificial Sequence
  Synthetic construct
YIIHFLY

SEQ ID NO: 15438 - protein, 7 aa, Artificial Sequence
  Synthetic construct
YIIHFAF

SEQ ID NO: 15439 - protein, 7 aa, Artificial Sequence
  Synthetic construct
YIIHFAY

SEQ ID NO: 15440 - protein, 7 aa, Artificial Sequence
  Synthetic construct
YIIHFQF

SEQ ID NO: 15441 - protein, 7 aa, Artificial Sequence
  Synthetic construct
YIIHFQY

SEQ ID NO: 15442 - protein, 7 aa, Artificial Sequence
  Synthetic construct
YIIHFDF

SEQ ID NO: 15443 - protein, 7 aa, Artificial Sequence
  Synthetic construct
YIIHFDY

SEQ ID NO: 15444 - protein, 7 aa, Artificial Sequence
  Synthetic construct
YIIHFVF

SEQ ID NO: 15445 - protein, 7 aa, Artificial Sequence
  Synthetic construct
YIIHFVY

SEQ ID NO: 15446 - protein, 7 aa, Artificial Sequence
  Synthetic construct
YIIHVFF

SEQ ID NO: 15447 - protein, 7 aa, Artificial Sequence
  Synthetic construct
YIIHVFY

SEQ ID NO: 15448 - protein, 7 aa, Artificial Sequence
  Synthetic construct
YIIHVRF

SEQ ID NO: 15449 - protein, 7 aa, Artificial Sequence
  Synthetic construct
YIIHVRY

SEQ ID NO: 15450 - protein, 7 aa, Artificial Sequence
  Synthetic construct
YIIHVCF

SEQ ID NO: 15451 - protein, 7 aa, Artificial Sequence
  Synthetic construct
YIIHVCY

SEQ ID NO: 15452 - protein, 7 aa, Artificial Sequence
  Synthetic construct
YIIHVLF

SEQ ID NO: 15453 - protein, 7 aa, Artificial Sequence
  Synthetic construct
YIIHVLY

SEQ ID NO: 15454 - protein, 7 aa, Artificial Sequence
  Synthetic construct
YIIHVAF

SEQ ID NO: 15455 - protein, 7 aa, Artificial Sequence
  Synthetic construct
YIIHVAY

SEQ ID NO: 15456 - protein, 7 aa, Artificial Sequence
  Synthetic construct
YIIHVQF

SEQ ID NO: 15457 - protein, 7 aa, Artificial Sequence
  Synthetic construct
YIIHVQY

SEQ ID NO: 15458 - protein, 7 aa, Artificial Sequence
  Synthetic construct
YIIHVDF

SEQ ID NO: 15459 - protein, 7 aa, Artificial Sequence
  Synthetic construct
YIIHVDY

SEQ ID NO: 15460 - protein, 7 aa, Artificial Sequence
  Synthetic construct
YIIHVVF

SEQ ID NO: 15461 - protein, 7 aa, Artificial Sequence
  Synthetic construct
YIIHVVY

SEQ ID NO: 15462 - protein, 7 aa, Artificial Sequence
  Synthetic construct
YIIHTFF

SEQ ID NO: 15463 - protein, 7 aa, Artificial Sequence
  Synthetic construct
YIIHTFY

SEQ ID NO: 15464 - protein, 7 aa, Artificial Sequence
  Synthetic construct
YIIHTRF

SEQ ID NO: 15465 - protein, 7 aa, Artificial Sequence
  Synthetic construct
YIIHTRY

SEQ ID NO: 15466 - protein, 7 aa, Artificial Sequence
  Synthetic construct
YIIHTCF

SEQ ID NO: 15467 - protein, 7 aa, Artificial Sequence
  Synthetic construct
YIIHTCY

SEQ ID NO: 15468 - protein, 7 aa, Artificial Sequence
  Synthetic construct
YIIHTLF

SEQ ID NO: 15469 - protein, 7 aa, Artificial Sequence
  Synthetic construct
YIIHTLY

SEQ ID NO: 15470 - protein, 7 aa, Artificial Sequence
  Synthetic construct
YIIHTAF

SEQ ID NO: 15471 - protein, 7 aa, Artificial Sequence
  Synthetic construct
YIIHTAY

SEQ ID NO: 15472 - protein, 7 aa, Artificial Sequence
  Synthetic construct
YIIHTQF

SEQ ID NO: 15473 - protein, 7 aa, Artificial Sequence
  Synthetic construct
YIIHTQY

SEQ ID NO: 15474 - protein, 7 aa, Artificial Sequence
  Synthetic construct
YIIHTDF

SEQ ID NO: 15475 - protein, 7 aa, Artificial Sequence
  Synthetic construct
YIIHTDY

SEQ ID NO: 15476 - protein, 7 aa, Artificial Sequence
  Synthetic construct
YIIHTVF

SEQ ID NO: 15477 - protein, 7 aa, Artificial Sequence
  Synthetic construct
YIIHTVY

SEQ ID NO: 15478 - protein, 7 aa, Artificial Sequence
  Synthetic construct
YIIHGFF

SEQ ID NO: 15479 - protein, 7 aa, Artificial Sequence
  Synthetic construct
YIIHGFY

SEQ ID NO: 15480 - protein, 7 aa, Artificial Sequence
  Synthetic construct
YIIHGRF

SEQ ID NO: 15481 - protein, 7 aa, Artificial Sequence
  Synthetic construct
YIIHGRY

SEQ ID NO: 15482 - protein, 7 aa, Artificial Sequence
  Synthetic construct
YIIHGCF

SEQ ID NO: 15483 - protein, 7 aa, Artificial Sequence
  Synthetic construct
YIIHGCY

SEQ ID NO: 15484 - protein, 7 aa, Artificial Sequence
  Synthetic construct
YIIHGLF

SEQ ID NO: 15485 - protein, 7 aa, Artificial Sequence
  Synthetic construct
YIIHGLY

SEQ ID NO: 15486 - protein, 7 aa, Artificial Sequence
  Synthetic construct
YIIHGAF

SEQ ID NO: 15487 - protein, 7 aa, Artificial Sequence
  Synthetic construct
YIIHGAY

SEQ ID NO: 15488 - protein, 7 aa, Artificial Sequence
  Synthetic construct
YIIHGQF

SEQ ID NO: 15489 - protein, 7 aa, Artificial Sequence
  Synthetic construct
YIIHGQY

SEQ ID NO: 15490 - protein, 7 aa, Artificial Sequence
  Synthetic construct
YIIHGDF

SEQ ID NO: 15491 - protein, 7 aa, Artificial Sequence
  Synthetic construct
YIIHGDY

SEQ ID NO: 15492 - protein, 7 aa, Artificial Sequence
  Synthetic construct
YIIHGVF

SEQ ID NO: 15493 - protein, 7 aa, Artificial Sequence
  Synthetic construct
YIIHGVY

SEQ ID NO: 15494 - protein, 7 aa, Artificial Sequence
  Synthetic construct
YIIHAFF

SEQ ID NO: 15495 - protein, 7 aa, Artificial Sequence
  Synthetic construct
YIIHAFY

SEQ ID NO: 15496 - protein, 7 aa, Artificial Sequence
  Synthetic construct
YIIHARF

SEQ ID NO: 15497 - protein, 7 aa, Artificial Sequence
  Synthetic construct
YIIHARY

SEQ ID NO: 15498 - protein, 7 aa, Artificial Sequence
  Synthetic construct
YIIHACF

SEQ ID NO: 15499 - protein, 7 aa, Artificial Sequence
  Synthetic construct
YIIHACY

SEQ ID NO: 15500 - protein, 7 aa, Artificial Sequence
  Synthetic construct
YIIHALF

SEQ ID NO: 15501 - protein, 7 aa, Artificial Sequence
  Synthetic construct
YIIHALY

SEQ ID NO: 15502 - protein, 7 aa, Artificial Sequence
  Synthetic construct
YIIHAAF

SEQ ID NO: 15503 - protein, 7 aa, Artificial Sequence
  Synthetic construct
YIIHAAY

SEQ ID NO: 15504 - protein, 7 aa, Artificial Sequence
  Synthetic construct
YIIHAQF

SEQ ID NO: 15505 - protein, 7 aa, Artificial Sequence
  Synthetic construct
YIIHAQY

SEQ ID NO: 15506 - protein, 7 aa, Artificial Sequence
  Synthetic construct
YIIHADF

SEQ ID NO: 15507 - protein, 7 aa, Artificial Sequence
  Synthetic construct
YIIHADY

SEQ ID NO: 15508 - protein, 7 aa, Artificial Sequence
  Synthetic construct
YIIHAVF

SEQ ID NO: 15509 - protein, 7 aa, Artificial Sequence
  Synthetic construct
YIIHAVY

SEQ ID NO: 15510 - protein, 7 aa, Artificial Sequence
  Synthetic construct
YIIHQFF

SEQ ID NO: 15511 - protein, 7 aa, Artificial Sequence
  Synthetic construct
YIIHQFY

SEQ ID NO: 15512 - protein, 7 aa, Artificial Sequence
  Synthetic construct
YIIHQRF

SEQ ID NO: 15513 - protein, 7 aa, Artificial Sequence
  Synthetic construct
YIIHQRY

SEQ ID NO: 15514 - protein, 7 aa, Artificial Sequence
  Synthetic construct
YIIHQCF

SEQ ID NO: 15515 - protein, 7 aa, Artificial Sequence
  Synthetic construct
YIIHQCY

SEQ ID NO: 15516 - protein, 7 aa, Artificial Sequence
  Synthetic construct
YIIHQLF

SEQ ID NO: 15517 - protein, 7 aa, Artificial Sequence
  Synthetic construct
YIIHQLY

SEQ ID NO: 15518 - protein, 7 aa, Artificial Sequence
  Synthetic construct
YIIHQAF

SEQ ID NO: 15519 - protein, 7 aa, Artificial Sequence
  Synthetic construct
YIIHQAY

SEQ ID NO: 15520 - protein, 7 aa, Artificial Sequence
  Synthetic construct
YIIHQQF

SEQ ID NO: 15521 - protein, 7 aa, Artificial Sequence
  Synthetic construct
YIIHQQY

SEQ ID NO: 15522 - protein, 7 aa, Artificial Sequence
  Synthetic construct
YIIHQDF

SEQ ID NO: 15523 - protein, 7 aa, Artificial Sequence
  Synthetic construct
YIIHQDY

SEQ ID NO: 15524 - protein, 7 aa, Artificial Sequence
  Synthetic construct
YIIHQVF

SEQ ID NO: 15525 - protein, 7 aa, Artificial Sequence
  Synthetic construct
YIIHQVY

SEQ ID NO: 15526 - protein, 7 aa, Artificial Sequence
  Synthetic construct
YIILIFF

SEQ ID NO: 15527 - protein, 7 aa, Artificial Sequence
  Synthetic construct
YIILIFY

SEQ ID NO: 15528 - protein, 7 aa, Artificial Sequence
  Synthetic construct
YIILIRF

SEQ ID NO: 15529 - protein, 7 aa, Artificial Sequence
  Synthetic construct
YIILIRY

SEQ ID NO: 15530 - protein, 7 aa, Artificial Sequence
  Synthetic construct
YIILICF

SEQ ID NO: 15531 - protein, 7 aa, Artificial Sequence
  Synthetic construct
YIILICY

SEQ ID NO: 15532 - protein, 7 aa, Artificial Sequence
  Synthetic construct
YIILILF

SEQ ID NO: 15533 - protein, 7 aa, Artificial Sequence
  Synthetic construct
YIILILY

SEQ ID NO: 15534 - protein, 7 aa, Artificial Sequence
  Synthetic construct
YIILIAF

SEQ ID NO: 15535 - protein, 7 aa, Artificial Sequence
  Synthetic construct
YIILIAY

SEQ ID NO: 15536 - protein, 7 aa, Artificial Sequence
  Synthetic construct
YIILIQF

SEQ ID NO: 15537 - protein, 7 aa, Artificial Sequence
  Synthetic construct
YIILIQY

SEQ ID NO: 15538 - protein, 7 aa, Artificial Sequence
  Synthetic construct
YIILIDF

SEQ ID NO: 15539 - protein, 7 aa, Artificial Sequence
  Synthetic construct
YIILIDY

SEQ ID NO: 15540 - protein, 7 aa, Artificial Sequence
  Synthetic construct
YIILIVF

SEQ ID NO: 15541 - protein, 7 aa, Artificial Sequence
  Synthetic construct
YIILIVY

SEQ ID NO: 15542 - protein, 7 aa, Artificial Sequence
  Synthetic construct
YIILDFF

SEQ ID NO: 15543 - protein, 7 aa, Artificial Sequence
  Synthetic construct
YIILDFY

SEQ ID NO: 15544 - protein, 7 aa, Artificial Sequence
  Synthetic construct
YIILDRF

SEQ ID NO: 15545 - protein, 7 aa, Artificial Sequence
  Synthetic construct
YIILDRY

SEQ ID NO: 15546 - protein, 7 aa, Artificial Sequence
  Synthetic construct
YIILDCF

SEQ ID NO: 15547 - protein, 7 aa, Artificial Sequence
  Synthetic construct
YIILDCY

SEQ ID NO: 15548 - protein, 7 aa, Artificial Sequence
  Synthetic construct
YIILDLF

SEQ ID NO: 15549 - protein, 7 aa, Artificial Sequence
  Synthetic construct
YIILDLY

SEQ ID NO: 15550 - protein, 7 aa, Artificial Sequence
  Synthetic construct
YIILDAF

SEQ ID NO: 15551 - protein, 7 aa, Artificial Sequence
  Synthetic construct
YIILDAY

SEQ ID NO: 15552 - protein, 7 aa, Artificial Sequence
  Synthetic construct
YIILDQF

SEQ ID NO: 15553 - protein, 7 aa, Artificial Sequence
  Synthetic construct
YIILDQY

SEQ ID NO: 15554 - protein, 7 aa, Artificial Sequence
  Synthetic construct
YIILDDF

SEQ ID NO: 15555 - protein, 7 aa, Artificial Sequence
  Synthetic construct
YIILDDY

SEQ ID NO: 15556 - protein, 7 aa, Artificial Sequence
  Synthetic construct
YIILDVF

SEQ ID NO: 15557 - protein, 7 aa, Artificial Sequence
  Synthetic construct
YIILDVY

SEQ ID NO: 15558 - protein, 7 aa, Artificial Sequence
  Synthetic construct
YIILYFF

SEQ ID NO: 15559 - protein, 7 aa, Artificial Sequence
  Synthetic construct
YIILYFY

SEQ ID NO: 15560 - protein, 7 aa, Artificial Sequence
  Synthetic construct
YIILYRF

SEQ ID NO: 15561 - protein, 7 aa, Artificial Sequence
  Synthetic construct
YIILYRY

SEQ ID NO: 15562 - protein, 7 aa, Artificial Sequence
  Synthetic construct
YIILYCF

SEQ ID NO: 15563 - protein, 7 aa, Artificial Sequence
  Synthetic construct
YIILYCY

SEQ ID NO: 15564 - protein, 7 aa, Artificial Sequence
  Synthetic construct
YIILYLF

SEQ ID NO: 15565 - protein, 7 aa, Artificial Sequence
  Synthetic construct
YIILYLY

SEQ ID NO: 15566 - protein, 7 aa, Artificial Sequence
  Synthetic construct
YIILYAF

SEQ ID NO: 15567 - protein, 7 aa, Artificial Sequence
  Synthetic construct
YIILYAY

SEQ ID NO: 15568 - protein, 7 aa, Artificial Sequence
  Synthetic construct
YIILYQF

SEQ ID NO: 15569 - protein, 7 aa, Artificial Sequence
  Synthetic construct
YIILYQY

SEQ ID NO: 15570 - protein, 7 aa, Artificial Sequence
  Synthetic construct
YIILYDF

SEQ ID NO: 15571 - protein, 7 aa, Artificial Sequence
  Synthetic construct
YIILYDY

SEQ ID NO: 15572 - protein, 7 aa, Artificial Sequence
  Synthetic construct
YIILYVF

SEQ ID NO: 15573 - protein, 7 aa, Artificial Sequence
  Synthetic construct
YIILYVY

SEQ ID NO: 15574 - protein, 7 aa, Artificial Sequence
  Synthetic construct
YIILFFF

SEQ ID NO: 15575 - protein, 7 aa, Artificial Sequence
  Synthetic construct
YIILFFY

SEQ ID NO: 15576 - protein, 7 aa, Artificial Sequence
  Synthetic construct
YIILFRF

SEQ ID NO: 15577 - protein, 7 aa, Artificial Sequence
  Synthetic construct
YIILFRY

SEQ ID NO: 15578 - protein, 7 aa, Artificial Sequence
  Synthetic construct
YIILFCF

SEQ ID NO: 15579 - protein, 7 aa, Artificial Sequence
  Synthetic construct
YIILFCY

SEQ ID NO: 15580 - protein, 7 aa, Artificial Sequence
  Synthetic construct
YIILFLF

SEQ ID NO: 15581 - protein, 7 aa, Artificial Sequence
  Synthetic construct
YIILFLY

SEQ ID NO: 15582 - protein, 7 aa, Artificial Sequence
  Synthetic construct
YIILFAF

SEQ ID NO: 15583 - protein, 7 aa, Artificial Sequence
  Synthetic construct
YIILFAY

SEQ ID NO: 15584 - protein, 7 aa, Artificial Sequence
  Synthetic construct
YIILFQF

SEQ ID NO: 15585 - protein, 7 aa, Artificial Sequence
  Synthetic construct
YIILFQY

SEQ ID NO: 15586 - protein, 7 aa, Artificial Sequence
  Synthetic construct
YIILFDF

SEQ ID NO: 15587 - protein, 7 aa, Artificial Sequence
  Synthetic construct
YIILFDY

SEQ ID NO: 15588 - protein, 7 aa, Artificial Sequence
  Synthetic construct
YIILFVF

SEQ ID NO: 15589 - protein, 7 aa, Artificial Sequence
  Synthetic construct
YIILFVY

SEQ ID NO: 15590 - protein, 7 aa, Artificial Sequence
  Synthetic construct
YIILVFF

SEQ ID NO: 15591 - protein, 7 aa, Artificial Sequence
  Synthetic construct
YIILVFY

SEQ ID NO: 15592 - protein, 7 aa, Artificial Sequence
  Synthetic construct
YIILVRF

SEQ ID NO: 15593 - protein, 7 aa, Artificial Sequence
  Synthetic construct
YIILVRY

SEQ ID NO: 15594 - protein, 7 aa, Artificial Sequence
  Synthetic construct
YIILVCF

SEQ ID NO: 15595 - protein, 7 aa, Artificial Sequence
  Synthetic construct
YIILVCY

SEQ ID NO: 15596 - protein, 7 aa, Artificial Sequence
  Synthetic construct
YIILVLF

SEQ ID NO: 15597 - protein, 7 aa, Artificial Sequence
  Synthetic construct
YIILVLY

SEQ ID NO: 15598 - protein, 7 aa, Artificial Sequence
  Synthetic construct
YIILVAF

SEQ ID NO: 15599 - protein, 7 aa, Artificial Sequence
  Synthetic construct
YIILVAY

SEQ ID NO: 15600 - protein, 7 aa, Artificial Sequence
  Synthetic construct
YIILVQF

SEQ ID NO: 15601 - protein, 7 aa, Artificial Sequence
  Synthetic construct
YIILVQY

SEQ ID NO: 15602 - protein, 7 aa, Artificial Sequence
  Synthetic construct
YIILVDF

SEQ ID NO: 15603 - protein, 7 aa, Artificial Sequence
  Synthetic construct
YIILVDY

SEQ ID NO: 15604 - protein, 7 aa, Artificial Sequence
  Synthetic construct
YIILVVF

SEQ ID NO: 15605 - protein, 7 aa, Artificial Sequence
  Synthetic construct
YIILVVY

SEQ ID NO: 15606 - protein, 7 aa, Artificial Sequence
  Synthetic construct
YIILTFF

SEQ ID NO: 15607 - protein, 7 aa, Artificial Sequence
  Synthetic construct
YIILTFY

SEQ ID NO: 15608 - protein, 7 aa, Artificial Sequence
  Synthetic construct
YIILTRF

SEQ ID NO: 15609 - protein, 7 aa, Artificial Sequence
  Synthetic construct
YIILTRY

SEQ ID NO: 15610 - protein, 7 aa, Artificial Sequence
  Synthetic construct
YIILTCF

SEQ ID NO: 15611 - protein, 7 aa, Artificial Sequence
  Synthetic construct
YIILTCY

SEQ ID NO: 15612 - protein, 7 aa, Artificial Sequence
  Synthetic construct
YIILTLF

SEQ ID NO: 15613 - protein, 7 aa, Artificial Sequence
  Synthetic construct
YIILTLY

SEQ ID NO: 15614 - protein, 7 aa, Artificial Sequence
  Synthetic construct
YIILTAF

SEQ ID NO: 15615 - protein, 7 aa, Artificial Sequence
  Synthetic construct
YIILTAY

SEQ ID NO: 15616 - protein, 7 aa, Artificial Sequence
  Synthetic construct
YIILTQF

SEQ ID NO: 15617 - protein, 7 aa, Artificial Sequence
  Synthetic construct
YIILTQY

SEQ ID NO: 15618 - protein, 7 aa, Artificial Sequence
  Synthetic construct
YIILTDF

SEQ ID NO: 15619 - protein, 7 aa, Artificial Sequence
  Synthetic construct
YIILTDY

SEQ ID NO: 15620 - protein, 7 aa, Artificial Sequence
  Synthetic construct
YIILTVF

SEQ ID NO: 15621 - protein, 7 aa, Artificial Sequence
  Synthetic construct
YIILTVY

SEQ ID NO: 15622 - protein, 7 aa, Artificial Sequence
  Synthetic construct
YIILGFF

SEQ ID NO: 15623 - protein, 7 aa, Artificial Sequence
  Synthetic construct
YIILGFY

SEQ ID NO: 15624 - protein, 7 aa, Artificial Sequence
  Synthetic construct
YIILGRF

SEQ ID NO: 15625 - protein, 7 aa, Artificial Sequence
  Synthetic construct
YIILGRY

SEQ ID NO: 15626 - protein, 7 aa, Artificial Sequence
  Synthetic construct
YIILGCF

SEQ ID NO: 15627 - protein, 7 aa, Artificial Sequence
  Synthetic construct
YIILGCY

SEQ ID NO: 15628 - protein, 7 aa, Artificial Sequence
  Synthetic construct
YIILGLF

SEQ ID NO: 15629 - protein, 7 aa, Artificial Sequence
  Synthetic construct
YIILGLY

SEQ ID NO: 15630 - protein, 7 aa, Artificial Sequence
  Synthetic construct
YIILGAF

SEQ ID NO: 15631 - protein, 7 aa, Artificial Sequence
  Synthetic construct
YIILGAY

SEQ ID NO: 15632 - protein, 7 aa, Artificial Sequence
  Synthetic construct
YIILGQF

SEQ ID NO: 15633 - protein, 7 aa, Artificial Sequence
  Synthetic construct
YIILGQY

SEQ ID NO: 15634 - protein, 7 aa, Artificial Sequence
  Synthetic construct
YIILGDF

SEQ ID NO: 15635 - protein, 7 aa, Artificial Sequence
  Synthetic construct
YIILGDY

SEQ ID NO: 15636 - protein, 7 aa, Artificial Sequence
  Synthetic construct
YIILGVF

SEQ ID NO: 15637 - protein, 7 aa, Artificial Sequence
  Synthetic construct
YIILGVY

SEQ ID NO: 15638 - protein, 7 aa, Artificial Sequence
  Synthetic construct
YIILAFF

SEQ ID NO: 15639 - protein, 7 aa, Artificial Sequence
  Synthetic construct
YIILAFY

SEQ ID NO: 15640 - protein, 7 aa, Artificial Sequence
  Synthetic construct
YIILARF

SEQ ID NO: 15641 - protein, 7 aa, Artificial Sequence
  Synthetic construct
YIILARY

SEQ ID NO: 15642 - protein, 7 aa, Artificial Sequence
  Synthetic construct
YIILACF

SEQ ID NO: 15643 - protein, 7 aa, Artificial Sequence
  Synthetic construct
YIILACY

SEQ ID NO: 15644 - protein, 7 aa, Artificial Sequence
  Synthetic construct
YIILALF

SEQ ID NO: 15645 - protein, 7 aa, Artificial Sequence
  Synthetic construct
YIILALY

SEQ ID NO: 15646 - protein, 7 aa, Artificial Sequence
  Synthetic construct
YIILAAF

SEQ ID NO: 15647 - protein, 7 aa, Artificial Sequence
  Synthetic construct
YIILAAY

SEQ ID NO: 15648 - protein, 7 aa, Artificial Sequence
  Synthetic construct
YIILAQF

SEQ ID NO: 15649 - protein, 7 aa, Artificial Sequence
  Synthetic construct
YIILAQY

SEQ ID NO: 15650 - protein, 7 aa, Artificial Sequence
  Synthetic construct
YIILADF

SEQ ID NO: 15651 - protein, 7 aa, Artificial Sequence
  Synthetic construct
YIILADY

SEQ ID NO: 15652 - protein, 7 aa, Artificial Sequence
  Synthetic construct
YIILAVF

SEQ ID NO: 15653 - protein, 7 aa, Artificial Sequence
  Synthetic construct
YIILAVY

SEQ ID NO: 15654 - protein, 7 aa, Artificial Sequence
  Synthetic construct
YIILQFF

SEQ ID NO: 15655 - protein, 7 aa, Artificial Sequence
  Synthetic construct
YIILQFY

SEQ ID NO: 15656 - protein, 7 aa, Artificial Sequence
  Synthetic construct
YIILQRF

SEQ ID NO: 15657 - protein, 7 aa, Artificial Sequence
  Synthetic construct
YIILQRY

SEQ ID NO: 15658 - protein, 7 aa, Artificial Sequence
  Synthetic construct
YIILQCF

SEQ ID NO: 15659 - protein, 7 aa, Artificial Sequence
  Synthetic construct
YIILQCY

SEQ ID NO: 15660 - protein, 7 aa, Artificial Sequence
  Synthetic construct
YIILQLF

SEQ ID NO: 15661 - protein, 7 aa, Artificial Sequence
  Synthetic construct
YIILQLY

SEQ ID NO: 15662 - protein, 7 aa, Artificial Sequence
  Synthetic construct
YIILQAF

SEQ ID NO: 15663 - protein, 7 aa, Artificial Sequence
  Synthetic construct
YIILQAY

SEQ ID NO: 15664 - protein, 7 aa, Artificial Sequence
  Synthetic construct
YIILQQF

SEQ ID NO: 15665 - protein, 7 aa, Artificial Sequence
  Synthetic construct
YIILQQY

SEQ ID NO: 15666 - protein, 7 aa, Artificial Sequence
  Synthetic construct
YIILQDF

SEQ ID NO: 15667 - protein, 7 aa, Artificial Sequence
  Synthetic construct
YIILQDY

SEQ ID NO: 15668 - protein, 7 aa, Artificial Sequence
  Synthetic construct
YIILQVF

SEQ ID NO: 15669 - protein, 7 aa, Artificial Sequence
  Synthetic construct
YIILQVY

SEQ ID NO: 15670 - protein, 7 aa, Artificial Sequence
  Synthetic construct
YIIFIFF

SEQ ID NO: 15671 - protein, 7 aa, Artificial Sequence
  Synthetic construct
YIIFIFY

SEQ ID NO: 15672 - protein, 7 aa, Artificial Sequence
  Synthetic construct
YIIFIRF

SEQ ID NO: 15673 - protein, 7 aa, Artificial Sequence
  Synthetic construct
YIIFIRY

SEQ ID NO: 15674 - protein, 7 aa, Artificial Sequence
  Synthetic construct
YIIFICF

SEQ ID NO: 15675 - protein, 7 aa, Artificial Sequence
  Synthetic construct
YIIFICY

SEQ ID NO: 15676 - protein, 7 aa, Artificial Sequence
  Synthetic construct
YIIFILF

SEQ ID NO: 15677 - protein, 7 aa, Artificial Sequence
  Synthetic construct
YIIFILY

SEQ ID NO: 15678 - protein, 7 aa, Artificial Sequence
  Synthetic construct
YIIFIAF

SEQ ID NO: 15679 - protein, 7 aa, Artificial Sequence
  Synthetic construct
YIIFIAY

SEQ ID NO: 15680 - protein, 7 aa, Artificial Sequence
  Synthetic construct
YIIFIQF

SEQ ID NO: 15681 - protein, 7 aa, Artificial Sequence
  Synthetic construct
YIIFIQY

SEQ ID NO: 15682 - protein, 7 aa, Artificial Sequence
  Synthetic construct
YIIFIDF

SEQ ID NO: 15683 - protein, 7 aa, Artificial Sequence
  Synthetic construct
YIIFIDY

SEQ ID NO: 15684 - protein, 7 aa, Artificial Sequence
  Synthetic construct
YIIFIVF

SEQ ID NO: 15685 - protein, 7 aa, Artificial Sequence
  Synthetic construct
YIIFIVY

SEQ ID NO: 15686 - protein, 7 aa, Artificial Sequence
  Synthetic construct
YIIFDFF

SEQ ID NO: 15687 - protein, 7 aa, Artificial Sequence
  Synthetic construct
YIIFDFY

SEQ ID NO: 15688 - protein, 7 aa, Artificial Sequence
  Synthetic construct
YIIFDRF

SEQ ID NO: 15689 - protein, 7 aa, Artificial Sequence
  Synthetic construct
YIIFDRY

SEQ ID NO: 15690 - protein, 7 aa, Artificial Sequence
  Synthetic construct
YIIFDCF

SEQ ID NO: 15691 - protein, 7 aa, Artificial Sequence
  Synthetic construct
YIIFDCY

SEQ ID NO: 15692 - protein, 7 aa, Artificial Sequence
  Synthetic construct
YIIFDLF

SEQ ID NO: 15693 - protein, 7 aa, Artificial Sequence
  Synthetic construct
YIIFDLY

SEQ ID NO: 15694 - protein, 7 aa, Artificial Sequence
  Synthetic construct
YIIFDAF

SEQ ID NO: 15695 - protein, 7 aa, Artificial Sequence
  Synthetic construct
YIIFDAY

SEQ ID NO: 15696 - protein, 7 aa, Artificial Sequence
  Synthetic construct
YIIFDQF

SEQ ID NO: 15697 - protein, 7 aa, Artificial Sequence
  Synthetic construct
YIIFDQY

SEQ ID NO: 15698 - protein, 7 aa, Artificial Sequence
  Synthetic construct
YIIFDDF

SEQ ID NO: 15699 - protein, 7 aa, Artificial Sequence
  Synthetic construct
YIIFDDY

SEQ ID NO: 15700 - protein, 7 aa, Artificial Sequence
  Synthetic construct
YIIFDVF

SEQ ID NO: 15701 - protein, 7 aa, Artificial Sequence
  Synthetic construct
YIIFDVY

SEQ ID NO: 15702 - protein, 7 aa, Artificial Sequence
  Synthetic construct
YIIFYFF

SEQ ID NO: 15703 - protein, 7 aa, Artificial Sequence
  Synthetic construct
YIIFYFY

SEQ ID NO: 15704 - protein, 7 aa, Artificial Sequence
  Synthetic construct
YIIFYRF

SEQ ID NO: 15705 - protein, 7 aa, Artificial Sequence
  Synthetic construct
YIIFYRY

SEQ ID NO: 15706 - protein, 7 aa, Artificial Sequence
  Synthetic construct
YIIFYCF

SEQ ID NO: 15707 - protein, 7 aa, Artificial Sequence
  Synthetic construct
YIIFYCY

SEQ ID NO: 15708 - protein, 7 aa, Artificial Sequence
  Synthetic construct
YIIFYLF

SEQ ID NO: 15709 - protein, 7 aa, Artificial Sequence
  Synthetic construct
YIIFYLY

SEQ ID NO: 15710 - protein, 7 aa, Artificial Sequence
  Synthetic construct
YIIFYAF

SEQ ID NO: 15711 - protein, 7 aa, Artificial Sequence
  Synthetic construct
YIIFYAY

SEQ ID NO: 15712 - protein, 7 aa, Artificial Sequence
  Synthetic construct
YIIFYQF

SEQ ID NO: 15713 - protein, 7 aa, Artificial Sequence
  Synthetic construct
YIIFYQY

SEQ ID NO: 15714 - protein, 7 aa, Artificial Sequence
  Synthetic construct
YIIFYDF

SEQ ID NO: 15715 - protein, 7 aa, Artificial Sequence
  Synthetic construct
YIIFYDY

SEQ ID NO: 15716 - protein, 7 aa, Artificial Sequence
  Synthetic construct
YIIFYVF

SEQ ID NO: 15717 - protein, 7 aa, Artificial Sequence
  Synthetic construct
YIIFYVY

SEQ ID NO: 15718 - protein, 7 aa, Artificial Sequence
  Synthetic construct
YIIFFFF

SEQ ID NO: 15719 - protein, 7 aa, Artificial Sequence
  Synthetic construct
YIIFFFY

SEQ ID NO: 15720 - protein, 7 aa, Artificial Sequence
  Synthetic construct
YIIFFRF

SEQ ID NO: 15721 - protein, 7 aa, Artificial Sequence
  Synthetic construct
YIIFFRY

SEQ ID NO: 15722 - protein, 7 aa, Artificial Sequence
  Synthetic construct
YIIFFCF

SEQ ID NO: 15723 - protein, 7 aa, Artificial Sequence
  Synthetic construct
YIIFFCY

SEQ ID NO: 15724 - protein, 7 aa, Artificial Sequence
  Synthetic construct
YIIFFLF

SEQ ID NO: 15725 - protein, 7 aa, Artificial Sequence
  Synthetic construct
YIIFFLY

SEQ ID NO: 15726 - protein, 7 aa, Artificial Sequence
  Synthetic construct
YIIFFAF

SEQ ID NO: 15727 - protein, 7 aa, Artificial Sequence
  Synthetic construct
YIIFFAY

SEQ ID NO: 15728 - protein, 7 aa, Artificial Sequence
  Synthetic construct
YIIFFQF

SEQ ID NO: 15729 - protein, 7 aa, Artificial Sequence
  Synthetic construct
YIIFFQY

SEQ ID NO: 15730 - protein, 7 aa, Artificial Sequence
  Synthetic construct
YIIFFDF

SEQ ID NO: 15731 - protein, 7 aa, Artificial Sequence
  Synthetic construct
YIIFFDY

SEQ ID NO: 15732 - protein, 7 aa, Artificial Sequence
  Synthetic construct
YIIFFVF

SEQ ID NO: 15733 - protein, 7 aa, Artificial Sequence
  Synthetic construct
YIIFFVY

SEQ ID NO: 15734 - protein, 7 aa, Artificial Sequence
  Synthetic construct
YIIFVFF

SEQ ID NO: 15735 - protein, 7 aa, Artificial Sequence
  Synthetic construct
YIIFVFY

SEQ ID NO: 15736 - protein, 7 aa, Artificial Sequence
  Synthetic construct
YIIFVRF

SEQ ID NO: 15737 - protein, 7 aa, Artificial Sequence
  Synthetic construct
YIIFVRY

SEQ ID NO: 15738 - protein, 7 aa, Artificial Sequence
  Synthetic construct
YIIFVCF

SEQ ID NO: 15739 - protein, 7 aa, Artificial Sequence
  Synthetic construct
YIIFVCY

SEQ ID NO: 15740 - protein, 7 aa, Artificial Sequence
  Synthetic construct
YIIFVLF

SEQ ID NO: 15741 - protein, 7 aa, Artificial Sequence
  Synthetic construct
YIIFVLY

SEQ ID NO: 15742 - protein, 7 aa, Artificial Sequence
  Synthetic construct
YIIFVAF

SEQ ID NO: 15743 - protein, 7 aa, Artificial Sequence
  Synthetic construct
YIIFVAY

SEQ ID NO: 15744 - protein, 7 aa, Artificial Sequence
  Synthetic construct
YIIFVQF

SEQ ID NO: 15745 - protein, 7 aa, Artificial Sequence
  Synthetic construct
YIIFVQY

SEQ ID NO: 15746 - protein, 7 aa, Artificial Sequence
  Synthetic construct
YIIFVDF

SEQ ID NO: 15747 - protein, 7 aa, Artificial Sequence
  Synthetic construct
YIIFVDY

SEQ ID NO: 15748 - protein, 7 aa, Artificial Sequence
  Synthetic construct
YIIFVVF

SEQ ID NO: 15749 - protein, 7 aa, Artificial Sequence
  Synthetic construct
YIIFVVY

SEQ ID NO: 15750 - protein, 7 aa, Artificial Sequence
  Synthetic construct
YIIFTFF

SEQ ID NO: 15751 - protein, 7 aa, Artificial Sequence
  Synthetic construct
YIIFTFY

SEQ ID NO: 15752 - protein, 7 aa, Artificial Sequence
  Synthetic construct
YIIFTRF

SEQ ID NO: 15753 - protein, 7 aa, Artificial Sequence
  Synthetic construct
YIIFTRY

SEQ ID NO: 15754 - protein, 7 aa, Artificial Sequence
  Synthetic construct
YIIFTCF

SEQ ID NO: 15755 - protein, 7 aa, Artificial Sequence
  Synthetic construct
YIIFTCY

SEQ ID NO: 15756 - protein, 7 aa, Artificial Sequence
  Synthetic construct
YIIFTLF

SEQ ID NO: 15757 - protein, 7 aa, Artificial Sequence
  Synthetic construct
YIIFTLY

SEQ ID NO: 15758 - protein, 7 aa, Artificial Sequence
  Synthetic construct
YIIFTAF

SEQ ID NO: 15759 - protein, 7 aa, Artificial Sequence
  Synthetic construct
YIIFTAY

SEQ ID NO: 15760 - protein, 7 aa, Artificial Sequence
  Synthetic construct
YIIFTQF

SEQ ID NO: 15761 - protein, 7 aa, Artificial Sequence
  Synthetic construct
YIIFTQY

SEQ ID NO: 15762 - protein, 7 aa, Artificial Sequence
  Synthetic construct
YIIFTDF

SEQ ID NO: 15763 - protein, 7 aa, Artificial Sequence
  Synthetic construct
YIIFTDY

SEQ ID NO: 15764 - protein, 7 aa, Artificial Sequence
  Synthetic construct
YIIFTVF

SEQ ID NO: 15765 - protein, 7 aa, Artificial Sequence
  Synthetic construct
YIIFTVY

SEQ ID NO: 15766 - protein, 7 aa, Artificial Sequence
  Synthetic construct
YIIFGFF

SEQ ID NO: 15767 - protein, 7 aa, Artificial Sequence
  Synthetic construct
YIIFGFY

SEQ ID NO: 15768 - protein, 7 aa, Artificial Sequence
  Synthetic construct
YIIFGRF

SEQ ID NO: 15769 - protein, 7 aa, Artificial Sequence
  Synthetic construct
YIIFGRY

SEQ ID NO: 15770 - protein, 7 aa, Artificial Sequence
  Synthetic construct
YIIFGCF

SEQ ID NO: 15771 - protein, 7 aa, Artificial Sequence
  Synthetic construct
YIIFGCY

SEQ ID NO: 15772 - protein, 7 aa, Artificial Sequence
  Synthetic construct
YIIFGLF

SEQ ID NO: 15773 - protein, 7 aa, Artificial Sequence
  Synthetic construct
YIIFGLY

SEQ ID NO: 15774 - protein, 7 aa, Artificial Sequence
  Synthetic construct
YIIFGAF

SEQ ID NO: 15775 - protein, 7 aa, Artificial Sequence
  Synthetic construct
YIIFGAY

SEQ ID NO: 15776 - protein, 7 aa, Artificial Sequence
  Synthetic construct
YIIFGQF

SEQ ID NO: 15777 - protein, 7 aa, Artificial Sequence
  Synthetic construct
YIIFGQY

SEQ ID NO: 15778 - protein, 7 aa, Artificial Sequence
  Synthetic construct
YIIFGDF

SEQ ID NO: 15779 - protein, 7 aa, Artificial Sequence
  Synthetic construct
YIIFGDY

SEQ ID NO: 15780 - protein, 7 aa, Artificial Sequence
  Synthetic construct
YIIFGVF

SEQ ID NO: 15781 - protein, 7 aa, Artificial Sequence
  Synthetic construct
YIIFGVY

SEQ ID NO: 15782 - protein, 7 aa, Artificial Sequence
  Synthetic construct
YIIFAFF

SEQ ID NO: 15783 - protein, 7 aa, Artificial Sequence
  Synthetic construct
YIIFAFY

SEQ ID NO: 15784 - protein, 7 aa, Artificial Sequence
  Synthetic construct
YIIFARF

SEQ ID NO: 15785 - protein, 7 aa, Artificial Sequence
  Synthetic construct
YIIFARY

SEQ ID NO: 15786 - protein, 7 aa, Artificial Sequence
  Synthetic construct
YIIFACF

SEQ ID NO: 15787 - protein, 7 aa, Artificial Sequence
  Synthetic construct
YIIFACY

SEQ ID NO: 15788 - protein, 7 aa, Artificial Sequence
  Synthetic construct
YIIFALF

SEQ ID NO: 15789 - protein, 7 aa, Artificial Sequence
  Synthetic construct
YIIFALY

SEQ ID NO: 15790 - protein, 7 aa, Artificial Sequence
  Synthetic construct
YIIFAAF

SEQ ID NO: 15791 - protein, 7 aa, Artificial Sequence
  Synthetic construct
YIIFAAY

SEQ ID NO: 15792 - protein, 7 aa, Artificial Sequence
  Synthetic construct
YIIFAQF

SEQ ID NO: 15793 - protein, 7 aa, Artificial Sequence
  Synthetic construct
YIIFAQY

SEQ ID NO: 15794 - protein, 7 aa, Artificial Sequence
  Synthetic construct
YIIFADF

SEQ ID NO: 15795 - protein, 7 aa, Artificial Sequence
  Synthetic construct
YIIFADY

SEQ ID NO: 15796 - protein, 7 aa, Artificial Sequence
  Synthetic construct
YIIFAVF

SEQ ID NO: 15797 - protein, 7 aa, Artificial Sequence
  Synthetic construct
YIIFAVY

SEQ ID NO: 15798 - protein, 7 aa, Artificial Sequence
  Synthetic construct
YIIFQFF

SEQ ID NO: 15799 - protein, 7 aa, Artificial Sequence
  Synthetic construct
YIIFQFY

SEQ ID NO: 15800 - protein, 7 aa, Artificial Sequence
  Synthetic construct
YIIFQRF

SEQ ID NO: 15801 - protein, 7 aa, Artificial Sequence
  Synthetic construct
YIIFQRY

SEQ ID NO: 15802 - protein, 7 aa, Artificial Sequence
  Synthetic construct
YIIFQCF

SEQ ID NO: 15803 - protein, 7 aa, Artificial Sequence
  Synthetic construct
YIIFQCY

SEQ ID NO: 15804 - protein, 7 aa, Artificial Sequence
  Synthetic construct
YIIFQLF

SEQ ID NO: 15805 - protein, 7 aa, Artificial Sequence
  Synthetic construct
YIIFQLY

SEQ ID NO: 15806 - protein, 7 aa, Artificial Sequence
  Synthetic construct
YIIFQAF

SEQ ID NO: 15807 - protein, 7 aa, Artificial Sequence
  Synthetic construct
YIIFQAY

SEQ ID NO: 15808 - protein, 7 aa, Artificial Sequence
  Synthetic construct
YIIFQQF

SEQ ID NO: 15809 - protein, 7 aa, Artificial Sequence
  Synthetic construct
YIIFQQY

SEQ ID NO: 15810 - protein, 7 aa, Artificial Sequence
  Synthetic construct
YIIFQDF

SEQ ID NO: 15811 - protein, 7 aa, Artificial Sequence
  Synthetic construct
YIIFQDY

SEQ ID NO: 15812 - protein, 7 aa, Artificial Sequence
  Synthetic construct
YIIFQVF

SEQ ID NO: 15813 - protein, 7 aa, Artificial Sequence
  Synthetic construct
YIIFQVY

SEQ ID NO: 15814 - protein, 7 aa, Artificial Sequence
  Synthetic construct
YIGYIFF

SEQ ID NO: 15815 - protein, 7 aa, Artificial Sequence
  Synthetic construct
YIGYIFY

SEQ ID NO: 15816 - protein, 7 aa, Artificial Sequence
  Synthetic construct
YIGYIRF

SEQ ID NO: 15817 - protein, 7 aa, Artificial Sequence
  Synthetic construct
YIGYIRY

SEQ ID NO: 15818 - protein, 7 aa, Artificial Sequence
  Synthetic construct
YIGYICF

SEQ ID NO: 15819 - protein, 7 aa, Artificial Sequence
  Synthetic construct
YIGYICY

SEQ ID NO: 15820 - protein, 7 aa, Artificial Sequence
  Synthetic construct
YIGYILF

SEQ ID NO: 15821 - protein, 7 aa, Artificial Sequence
  Synthetic construct
YIGYILY

SEQ ID NO: 15822 - protein, 7 aa, Artificial Sequence
  Synthetic construct
YIGYIAF

SEQ ID NO: 15823 - protein, 7 aa, Artificial Sequence
  Synthetic construct
YIGYIAY

SEQ ID NO: 15824 - protein, 7 aa, Artificial Sequence
  Synthetic construct
YIGYIQF

SEQ ID NO: 15825 - protein, 7 aa, Artificial Sequence
  Synthetic construct
YIGYIQY

SEQ ID NO: 15826 - protein, 7 aa, Artificial Sequence
  Synthetic construct
YIGYIDF

SEQ ID NO: 15827 - protein, 7 aa, Artificial Sequence
  Synthetic construct
YIGYIDY

SEQ ID NO: 15828 - protein, 7 aa, Artificial Sequence
  Synthetic construct
YIGYIVF

SEQ ID NO: 15829 - protein, 7 aa, Artificial Sequence
  Synthetic construct
YIGYIVY

SEQ ID NO: 15830 - protein, 7 aa, Artificial Sequence
  Synthetic construct
YIGYDFF

SEQ ID NO: 15831 - protein, 7 aa, Artificial Sequence
  Synthetic construct
YIGYDFY

SEQ ID NO: 15832 - protein, 7 aa, Artificial Sequence
  Synthetic construct
YIGYDRF

SEQ ID NO: 15833 - protein, 7 aa, Artificial Sequence
  Synthetic construct
YIGYDRY

SEQ ID NO: 15834 - protein, 7 aa, Artificial Sequence
  Synthetic construct
YIGYDCF

SEQ ID NO: 15835 - protein, 7 aa, Artificial Sequence
  Synthetic construct
YIGYDCY

SEQ ID NO: 15836 - protein, 7 aa, Artificial Sequence
  Synthetic construct
YIGYDLF

SEQ ID NO: 15837 - protein, 7 aa, Artificial Sequence
  Synthetic construct
YIGYDLY

SEQ ID NO: 15838 - protein, 7 aa, Artificial Sequence
  Synthetic construct
YIGYDAF

SEQ ID NO: 15839 - protein, 7 aa, Artificial Sequence
  Synthetic construct
YIGYDAY

SEQ ID NO: 15840 - protein, 7 aa, Artificial Sequence
  Synthetic construct
YIGYDQF

SEQ ID NO: 15841 - protein, 7 aa, Artificial Sequence
  Synthetic construct
YIGYDQY

SEQ ID NO: 15842 - protein, 7 aa, Artificial Sequence
  Synthetic construct
YIGYDDF

SEQ ID NO: 15843 - protein, 7 aa, Artificial Sequence
  Synthetic construct
YIGYDDY

SEQ ID NO: 15844 - protein, 7 aa, Artificial Sequence
  Synthetic construct
YIGYDVF

SEQ ID NO: 15845 - protein, 7 aa, Artificial Sequence
  Synthetic construct
YIGYDVY

SEQ ID NO: 15846 - protein, 7 aa, Artificial Sequence
  Synthetic construct
YIGYYFF

SEQ ID NO: 15847 - protein, 7 aa, Artificial Sequence
  Synthetic construct
YIGYYFY

SEQ ID NO: 15848 - protein, 7 aa, Artificial Sequence
  Synthetic construct
YIGYYRF

SEQ ID NO: 15849 - protein, 7 aa, Artificial Sequence
  Synthetic construct
YIGYYRY

SEQ ID NO: 15850 - protein, 7 aa, Artificial Sequence
  Synthetic construct
YIGYYCF

SEQ ID NO: 15851 - protein, 7 aa, Artificial Sequence
  Synthetic construct
YIGYYCY

SEQ ID NO: 15852 - protein, 7 aa, Artificial Sequence
  Synthetic construct
YIGYYLF

SEQ ID NO: 15853 - protein, 7 aa, Artificial Sequence
  Synthetic construct
YIGYYLY

SEQ ID NO: 15854 - protein, 7 aa, Artificial Sequence
  Synthetic construct
YIGYYAF

SEQ ID NO: 15855 - protein, 7 aa, Artificial Sequence
  Synthetic construct
YIGYYAY

SEQ ID NO: 15856 - protein, 7 aa, Artificial Sequence
  Synthetic construct
YIGYYQF

SEQ ID NO: 15857 - protein, 7 aa, Artificial Sequence
  Synthetic construct
YIGYYQY

SEQ ID NO: 15858 - protein, 7 aa, Artificial Sequence
  Synthetic construct
YIGYYDF

SEQ ID NO: 15859 - protein, 7 aa, Artificial Sequence
  Synthetic construct
YIGYYDY

SEQ ID NO: 15860 - protein, 7 aa, Artificial Sequence
  Synthetic construct
YIGYYVF

SEQ ID NO: 15861 - protein, 7 aa, Artificial Sequence
  Synthetic construct
YIGYYVY

SEQ ID NO: 15862 - protein, 7 aa, Artificial Sequence
  Synthetic construct
YIGYFFF

SEQ ID NO: 15863 - protein, 7 aa, Artificial Sequence
  Synthetic construct
YIGYFFY

SEQ ID NO: 15864 - protein, 7 aa, Artificial Sequence
  Synthetic construct
YIGYFRF

SEQ ID NO: 15865 - protein, 7 aa, Artificial Sequence
  Synthetic construct
YIGYFRY

SEQ ID NO: 15866 - protein, 7 aa, Artificial Sequence
  Synthetic construct
YIGYFCF

SEQ ID NO: 15867 - protein, 7 aa, Artificial Sequence
  Synthetic construct
YIGYFCY

SEQ ID NO: 15868 - protein, 7 aa, Artificial Sequence
  Synthetic construct
YIGYFLF

SEQ ID NO: 15869 - protein, 7 aa, Artificial Sequence
  Synthetic construct
YIGYFLY

SEQ ID NO: 15870 - protein, 7 aa, Artificial Sequence
  Synthetic construct
YIGYFAF

SEQ ID NO: 15871 - protein, 7 aa, Artificial Sequence
  Synthetic construct
YIGYFAY

SEQ ID NO: 15872 - protein, 7 aa, Artificial Sequence
  Synthetic construct
YIGYFQF

SEQ ID NO: 15873 - protein, 7 aa, Artificial Sequence
  Synthetic construct
YIGYFQY

SEQ ID NO: 15874 - protein, 7 aa, Artificial Sequence
  Synthetic construct
YIGYFDF

SEQ ID NO: 15875 - protein, 7 aa, Artificial Sequence
  Synthetic construct
YIGYFDY

SEQ ID NO: 15876 - protein, 7 aa, Artificial Sequence
  Synthetic construct
YIGYFVF

SEQ ID NO: 15877 - protein, 7 aa, Artificial Sequence
  Synthetic construct
YIGYFVY

SEQ ID NO: 15878 - protein, 7 aa, Artificial Sequence
  Synthetic construct
YIGYVFF

SEQ ID NO: 15879 - protein, 7 aa, Artificial Sequence
  Synthetic construct
YIGYVFY

SEQ ID NO: 15880 - protein, 7 aa, Artificial Sequence
  Synthetic construct
YIGYVRF

SEQ ID NO: 15881 - protein, 7 aa, Artificial Sequence
  Synthetic construct
YIGYVRY

SEQ ID NO: 15882 - protein, 7 aa, Artificial Sequence
  Synthetic construct
YIGYVCF

SEQ ID NO: 15883 - protein, 7 aa, Artificial Sequence
  Synthetic construct
YIGYVCY

SEQ ID NO: 15884 - protein, 7 aa, Artificial Sequence
  Synthetic construct
YIGYVLF

SEQ ID NO: 15885 - protein, 7 aa, Artificial Sequence
  Synthetic construct
YIGYVLY

SEQ ID NO: 15886 - protein, 7 aa, Artificial Sequence
  Synthetic construct
YIGYVAF

SEQ ID NO: 15887 - protein, 7 aa, Artificial Sequence
  Synthetic construct
YIGYVAY

SEQ ID NO: 15888 - protein, 7 aa, Artificial Sequence
  Synthetic construct
YIGYVQF

SEQ ID NO: 15889 - protein, 7 aa, Artificial Sequence
  Synthetic construct
YIGYVQY

SEQ ID NO: 15890 - protein, 7 aa, Artificial Sequence
  Synthetic construct
YIGYVDF

SEQ ID NO: 15891 - protein, 7 aa, Artificial Sequence
  Synthetic construct
YIGYVDY

SEQ ID NO: 15892 - protein, 7 aa, Artificial Sequence
  Synthetic construct
YIGYVVF

SEQ ID NO: 15893 - protein, 7 aa, Artificial Sequence
  Synthetic construct
YIGYVVY

SEQ ID NO: 15894 - protein, 7 aa, Artificial Sequence
  Synthetic construct
YIGYTFF

SEQ ID NO: 15895 - protein, 7 aa, Artificial Sequence
  Synthetic construct
YIGYTFY

SEQ ID NO: 15896 - protein, 7 aa, Artificial Sequence
  Synthetic construct
YIGYTRF

SEQ ID NO: 15897 - protein, 7 aa, Artificial Sequence
  Synthetic construct
YIGYTRY

SEQ ID NO: 15898 - protein, 7 aa, Artificial Sequence
  Synthetic construct
YIGYTCF

SEQ ID NO: 15899 - protein, 7 aa, Artificial Sequence
  Synthetic construct
YIGYTCY

SEQ ID NO: 15900 - protein, 7 aa, Artificial Sequence
  Synthetic construct
YIGYTLF

SEQ ID NO: 15901 - protein, 7 aa, Artificial Sequence
  Synthetic construct
YIGYTLY

SEQ ID NO: 15902 - protein, 7 aa, Artificial Sequence
  Synthetic construct
YIGYTAF

SEQ ID NO: 15903 - protein, 7 aa, Artificial Sequence
  Synthetic construct
YIGYTAY

SEQ ID NO: 15904 - protein, 7 aa, Artificial Sequence
  Synthetic construct
YIGYTQF

SEQ ID NO: 15905 - protein, 7 aa, Artificial Sequence
  Synthetic construct
YIGYTQY

SEQ ID NO: 15906 - protein, 7 aa, Artificial Sequence
  Synthetic construct
YIGYTDF

SEQ ID NO: 15907 - protein, 7 aa, Artificial Sequence
  Synthetic construct
YIGYTDY

SEQ ID NO: 15908 - protein, 7 aa, Artificial Sequence
  Synthetic construct
YIGYTVF

SEQ ID NO: 15909 - protein, 7 aa, Artificial Sequence
  Synthetic construct
YIGYTVY

SEQ ID NO: 15910 - protein, 7 aa, Artificial Sequence
  Synthetic construct
YIGYGFF

SEQ ID NO: 15911 - protein, 7 aa, Artificial Sequence
  Synthetic construct
YIGYGFY

SEQ ID NO: 15912 - protein, 7 aa, Artificial Sequence
  Synthetic construct
YIGYGRF

SEQ ID NO: 15913 - protein, 7 aa, Artificial Sequence
  Synthetic construct
YIGYGRY

SEQ ID NO: 15914 - protein, 7 aa, Artificial Sequence
  Synthetic construct
YIGYGCF

SEQ ID NO: 15915 - protein, 7 aa, Artificial Sequence
  Synthetic construct
YIGYGCY

SEQ ID NO: 15916 - protein, 7 aa, Artificial Sequence
  Synthetic construct
YIGYGLF

SEQ ID NO: 15917 - protein, 7 aa, Artificial Sequence
  Synthetic construct
YIGYGLY

SEQ ID NO: 15918 - protein, 7 aa, Artificial Sequence
  Synthetic construct
YIGYGAF

SEQ ID NO: 15919 - protein, 7 aa, Artificial Sequence
  Synthetic construct
YIGYGAY

SEQ ID NO: 15920 - protein, 7 aa, Artificial Sequence
  Synthetic construct
YIGYGQF

SEQ ID NO: 15921 - protein, 7 aa, Artificial Sequence
  Synthetic construct
YIGYGQY

SEQ ID NO: 15922 - protein, 7 aa, Artificial Sequence
  Synthetic construct
YIGYGDF

SEQ ID NO: 15923 - protein, 7 aa, Artificial Sequence
  Synthetic construct
YIGYGDY

SEQ ID NO: 15924 - protein, 7 aa, Artificial Sequence
  Synthetic construct
YIGYGVF

SEQ ID NO: 15925 - protein, 7 aa, Artificial Sequence
  Synthetic construct
YIGYGVY

SEQ ID NO: 15926 - protein, 7 aa, Artificial Sequence
  Synthetic construct
YIGYAFF

SEQ ID NO: 15927 - protein, 7 aa, Artificial Sequence
  Synthetic construct
YIGYAFY

SEQ ID NO: 15928 - protein, 7 aa, Artificial Sequence
  Synthetic construct
YIGYARF

SEQ ID NO: 15929 - protein, 7 aa, Artificial Sequence
  Synthetic construct
YIGYARY

SEQ ID NO: 15930 - protein, 7 aa, Artificial Sequence
  Synthetic construct
YIGYACF

SEQ ID NO: 15931 - protein, 7 aa, Artificial Sequence
  Synthetic construct
YIGYACY

SEQ ID NO: 15932 - protein, 7 aa, Artificial Sequence
  Synthetic construct
YIGYALF

SEQ ID NO: 15933 - protein, 7 aa, Artificial Sequence
  Synthetic construct
YIGYALY

SEQ ID NO: 15934 - protein, 7 aa, Artificial Sequence
  Synthetic construct
YIGYAAF

SEQ ID NO: 15935 - protein, 7 aa, Artificial Sequence
  Synthetic construct
YIGYAAY

SEQ ID NO: 15936 - protein, 7 aa, Artificial Sequence
  Synthetic construct
YIGYAQF

SEQ ID NO: 15937 - protein, 7 aa, Artificial Sequence
  Synthetic construct
YIGYAQY

SEQ ID NO: 15938 - protein, 7 aa, Artificial Sequence
  Synthetic construct
YIGYADF

SEQ ID NO: 15939 - protein, 7 aa, Artificial Sequence
  Synthetic construct
YIGYADY

SEQ ID NO: 15940 - protein, 7 aa, Artificial Sequence
  Synthetic construct
YIGYAVF

SEQ ID NO: 15941 - protein, 7 aa, Artificial Sequence
  Synthetic construct
YIGYAVY

SEQ ID NO: 15942 - protein, 7 aa, Artificial Sequence
  Synthetic construct
YIGYQFF

SEQ ID NO: 15943 - protein, 7 aa, Artificial Sequence
  Synthetic construct
YIGYQFY

SEQ ID NO: 15944 - protein, 7 aa, Artificial Sequence
  Synthetic construct
YIGYQRF

SEQ ID NO: 15945 - protein, 7 aa, Artificial Sequence
  Synthetic construct
YIGYQRY

SEQ ID NO: 15946 - protein, 7 aa, Artificial Sequence
  Synthetic construct
YIGYQCF

SEQ ID NO: 15947 - protein, 7 aa, Artificial Sequence
  Synthetic construct
YIGYQCY

SEQ ID NO: 15948 - protein, 7 aa, Artificial Sequence
  Synthetic construct
YIGYQLF

SEQ ID NO: 15949 - protein, 7 aa, Artificial Sequence
  Synthetic construct
YIGYQLY

SEQ ID NO: 15950 - protein, 7 aa, Artificial Sequence
  Synthetic construct
YIGYQAF

SEQ ID NO: 15951 - protein, 7 aa, Artificial Sequence
  Synthetic construct
YIGYQAY

SEQ ID NO: 15952 - protein, 7 aa, Artificial Sequence
  Synthetic construct
YIGYQQF

SEQ ID NO: 15953 - protein, 7 aa, Artificial Sequence
  Synthetic construct
YIGYQQY

SEQ ID NO: 15954 - protein, 7 aa, Artificial Sequence
  Synthetic construct
YIGYQDF

SEQ ID NO: 15955 - protein, 7 aa, Artificial Sequence
  Synthetic construct
YIGYQDY

SEQ ID NO: 15956 - protein, 7 aa, Artificial Sequence
  Synthetic construct
YIGYQVF

SEQ ID NO: 15957 - protein, 7 aa, Artificial Sequence
  Synthetic construct
YIGYQVY

SEQ ID NO: 15958 - protein, 7 aa, Artificial Sequence
  Synthetic construct
YIGPIFF

SEQ ID NO: 15959 - protein, 7 aa, Artificial Sequence
  Synthetic construct
YIGPIFY

SEQ ID NO: 15960 - protein, 7 aa, Artificial Sequence
  Synthetic construct
YIGPIRF

SEQ ID NO: 15961 - protein, 7 aa, Artificial Sequence
  Synthetic construct
YIGPIRY

SEQ ID NO: 15962 - protein, 7 aa, Artificial Sequence
  Synthetic construct
YIGPICF

SEQ ID NO: 15963 - protein, 7 aa, Artificial Sequence
  Synthetic construct
YIGPICY

SEQ ID NO: 15964 - protein, 7 aa, Artificial Sequence
  Synthetic construct
YIGPILF

SEQ ID NO: 15965 - protein, 7 aa, Artificial Sequence
  Synthetic construct
YIGPILY

SEQ ID NO: 15966 - protein, 7 aa, Artificial Sequence
  Synthetic construct
YIGPIAF

SEQ ID NO: 15967 - protein, 7 aa, Artificial Sequence
  Synthetic construct
YIGPIAY

SEQ ID NO: 15968 - protein, 7 aa, Artificial Sequence
  Synthetic construct
YIGPIQF

SEQ ID NO: 15969 - protein, 7 aa, Artificial Sequence
  Synthetic construct
YIGPIQY

SEQ ID NO: 15970 - protein, 7 aa, Artificial Sequence
  Synthetic construct
YIGPIDF

SEQ ID NO: 15971 - protein, 7 aa, Artificial Sequence
  Synthetic construct
YIGPIDY

SEQ ID NO: 15972 - protein, 7 aa, Artificial Sequence
  Synthetic construct
YIGPIVF

SEQ ID NO: 15973 - protein, 7 aa, Artificial Sequence
  Synthetic construct
YIGPIVY

SEQ ID NO: 15974 - protein, 7 aa, Artificial Sequence
  Synthetic construct
YIGPDFF

SEQ ID NO: 15975 - protein, 7 aa, Artificial Sequence
  Synthetic construct
YIGPDFY

SEQ ID NO: 15976 - protein, 7 aa, Artificial Sequence
  Synthetic construct
YIGPDRF

SEQ ID NO: 15977 - protein, 7 aa, Artificial Sequence
  Synthetic construct
YIGPDRY

SEQ ID NO: 15978 - protein, 7 aa, Artificial Sequence
  Synthetic construct
YIGPDCF

SEQ ID NO: 15979 - protein, 7 aa, Artificial Sequence
  Synthetic construct
YIGPDCY

SEQ ID NO: 15980 - protein, 7 aa, Artificial Sequence
  Synthetic construct
YIGPDLF

SEQ ID NO: 15981 - protein, 7 aa, Artificial Sequence
  Synthetic construct
YIGPDLY

SEQ ID NO: 15982 - protein, 7 aa, Artificial Sequence
  Synthetic construct
YIGPDAF

SEQ ID NO: 15983 - protein, 7 aa, Artificial Sequence
  Synthetic construct
YIGPDAY

SEQ ID NO: 15984 - protein, 7 aa, Artificial Sequence
  Synthetic construct
YIGPDQF

SEQ ID NO: 15985 - protein, 7 aa, Artificial Sequence
  Synthetic construct
YIGPDQY

SEQ ID NO: 15986 - protein, 7 aa, Artificial Sequence
  Synthetic construct
YIGPDDF

SEQ ID NO: 15987 - protein, 7 aa, Artificial Sequence
  Synthetic construct
YIGPDDY

SEQ ID NO: 15988 - protein, 7 aa, Artificial Sequence
  Synthetic construct
YIGPDVF

SEQ ID NO: 15989 - protein, 7 aa, Artificial Sequence
  Synthetic construct
YIGPDVY

SEQ ID NO: 15990 - protein, 7 aa, Artificial Sequence
  Synthetic construct
YIGPYFF

SEQ ID NO: 15991 - protein, 7 aa, Artificial Sequence
  Synthetic construct
YIGPYFY

SEQ ID NO: 15992 - protein, 7 aa, Artificial Sequence
  Synthetic construct
YIGPYRF

SEQ ID NO: 15993 - protein, 7 aa, Artificial Sequence
  Synthetic construct
YIGPYRY

SEQ ID NO: 15994 - protein, 7 aa, Artificial Sequence
  Synthetic construct
YIGPYCF

SEQ ID NO: 15995 - protein, 7 aa, Artificial Sequence
  Synthetic construct
YIGPYCY

SEQ ID NO: 15996 - protein, 7 aa, Artificial Sequence
  Synthetic construct
YIGPYLF

SEQ ID NO: 15997 - protein, 7 aa, Artificial Sequence
  Synthetic construct
YIGPYLY

SEQ ID NO: 15998 - protein, 7 aa, Artificial Sequence
  Synthetic construct
YIGPYAF

SEQ ID NO: 15999 - protein, 7 aa, Artificial Sequence
  Synthetic construct
YIGPYAY

SEQ ID NO: 16000 - protein, 7 aa, Artificial Sequence
  Synthetic construct
YIGPYQF

SEQ ID NO: 16001 - protein, 7 aa, Artificial Sequence
  Synthetic construct
YIGPYQY

SEQ ID NO: 16002 - protein, 7 aa, Artificial Sequence
  Synthetic construct
YIGPYDF

SEQ ID NO: 16003 - protein, 7 aa, Artificial Sequence
  Synthetic construct
YIGPYDY

SEQ ID NO: 16004 - protein, 7 aa, Artificial Sequence
  Synthetic construct
YIGPYVF

SEQ ID NO: 16005 - protein, 7 aa, Artificial Sequence
  Synthetic construct
YIGPYVY

SEQ ID NO: 16006 - protein, 7 aa, Artificial Sequence
  Synthetic construct
YIGPFFF

SEQ ID NO: 16007 - protein, 7 aa, Artificial Sequence
  Synthetic construct
YIGPFFY

SEQ ID NO: 16008 - protein, 7 aa, Artificial Sequence
  Synthetic construct
YIGPFRF

SEQ ID NO: 16009 - protein, 7 aa, Artificial Sequence
  Synthetic construct
YIGPFRY

SEQ ID NO: 16010 - protein, 7 aa, Artificial Sequence
  Synthetic construct
YIGPFCF

SEQ ID NO: 16011 - protein, 7 aa, Artificial Sequence
  Synthetic construct
YIGPFCY

SEQ ID NO: 16012 - protein, 7 aa, Artificial Sequence
  Synthetic construct
YIGPFLF

SEQ ID NO: 16013 - protein, 7 aa, Artificial Sequence
  Synthetic construct
YIGPFLY

SEQ ID NO: 16014 - protein, 7 aa, Artificial Sequence
  Synthetic construct
YIGPFAF

SEQ ID NO: 16015 - protein, 7 aa, Artificial Sequence
  Synthetic construct
YIGPFAY

SEQ ID NO: 16016 - protein, 7 aa, Artificial Sequence
  Synthetic construct
YIGPFQF

SEQ ID NO: 16017 - protein, 7 aa, Artificial Sequence
  Synthetic construct
YIGPFQY

SEQ ID NO: 16018 - protein, 7 aa, Artificial Sequence
  Synthetic construct
YIGPFDF

SEQ ID NO: 16019 - protein, 7 aa, Artificial Sequence
  Synthetic construct
YIGPFDY

SEQ ID NO: 16020 - protein, 7 aa, Artificial Sequence
  Synthetic construct
YIGPFVF

SEQ ID NO: 16021 - protein, 7 aa, Artificial Sequence
  Synthetic construct
YIGPFVY

SEQ ID NO: 16022 - protein, 7 aa, Artificial Sequence
  Synthetic construct
YIGPVFF

SEQ ID NO: 16023 - protein, 7 aa, Artificial Sequence
  Synthetic construct
YIGPVFY

SEQ ID NO: 16024 - protein, 7 aa, Artificial Sequence
  Synthetic construct
YIGPVRF

SEQ ID NO: 16025 - protein, 7 aa, Artificial Sequence
  Synthetic construct
YIGPVRY

SEQ ID NO: 16026 - protein, 7 aa, Artificial Sequence
  Synthetic construct
YIGPVCF

SEQ ID NO: 16027 - protein, 7 aa, Artificial Sequence
  Synthetic construct
YIGPVCY

SEQ ID NO: 16028 - protein, 7 aa, Artificial Sequence
  Synthetic construct
YIGPVLF

SEQ ID NO: 16029 - protein, 7 aa, Artificial Sequence
  Synthetic construct
YIGPVLY

SEQ ID NO: 16030 - protein, 7 aa, Artificial Sequence
  Synthetic construct
YIGPVAF

SEQ ID NO: 16031 - protein, 7 aa, Artificial Sequence
  Synthetic construct
YIGPVAY

SEQ ID NO: 16032 - protein, 7 aa, Artificial Sequence
  Synthetic construct
YIGPVQF

SEQ ID NO: 16033 - protein, 7 aa, Artificial Sequence
  Synthetic construct
YIGPVQY

SEQ ID NO: 16034 - protein, 7 aa, Artificial Sequence
  Synthetic construct
YIGPVDF

SEQ ID NO: 16035 - protein, 7 aa, Artificial Sequence
  Synthetic construct
YIGPVDY

SEQ ID NO: 16036 - protein, 7 aa, Artificial Sequence
  Synthetic construct
YIGPVVF

SEQ ID NO: 16037 - protein, 7 aa, Artificial Sequence
  Synthetic construct
YIGPVVY

SEQ ID NO: 16038 - protein, 7 aa, Artificial Sequence
  Synthetic construct
YIGPTFF

SEQ ID NO: 16039 - protein, 7 aa, Artificial Sequence
  Synthetic construct
YIGPTFY

SEQ ID NO: 16040 - protein, 7 aa, Artificial Sequence
  Synthetic construct
YIGPTRF

SEQ ID NO: 16041 - protein, 7 aa, Artificial Sequence
  Synthetic construct
YIGPTRY

SEQ ID NO: 16042 - protein, 7 aa, Artificial Sequence
  Synthetic construct
YIGPTCF

SEQ ID NO: 16043 - protein, 7 aa, Artificial Sequence
  Synthetic construct
YIGPTCY

SEQ ID NO: 16044 - protein, 7 aa, Artificial Sequence
  Synthetic construct
YIGPTLF

SEQ ID NO: 16045 - protein, 7 aa, Artificial Sequence
  Synthetic construct
YIGPTLY

SEQ ID NO: 16046 - protein, 7 aa, Artificial Sequence
  Synthetic construct
YIGPTAF

SEQ ID NO: 16047 - protein, 7 aa, Artificial Sequence
  Synthetic construct
YIGPTAY

SEQ ID NO: 16048 - protein, 7 aa, Artificial Sequence
  Synthetic construct
YIGPTQF

SEQ ID NO: 16049 - protein, 7 aa, Artificial Sequence
  Synthetic construct
YIGPTQY

SEQ ID NO: 16050 - protein, 7 aa, Artificial Sequence
  Synthetic construct
YIGPTDF

SEQ ID NO: 16051 - protein, 7 aa, Artificial Sequence
  Synthetic construct
YIGPTDY

SEQ ID NO: 16052 - protein, 7 aa, Artificial Sequence
  Synthetic construct
YIGPTVF

SEQ ID NO: 16053 - protein, 7 aa, Artificial Sequence
  Synthetic construct
YIGPTVY

SEQ ID NO: 16054 - protein, 7 aa, Artificial Sequence
  Synthetic construct
YIGPGFF

SEQ ID NO: 16055 - protein, 7 aa, Artificial Sequence
  Synthetic construct
YIGPGFY

SEQ ID NO: 16056 - protein, 7 aa, Artificial Sequence
  Synthetic construct
YIGPGRF

SEQ ID NO: 16057 - protein, 7 aa, Artificial Sequence
  Synthetic construct
YIGPGRY

SEQ ID NO: 16058 - protein, 7 aa, Artificial Sequence
  Synthetic construct
YIGPGCF

SEQ ID NO: 16059 - protein, 7 aa, Artificial Sequence
  Synthetic construct
YIGPGCY

SEQ ID NO: 16060 - protein, 7 aa, Artificial Sequence
  Synthetic construct
YIGPGLF

SEQ ID NO: 16061 - protein, 7 aa, Artificial Sequence
  Synthetic construct
YIGPGLY

SEQ ID NO: 16062 - protein, 7 aa, Artificial Sequence
  Synthetic construct
YIGPGAF

SEQ ID NO: 16063 - protein, 7 aa, Artificial Sequence
  Synthetic construct
YIGPGAY

SEQ ID NO: 16064 - protein, 7 aa, Artificial Sequence
  Synthetic construct
YIGPGQF

SEQ ID NO: 16065 - protein, 7 aa, Artificial Sequence
  Synthetic construct
YIGPGQY

SEQ ID NO: 16066 - protein, 7 aa, Artificial Sequence
  Synthetic construct
YIGPGDF

SEQ ID NO: 16067 - protein, 7 aa, Artificial Sequence
  Synthetic construct
YIGPGDY

SEQ ID NO: 16068 - protein, 7 aa, Artificial Sequence
  Synthetic construct
YIGPGVF

SEQ ID NO: 16069 - protein, 7 aa, Artificial Sequence
  Synthetic construct
YIGPGVY

SEQ ID NO: 16070 - protein, 7 aa, Artificial Sequence
  Synthetic construct
YIGPAFF

SEQ ID NO: 16071 - protein, 7 aa, Artificial Sequence
  Synthetic construct
YIGPAFY

SEQ ID NO: 16072 - protein, 7 aa, Artificial Sequence
  Synthetic construct
YIGPARF

SEQ ID NO: 16073 - protein, 7 aa, Artificial Sequence
  Synthetic construct
YIGPARY

SEQ ID NO: 16074 - protein, 7 aa, Artificial Sequence
  Synthetic construct
YIGPACF

SEQ ID NO: 16075 - protein, 7 aa, Artificial Sequence
  Synthetic construct
YIGPACY

SEQ ID NO: 16076 - protein, 7 aa, Artificial Sequence
  Synthetic construct
YIGPALF

SEQ ID NO: 16077 - protein, 7 aa, Artificial Sequence
  Synthetic construct
YIGPALY

SEQ ID NO: 16078 - protein, 7 aa, Artificial Sequence
  Synthetic construct
YIGPAAF

SEQ ID NO: 16079 - protein, 7 aa, Artificial Sequence
  Synthetic construct
YIGPAAY

SEQ ID NO: 16080 - protein, 7 aa, Artificial Sequence
  Synthetic construct
YIGPAQF

SEQ ID NO: 16081 - protein, 7 aa, Artificial Sequence
  Synthetic construct
YIGPAQY

SEQ ID NO: 16082 - protein, 7 aa, Artificial Sequence
  Synthetic construct
YIGPADF

SEQ ID NO: 16083 - protein, 7 aa, Artificial Sequence
  Synthetic construct
YIGPADY

SEQ ID NO: 16084 - protein, 7 aa, Artificial Sequence
  Synthetic construct
YIGPAVF

SEQ ID NO: 16085 - protein, 7 aa, Artificial Sequence
  Synthetic construct
YIGPAVY

SEQ ID NO: 16086 - protein, 7 aa, Artificial Sequence
  Synthetic construct
YIGPQFF

SEQ ID NO: 16087 - protein, 7 aa, Artificial Sequence
  Synthetic construct
YIGPQFY

SEQ ID NO: 16088 - protein, 7 aa, Artificial Sequence
  Synthetic construct
YIGPQRF

SEQ ID NO: 16089 - protein, 7 aa, Artificial Sequence
  Synthetic construct
YIGPQRY

SEQ ID NO: 16090 - protein, 7 aa, Artificial Sequence
  Synthetic construct
YIGPQCF

SEQ ID NO: 16091 - protein, 7 aa, Artificial Sequence
  Synthetic construct
YIGPQCY

SEQ ID NO: 16092 - protein, 7 aa, Artificial Sequence
  Synthetic construct
YIGPQLF

SEQ ID NO: 16093 - protein, 7 aa, Artificial Sequence
  Synthetic construct
YIGPQLY

SEQ ID NO: 16094 - protein, 7 aa, Artificial Sequence
  Synthetic construct
YIGPQAF

SEQ ID NO: 16095 - protein, 7 aa, Artificial Sequence
  Synthetic construct
YIGPQAY

SEQ ID NO: 16096 - protein, 7 aa, Artificial Sequence
  Synthetic construct
YIGPQQF

SEQ ID NO: 16097 - protein, 7 aa, Artificial Sequence
  Synthetic construct
YIGPQQY

SEQ ID NO: 16098 - protein, 7 aa, Artificial Sequence
  Synthetic construct
YIGPQDF

SEQ ID NO: 16099 - protein, 7 aa, Artificial Sequence
  Synthetic construct
YIGPQDY

SEQ ID NO: 16100 - protein, 7 aa, Artificial Sequence
  Synthetic construct
YIGPQVF

SEQ ID NO: 16101 - protein, 7 aa, Artificial Sequence
  Synthetic construct
YIGPQVY

SEQ ID NO: 16102 - protein, 7 aa, Artificial Sequence
  Synthetic construct
YIGHIFF

SEQ ID NO: 16103 - protein, 7 aa, Artificial Sequence
  Synthetic construct
YIGHIFY

SEQ ID NO: 16104 - protein, 7 aa, Artificial Sequence
  Synthetic construct
YIGHIRF

SEQ ID NO: 16105 - protein, 7 aa, Artificial Sequence
  Synthetic construct
YIGHIRY

SEQ ID NO: 16106 - protein, 7 aa, Artificial Sequence
  Synthetic construct
YIGHICF

SEQ ID NO: 16107 - protein, 7 aa, Artificial Sequence
  Synthetic construct
YIGHICY

SEQ ID NO: 16108 - protein, 7 aa, Artificial Sequence
  Synthetic construct
YIGHILF

SEQ ID NO: 16109 - protein, 7 aa, Artificial Sequence
  Synthetic construct
YIGHILY

SEQ ID NO: 16110 - protein, 7 aa, Artificial Sequence
  Synthetic construct
YIGHIAF

SEQ ID NO: 16111 - protein, 7 aa, Artificial Sequence
  Synthetic construct
YIGHIAY

SEQ ID NO: 16112 - protein, 7 aa, Artificial Sequence
  Synthetic construct
YIGHIQF

SEQ ID NO: 16113 - protein, 7 aa, Artificial Sequence
  Synthetic construct
YIGHIQY

SEQ ID NO: 16114 - protein, 7 aa, Artificial Sequence
  Synthetic construct
YIGHIDF

SEQ ID NO: 16115 - protein, 7 aa, Artificial Sequence
  Synthetic construct
YIGHIDY

SEQ ID NO: 16116 - protein, 7 aa, Artificial Sequence
  Synthetic construct
YIGHIVF

SEQ ID NO: 16117 - protein, 7 aa, Artificial Sequence
  Synthetic construct
YIGHIVY

SEQ ID NO: 16118 - protein, 7 aa, Artificial Sequence
  Synthetic construct
YIGHDFF

SEQ ID NO: 16119 - protein, 7 aa, Artificial Sequence
  Synthetic construct
YIGHDFY

SEQ ID NO: 16120 - protein, 7 aa, Artificial Sequence
  Synthetic construct
YIGHDRF

SEQ ID NO: 16121 - protein, 7 aa, Artificial Sequence
  Synthetic construct
YIGHDRY

SEQ ID NO: 16122 - protein, 7 aa, Artificial Sequence
  Synthetic construct
YIGHDCF

SEQ ID NO: 16123 - protein, 7 aa, Artificial Sequence
  Synthetic construct
YIGHDCY

SEQ ID NO: 16124 - protein, 7 aa, Artificial Sequence
  Synthetic construct
YIGHDLF

SEQ ID NO: 16125 - protein, 7 aa, Artificial Sequence
  Synthetic construct
YIGHDLY

SEQ ID NO: 16126 - protein, 7 aa, Artificial Sequence
  Synthetic construct
YIGHDAF

SEQ ID NO: 16127 - protein, 7 aa, Artificial Sequence
  Synthetic construct
YIGHDAY

SEQ ID NO: 16128 - protein, 7 aa, Artificial Sequence
  Synthetic construct
YIGHDQF

SEQ ID NO: 16129 - protein, 7 aa, Artificial Sequence
  Synthetic construct
YIGHDQY

SEQ ID NO: 16130 - protein, 7 aa, Artificial Sequence
  Synthetic construct
YIGHDDF

SEQ ID NO: 16131 - protein, 7 aa, Artificial Sequence
  Synthetic construct
YIGHDDY

SEQ ID NO: 16132 - protein, 7 aa, Artificial Sequence
  Synthetic construct
YIGHDVF

SEQ ID NO: 16133 - protein, 7 aa, Artificial Sequence
  Synthetic construct
YIGHDVY

SEQ ID NO: 16134 - protein, 7 aa, Artificial Sequence
  Synthetic construct
YIGHYFF

SEQ ID NO: 16135 - protein, 7 aa, Artificial Sequence
  Synthetic construct
YIGHYFY

SEQ ID NO: 16136 - protein, 7 aa, Artificial Sequence
  Synthetic construct
YIGHYRF

SEQ ID NO: 16137 - protein, 7 aa, Artificial Sequence
  Synthetic construct
YIGHYRY

SEQ ID NO: 16138 - protein, 7 aa, Artificial Sequence
  Synthetic construct
YIGHYCF

SEQ ID NO: 16139 - protein, 7 aa, Artificial Sequence
  Synthetic construct
YIGHYCY

SEQ ID NO: 16140 - protein, 7 aa, Artificial Sequence
  Synthetic construct
YIGHYLF

SEQ ID NO: 16141 - protein, 7 aa, Artificial Sequence
  Synthetic construct
YIGHYLY

SEQ ID NO: 16142 - protein, 7 aa, Artificial Sequence
  Synthetic construct
YIGHYAF

SEQ ID NO: 16143 - protein, 7 aa, Artificial Sequence
  Synthetic construct
YIGHYAY

SEQ ID NO: 16144 - protein, 7 aa, Artificial Sequence
  Synthetic construct
YIGHYQF

SEQ ID NO: 16145 - protein, 7 aa, Artificial Sequence
  Synthetic construct
YIGHYQY

SEQ ID NO: 16146 - protein, 7 aa, Artificial Sequence
  Synthetic construct
YIGHYDF

SEQ ID NO: 16147 - protein, 7 aa, Artificial Sequence
  Synthetic construct
YIGHYDY

SEQ ID NO: 16148 - protein, 7 aa, Artificial Sequence
  Synthetic construct
YIGHYVF

SEQ ID NO: 16149 - protein, 7 aa, Artificial Sequence
  Synthetic construct
YIGHYVY

SEQ ID NO: 16150 - protein, 7 aa, Artificial Sequence
  Synthetic construct
YIGHFFF

SEQ ID NO: 16151 - protein, 7 aa, Artificial Sequence
  Synthetic construct
YIGHFFY

SEQ ID NO: 16152 - protein, 7 aa, Artificial Sequence
  Synthetic construct
YIGHFRF

SEQ ID NO: 16153 - protein, 7 aa, Artificial Sequence
  Synthetic construct
YIGHFRY

SEQ ID NO: 16154 - protein, 7 aa, Artificial Sequence
  Synthetic construct
YIGHFCF

SEQ ID NO: 16155 - protein, 7 aa, Artificial Sequence
  Synthetic construct
YIGHFCY

SEQ ID NO: 16156 - protein, 7 aa, Artificial Sequence
  Synthetic construct
YIGHFLF

SEQ ID NO: 16157 - protein, 7 aa, Artificial Sequence
  Synthetic construct
YIGHFLY

SEQ ID NO: 16158 - protein, 7 aa, Artificial Sequence
  Synthetic construct
YIGHFAF

SEQ ID NO: 16159 - protein, 7 aa, Artificial Sequence
  Synthetic construct
YIGHFAY

SEQ ID NO: 16160 - protein, 7 aa, Artificial Sequence
  Synthetic construct
YIGHFQF

SEQ ID NO: 16161 - protein, 7 aa, Artificial Sequence
  Synthetic construct
YIGHFQY

SEQ ID NO: 16162 - protein, 7 aa, Artificial Sequence
  Synthetic construct
YIGHFDF

SEQ ID NO: 16163 - protein, 7 aa, Artificial Sequence
  Synthetic construct
YIGHFDY

SEQ ID NO: 16164 - protein, 7 aa, Artificial Sequence
  Synthetic construct
YIGHFVF

SEQ ID NO: 16165 - protein, 7 aa, Artificial Sequence
  Synthetic construct
YIGHFVY

SEQ ID NO: 16166 - protein, 7 aa, Artificial Sequence
  Synthetic construct
YIGHVFF

SEQ ID NO: 16167 - protein, 7 aa, Artificial Sequence
  Synthetic construct
YIGHVFY

SEQ ID NO: 16168 - protein, 7 aa, Artificial Sequence
  Synthetic construct
YIGHVRF

SEQ ID NO: 16169 - protein, 7 aa, Artificial Sequence
  Synthetic construct
YIGHVRY

SEQ ID NO: 16170 - protein, 7 aa, Artificial Sequence
  Synthetic construct
YIGHVCF

SEQ ID NO: 16171 - protein, 7 aa, Artificial Sequence
  Synthetic construct
YIGHVCY

SEQ ID NO: 16172 - protein, 7 aa, Artificial Sequence
  Synthetic construct
YIGHVLF

SEQ ID NO: 16173 - protein, 7 aa, Artificial Sequence
  Synthetic construct
YIGHVLY

SEQ ID NO: 16174 - protein, 7 aa, Artificial Sequence
  Synthetic construct
YIGHVAF

SEQ ID NO: 16175 - protein, 7 aa, Artificial Sequence
  Synthetic construct
YIGHVAY

SEQ ID NO: 16176 - protein, 7 aa, Artificial Sequence
  Synthetic construct
YIGHVQF

SEQ ID NO: 16177 - protein, 7 aa, Artificial Sequence
  Synthetic construct
YIGHVQY

SEQ ID NO: 16178 - protein, 7 aa, Artificial Sequence
  Synthetic construct
YIGHVDF

SEQ ID NO: 16179 - protein, 7 aa, Artificial Sequence
  Synthetic construct
YIGHVDY

SEQ ID NO: 16180 - protein, 7 aa, Artificial Sequence
  Synthetic construct
YIGHVVF

SEQ ID NO: 16181 - protein, 7 aa, Artificial Sequence
  Synthetic construct
YIGHVVY

SEQ ID NO: 16182 - protein, 7 aa, Artificial Sequence
  Synthetic construct
YIGHTFF

SEQ ID NO: 16183 - protein, 7 aa, Artificial Sequence
  Synthetic construct
YIGHTFY

SEQ ID NO: 16184 - protein, 7 aa, Artificial Sequence
  Synthetic construct
YIGHTRF

SEQ ID NO: 16185 - protein, 7 aa, Artificial Sequence
  Synthetic construct
YIGHTRY

SEQ ID NO: 16186 - protein, 7 aa, Artificial Sequence
  Synthetic construct
YIGHTCF

SEQ ID NO: 16187 - protein, 7 aa, Artificial Sequence
  Synthetic construct
YIGHTCY

SEQ ID NO: 16188 - protein, 7 aa, Artificial Sequence
  Synthetic construct
YIGHTLF

SEQ ID NO: 16189 - protein, 7 aa, Artificial Sequence
  Synthetic construct
YIGHTLY

SEQ ID NO: 16190 - protein, 7 aa, Artificial Sequence
  Synthetic construct
YIGHTAF

SEQ ID NO: 16191 - protein, 7 aa, Artificial Sequence
  Synthetic construct
YIGHTAY

SEQ ID NO: 16192 - protein, 7 aa, Artificial Sequence
  Synthetic construct
YIGHTQF

SEQ ID NO: 16193 - protein, 7 aa, Artificial Sequence
  Synthetic construct
YIGHTQY

SEQ ID NO: 16194 - protein, 7 aa, Artificial Sequence
  Synthetic construct
YIGHTDF

SEQ ID NO: 16195 - protein, 7 aa, Artificial Sequence
  Synthetic construct
YIGHTDY

SEQ ID NO: 16196 - protein, 7 aa, Artificial Sequence
  Synthetic construct
YIGHTVF

SEQ ID NO: 16197 - protein, 7 aa, Artificial Sequence
  Synthetic construct
YIGHTVY

SEQ ID NO: 16198 - protein, 7 aa, Artificial Sequence
  Synthetic construct
YIGHGFF

SEQ ID NO: 16199 - protein, 7 aa, Artificial Sequence
  Synthetic construct
YIGHGFY

SEQ ID NO: 16200 - protein, 7 aa, Artificial Sequence
  Synthetic construct
YIGHGRF

SEQ ID NO: 16201 - protein, 7 aa, Artificial Sequence
  Synthetic construct
YIGHGRY

SEQ ID NO: 16202 - protein, 7 aa, Artificial Sequence
  Synthetic construct
YIGHGCF

SEQ ID NO: 16203 - protein, 7 aa, Artificial Sequence
  Synthetic construct
YIGHGCY

SEQ ID NO: 16204 - protein, 7 aa, Artificial Sequence
  Synthetic construct
YIGHGLF

SEQ ID NO: 16205 - protein, 7 aa, Artificial Sequence
  Synthetic construct
YIGHGLY

SEQ ID NO: 16206 - protein, 7 aa, Artificial Sequence
  Synthetic construct
YIGHGAF

SEQ ID NO: 16207 - protein, 7 aa, Artificial Sequence
  Synthetic construct
YIGHGAY

SEQ ID NO: 16208 - protein, 7 aa, Artificial Sequence
  Synthetic construct
YIGHGQF

SEQ ID NO: 16209 - protein, 7 aa, Artificial Sequence
  Synthetic construct
YIGHGQY

SEQ ID NO: 16210 - protein, 7 aa, Artificial Sequence
  Synthetic construct
YIGHGDF

SEQ ID NO: 16211 - protein, 7 aa, Artificial Sequence
  Synthetic construct
YIGHGDY

SEQ ID NO: 16212 - protein, 7 aa, Artificial Sequence
  Synthetic construct
YIGHGVF

SEQ ID NO: 16213 - protein, 7 aa, Artificial Sequence
  Synthetic construct
YIGHGVY

SEQ ID NO: 16214 - protein, 7 aa, Artificial Sequence
  Synthetic construct
YIGHAFF

SEQ ID NO: 16215 - protein, 7 aa, Artificial Sequence
  Synthetic construct
YIGHAFY

SEQ ID NO: 16216 - protein, 7 aa, Artificial Sequence
  Synthetic construct
YIGHARF

SEQ ID NO: 16217 - protein, 7 aa, Artificial Sequence
  Synthetic construct
YIGHARY

SEQ ID NO: 16218 - protein, 7 aa, Artificial Sequence
  Synthetic construct
YIGHACF

SEQ ID NO: 16219 - protein, 7 aa, Artificial Sequence
  Synthetic construct
YIGHACY

SEQ ID NO: 16220 - protein, 7 aa, Artificial Sequence
  Synthetic construct
YIGHALF

SEQ ID NO: 16221 - protein, 7 aa, Artificial Sequence
  Synthetic construct
YIGHALY

SEQ ID NO: 16222 - protein, 7 aa, Artificial Sequence
  Synthetic construct
YIGHAAF

SEQ ID NO: 16223 - protein, 7 aa, Artificial Sequence
  Synthetic construct
YIGHAAY

SEQ ID NO: 16224 - protein, 7 aa, Artificial Sequence
  Synthetic construct
YIGHAQF

SEQ ID NO: 16225 - protein, 7 aa, Artificial Sequence
  Synthetic construct
YIGHAQY

SEQ ID NO: 16226 - protein, 7 aa, Artificial Sequence
  Synthetic construct
YIGHADF

SEQ ID NO: 16227 - protein, 7 aa, Artificial Sequence
  Synthetic construct
YIGHADY

SEQ ID NO: 16228 - protein, 7 aa, Artificial Sequence
  Synthetic construct
YIGHAVF

SEQ ID NO: 16229 - protein, 7 aa, Artificial Sequence
  Synthetic construct
YIGHAVY

SEQ ID NO: 16230 - protein, 7 aa, Artificial Sequence
  Synthetic construct
YIGHQFF

SEQ ID NO: 16231 - protein, 7 aa, Artificial Sequence
  Synthetic construct
YIGHQFY

SEQ ID NO: 16232 - protein, 7 aa, Artificial Sequence
  Synthetic construct
YIGHQRF

SEQ ID NO: 16233 - protein, 7 aa, Artificial Sequence
  Synthetic construct
YIGHQRY

SEQ ID NO: 16234 - protein, 7 aa, Artificial Sequence
  Synthetic construct
YIGHQCF

SEQ ID NO: 16235 - protein, 7 aa, Artificial Sequence
  Synthetic construct
YIGHQCY

SEQ ID NO: 16236 - protein, 7 aa, Artificial Sequence
  Synthetic construct
YIGHQLF

SEQ ID NO: 16237 - protein, 7 aa, Artificial Sequence
  Synthetic construct
YIGHQLY

SEQ ID NO: 16238 - protein, 7 aa, Artificial Sequence
  Synthetic construct
YIGHQAF

SEQ ID NO: 16239 - protein, 7 aa, Artificial Sequence
  Synthetic construct
YIGHQAY

SEQ ID NO: 16240 - protein, 7 aa, Artificial Sequence
  Synthetic construct
YIGHQQF

SEQ ID NO: 16241 - protein, 7 aa, Artificial Sequence
  Synthetic construct
YIGHQQY

SEQ ID NO: 16242 - protein, 7 aa, Artificial Sequence
  Synthetic construct
YIGHQDF

SEQ ID NO: 16243 - protein, 7 aa, Artificial Sequence
  Synthetic construct
YIGHQDY

SEQ ID NO: 16244 - protein, 7 aa, Artificial Sequence
  Synthetic construct
YIGHQVF

SEQ ID NO: 16245 - protein, 7 aa, Artificial Sequence
  Synthetic construct
YIGHQVY

SEQ ID NO: 16246 - protein, 7 aa, Artificial Sequence
  Synthetic construct
YIGLIFF

SEQ ID NO: 16247 - protein, 7 aa, Artificial Sequence
  Synthetic construct
YIGLIFY

SEQ ID NO: 16248 - protein, 7 aa, Artificial Sequence
  Synthetic construct
YIGLIRF

SEQ ID NO: 16249 - protein, 7 aa, Artificial Sequence
  Synthetic construct
YIGLIRY

SEQ ID NO: 16250 - protein, 7 aa, Artificial Sequence
  Synthetic construct
YIGLICF

SEQ ID NO: 16251 - protein, 7 aa, Artificial Sequence
  Synthetic construct
YIGLICY

SEQ ID NO: 16252 - protein, 7 aa, Artificial Sequence
  Synthetic construct
YIGLILF

SEQ ID NO: 16253 - protein, 7 aa, Artificial Sequence
  Synthetic construct
YIGLILY

SEQ ID NO: 16254 - protein, 7 aa, Artificial Sequence
  Synthetic construct
YIGLIAF

SEQ ID NO: 16255 - protein, 7 aa, Artificial Sequence
  Synthetic construct
YIGLIAY

SEQ ID NO: 16256 - protein, 7 aa, Artificial Sequence
  Synthetic construct
YIGLIQF

SEQ ID NO: 16257 - protein, 7 aa, Artificial Sequence
  Synthetic construct
YIGLIQY

SEQ ID NO: 16258 - protein, 7 aa, Artificial Sequence
  Synthetic construct
YIGLIDF

SEQ ID NO: 16259 - protein, 7 aa, Artificial Sequence
  Synthetic construct
YIGLIDY

SEQ ID NO: 16260 - protein, 7 aa, Artificial Sequence
  Synthetic construct
YIGLIVF

SEQ ID NO: 16261 - protein, 7 aa, Artificial Sequence
  Synthetic construct
YIGLIVY

SEQ ID NO: 16262 - protein, 7 aa, Artificial Sequence
  Synthetic construct
YIGLDFF

SEQ ID NO: 16263 - protein, 7 aa, Artificial Sequence
  Synthetic construct
YIGLDFY

SEQ ID NO: 16264 - protein, 7 aa, Artificial Sequence
  Synthetic construct
YIGLDRF

SEQ ID NO: 16265 - protein, 7 aa, Artificial Sequence
  Synthetic construct
YIGLDRY

SEQ ID NO: 16266 - protein, 7 aa, Artificial Sequence
  Synthetic construct
YIGLDCF

SEQ ID NO: 16267 - protein, 7 aa, Artificial Sequence
  Synthetic construct
YIGLDCY

SEQ ID NO: 16268 - protein, 7 aa, Artificial Sequence
  Synthetic construct
YIGLDLF

SEQ ID NO: 16269 - protein, 7 aa, Artificial Sequence
  Synthetic construct
YIGLDLY

SEQ ID NO: 16270 - protein, 7 aa, Artificial Sequence
  Synthetic construct
YIGLDAF

SEQ ID NO: 16271 - protein, 7 aa, Artificial Sequence
  Synthetic construct
YIGLDAY

SEQ ID NO: 16272 - protein, 7 aa, Artificial Sequence
  Synthetic construct
YIGLDQF

SEQ ID NO: 16273 - protein, 7 aa, Artificial Sequence
  Synthetic construct
YIGLDQY

SEQ ID NO: 16274 - protein, 7 aa, Artificial Sequence
  Synthetic construct
YIGLDDF

SEQ ID NO: 16275 - protein, 7 aa, Artificial Sequence
  Synthetic construct
YIGLDDY

SEQ ID NO: 16276 - protein, 7 aa, Artificial Sequence
  Synthetic construct
YIGLDVF

SEQ ID NO: 16277 - protein, 7 aa, Artificial Sequence
  Synthetic construct
YIGLDVY

SEQ ID NO: 16278 - protein, 7 aa, Artificial Sequence
  Synthetic construct
YIGLYFF

SEQ ID NO: 16279 - protein, 7 aa, Artificial Sequence
  Synthetic construct
YIGLYFY

SEQ ID NO: 16280 - protein, 7 aa, Artificial Sequence
  Synthetic construct
YIGLYRF

SEQ ID NO: 16281 - protein, 7 aa, Artificial Sequence
  Synthetic construct
YIGLYRY

SEQ ID NO: 16282 - protein, 7 aa, Artificial Sequence
  Synthetic construct
YIGLYCF

SEQ ID NO: 16283 - protein, 7 aa, Artificial Sequence
  Synthetic construct
YIGLYCY

SEQ ID NO: 16284 - protein, 7 aa, Artificial Sequence
  Synthetic construct
YIGLYLF

SEQ ID NO: 16285 - protein, 7 aa, Artificial Sequence
  Synthetic construct
YIGLYLY

SEQ ID NO: 16286 - protein, 7 aa, Artificial Sequence
  Synthetic construct
YIGLYAF

SEQ ID NO: 16287 - protein, 7 aa, Artificial Sequence
  Synthetic construct
YIGLYAY

SEQ ID NO: 16288 - protein, 7 aa, Artificial Sequence
  Synthetic construct
YIGLYQF

SEQ ID NO: 16289 - protein, 7 aa, Artificial Sequence
  Synthetic construct
YIGLYQY

SEQ ID NO: 16290 - protein, 7 aa, Artificial Sequence
  Synthetic construct
YIGLYDF

SEQ ID NO: 16291 - protein, 7 aa, Artificial Sequence
  Synthetic construct
YIGLYDY

SEQ ID NO: 16292 - protein, 7 aa, Artificial Sequence
  Synthetic construct
YIGLYVF

SEQ ID NO: 16293 - protein, 7 aa, Artificial Sequence
  Synthetic construct
YIGLYVY

SEQ ID NO: 16294 - protein, 7 aa, Artificial Sequence
  Synthetic construct
YIGLFFF

SEQ ID NO: 16295 - protein, 7 aa, Artificial Sequence
  Synthetic construct
YIGLFFY

SEQ ID NO: 16296 - protein, 7 aa, Artificial Sequence
  Synthetic construct
YIGLFRF

SEQ ID NO: 16297 - protein, 7 aa, Artificial Sequence
  Synthetic construct
YIGLFRY

SEQ ID NO: 16298 - protein, 7 aa, Artificial Sequence
  Synthetic construct
YIGLFCF

SEQ ID NO: 16299 - protein, 7 aa, Artificial Sequence
  Synthetic construct
YIGLFCY

SEQ ID NO: 16300 - protein, 7 aa, Artificial Sequence
  Synthetic construct
YIGLFLF

SEQ ID NO: 16301 - protein, 7 aa, Artificial Sequence
  Synthetic construct
YIGLFLY

SEQ ID NO: 16302 - protein, 7 aa, Artificial Sequence
  Synthetic construct
YIGLFAF

SEQ ID NO: 16303 - protein, 7 aa, Artificial Sequence
  Synthetic construct
YIGLFAY

SEQ ID NO: 16304 - protein, 7 aa, Artificial Sequence
  Synthetic construct
YIGLFQF

SEQ ID NO: 16305 - protein, 7 aa, Artificial Sequence
  Synthetic construct
YIGLFQY

SEQ ID NO: 16306 - protein, 7 aa, Artificial Sequence
  Synthetic construct
YIGLFDF

SEQ ID NO: 16307 - protein, 7 aa, Artificial Sequence
  Synthetic construct
YIGLFDY

SEQ ID NO: 16308 - protein, 7 aa, Artificial Sequence
  Synthetic construct
YIGLFVF

SEQ ID NO: 16309 - protein, 7 aa, Artificial Sequence
  Synthetic construct
YIGLFVY

SEQ ID NO: 16310 - protein, 7 aa, Artificial Sequence
  Synthetic construct
YIGLVFF

SEQ ID NO: 16311 - protein, 7 aa, Artificial Sequence
  Synthetic construct
YIGLVFY

SEQ ID NO: 16312 - protein, 7 aa, Artificial Sequence
  Synthetic construct
YIGLVRF

SEQ ID NO: 16313 - protein, 7 aa, Artificial Sequence
  Synthetic construct
YIGLVRY

SEQ ID NO: 16314 - protein, 7 aa, Artificial Sequence
  Synthetic construct
YIGLVCF

SEQ ID NO: 16315 - protein, 7 aa, Artificial Sequence
  Synthetic construct
YIGLVCY

SEQ ID NO: 16316 - protein, 7 aa, Artificial Sequence
  Synthetic construct
YIGLVLF

SEQ ID NO: 16317 - protein, 7 aa, Artificial Sequence
  Synthetic construct
YIGLVLY

SEQ ID NO: 16318 - protein, 7 aa, Artificial Sequence
  Synthetic construct
YIGLVAF

SEQ ID NO: 16319 - protein, 7 aa, Artificial Sequence
  Synthetic construct
YIGLVAY

SEQ ID NO: 16320 - protein, 7 aa, Artificial Sequence
  Synthetic construct
YIGLVQF

SEQ ID NO: 16321 - protein, 7 aa, Artificial Sequence
  Synthetic construct
YIGLVQY

SEQ ID NO: 16322 - protein, 7 aa, Artificial Sequence
  Synthetic construct
YIGLVDF

SEQ ID NO: 16323 - protein, 7 aa, Artificial Sequence
  Synthetic construct
YIGLVDY

SEQ ID NO: 16324 - protein, 7 aa, Artificial Sequence
  Synthetic construct
YIGLVVF

SEQ ID NO: 16325 - protein, 7 aa, Artificial Sequence
  Synthetic construct
YIGLVVY

SEQ ID NO: 16326 - protein, 7 aa, Artificial Sequence
  Synthetic construct
YIGLTFF

SEQ ID NO: 16327 - protein, 7 aa, Artificial Sequence
  Synthetic construct
YIGLTFY

SEQ ID NO: 16328 - protein, 7 aa, Artificial Sequence
  Synthetic construct
YIGLTRF

SEQ ID NO: 16329 - protein, 7 aa, Artificial Sequence
  Synthetic construct
YIGLTRY

SEQ ID NO: 16330 - protein, 7 aa, Artificial Sequence
  Synthetic construct
YIGLTCF

SEQ ID NO: 16331 - protein, 7 aa, Artificial Sequence
  Synthetic construct
YIGLTCY

SEQ ID NO: 16332 - protein, 7 aa, Artificial Sequence
  Synthetic construct
YIGLTLF

SEQ ID NO: 16333 - protein, 7 aa, Artificial Sequence
  Synthetic construct
YIGLTLY

SEQ ID NO: 16334 - protein, 7 aa, Artificial Sequence
  Synthetic construct
YIGLTAF

SEQ ID NO: 16335 - protein, 7 aa, Artificial Sequence
  Synthetic construct
YIGLTAY

SEQ ID NO: 16336 - protein, 7 aa, Artificial Sequence
  Synthetic construct
YIGLTQF

SEQ ID NO: 16337 - protein, 7 aa, Artificial Sequence
  Synthetic construct
YIGLTQY

SEQ ID NO: 16338 - protein, 7 aa, Artificial Sequence
  Synthetic construct
YIGLTDF

SEQ ID NO: 16339 - protein, 7 aa, Artificial Sequence
  Synthetic construct
YIGLTDY

SEQ ID NO: 16340 - protein, 7 aa, Artificial Sequence
  Synthetic construct
YIGLTVF

SEQ ID NO: 16341 - protein, 7 aa, Artificial Sequence
  Synthetic construct
YIGLTVY

SEQ ID NO: 16342 - protein, 7 aa, Artificial Sequence
  Synthetic construct
YIGLGFF

SEQ ID NO: 16343 - protein, 7 aa, Artificial Sequence
  Synthetic construct
YIGLGFY

SEQ ID NO: 16344 - protein, 7 aa, Artificial Sequence
  Synthetic construct
YIGLGRF

SEQ ID NO: 16345 - protein, 7 aa, Artificial Sequence
  Synthetic construct
YIGLGRY

SEQ ID NO: 16346 - protein, 7 aa, Artificial Sequence
  Synthetic construct
YIGLGCF

SEQ ID NO: 16347 - protein, 7 aa, Artificial Sequence
  Synthetic construct
YIGLGCY

SEQ ID NO: 16348 - protein, 7 aa, Artificial Sequence
  Synthetic construct
YIGLGLF

SEQ ID NO: 16349 - protein, 7 aa, Artificial Sequence
  Synthetic construct
YIGLGLY

SEQ ID NO: 16350 - protein, 7 aa, Artificial Sequence
  Synthetic construct
YIGLGAF

SEQ ID NO: 16351 - protein, 7 aa, Artificial Sequence
  Synthetic construct
YIGLGAY

SEQ ID NO: 16352 - protein, 7 aa, Artificial Sequence
  Synthetic construct
YIGLGQF

SEQ ID NO: 16353 - protein, 7 aa, Artificial Sequence
  Synthetic construct
YIGLGQY

SEQ ID NO: 16354 - protein, 7 aa, Artificial Sequence
  Synthetic construct
YIGLGDF

SEQ ID NO: 16355 - protein, 7 aa, Artificial Sequence
  Synthetic construct
YIGLGDY

SEQ ID NO: 16356 - protein, 7 aa, Artificial Sequence
  Synthetic construct
YIGLGVF

SEQ ID NO: 16357 - protein, 7 aa, Artificial Sequence
  Synthetic construct
YIGLGVY

SEQ ID NO: 16358 - protein, 7 aa, Artificial Sequence
  Synthetic construct
YIGLAFF

SEQ ID NO: 16359 - protein, 7 aa, Artificial Sequence
  Synthetic construct
YIGLAFY

SEQ ID NO: 16360 - protein, 7 aa, Artificial Sequence
  Synthetic construct
YIGLARF

SEQ ID NO: 16361 - protein, 7 aa, Artificial Sequence
  Synthetic construct
YIGLARY

SEQ ID NO: 16362 - protein, 7 aa, Artificial Sequence
  Synthetic construct
YIGLACF

SEQ ID NO: 16363 - protein, 7 aa, Artificial Sequence
  Synthetic construct
YIGLACY

SEQ ID NO: 16364 - protein, 7 aa, Artificial Sequence
  Synthetic construct
YIGLALF

SEQ ID NO: 16365 - protein, 7 aa, Artificial Sequence
  Synthetic construct
YIGLALY

SEQ ID NO: 16366 - protein, 7 aa, Artificial Sequence
  Synthetic construct
YIGLAAF

SEQ ID NO: 16367 - protein, 7 aa, Artificial Sequence
  Synthetic construct
YIGLAAY

SEQ ID NO: 16368 - protein, 7 aa, Artificial Sequence
  Synthetic construct
YIGLAQF

SEQ ID NO: 16369 - protein, 7 aa, Artificial Sequence
  Synthetic construct
YIGLAQY

SEQ ID NO: 16370 - protein, 7 aa, Artificial Sequence
  Synthetic construct
YIGLADF

SEQ ID NO: 16371 - protein, 7 aa, Artificial Sequence
  Synthetic construct
YIGLADY

SEQ ID NO: 16372 - protein, 7 aa, Artificial Sequence
  Synthetic construct
YIGLAVF

SEQ ID NO: 16373 - protein, 7 aa, Artificial Sequence
  Synthetic construct
YIGLAVY

SEQ ID NO: 16374 - protein, 7 aa, Artificial Sequence
  Synthetic construct
YIGLQFF

SEQ ID NO: 16375 - protein, 7 aa, Artificial Sequence
  Synthetic construct
YIGLQFY

SEQ ID NO: 16376 - protein, 7 aa, Artificial Sequence
  Synthetic construct
YIGLQRF

SEQ ID NO: 16377 - protein, 7 aa, Artificial Sequence
  Synthetic construct
YIGLQRY

SEQ ID NO: 16378 - protein, 7 aa, Artificial Sequence
  Synthetic construct
YIGLQCF

SEQ ID NO: 16379 - protein, 7 aa, Artificial Sequence
  Synthetic construct
YIGLQCY

SEQ ID NO: 16380 - protein, 7 aa, Artificial Sequence
  Synthetic construct
YIGLQLF

SEQ ID NO: 16381 - protein, 7 aa, Artificial Sequence
  Synthetic construct
YIGLQLY

SEQ ID NO: 16382 - protein, 7 aa, Artificial Sequence
  Synthetic construct
YIGLQAF

SEQ ID NO: 16383 - protein, 7 aa, Artificial Sequence
  Synthetic construct
YIGLQAY

SEQ ID NO: 16384 - protein, 7 aa, Artificial Sequence
  Synthetic construct
YIGLQQF

SEQ ID NO: 16385 - protein, 7 aa, Artificial Sequence
  Synthetic construct
YIGLQQY

SEQ ID NO: 16386 - protein, 7 aa, Artificial Sequence
  Synthetic construct
YIGLQDF

SEQ ID NO: 16387 - protein, 7 aa, Artificial Sequence
  Synthetic construct
YIGLQDY

SEQ ID NO: 16388 - protein, 7 aa, Artificial Sequence
  Synthetic construct
YIGLQVF

SEQ ID NO: 16389 - protein, 7 aa, Artificial Sequence
  Synthetic construct
YIGLQVY

SEQ ID NO: 16390 - protein, 7 aa, Artificial Sequence
  Synthetic construct
YIGFIFF

SEQ ID NO: 16391 - protein, 7 aa, Artificial Sequence
  Synthetic construct
YIGFIFY

SEQ ID NO: 16392 - protein, 7 aa, Artificial Sequence
  Synthetic construct
YIGFIRF

SEQ ID NO: 16393 - protein, 7 aa, Artificial Sequence
  Synthetic construct
YIGFIRY

SEQ ID NO: 16394 - protein, 7 aa, Artificial Sequence
  Synthetic construct
YIGFICF

SEQ ID NO: 16395 - protein, 7 aa, Artificial Sequence
  Synthetic construct
YIGFICY

SEQ ID NO: 16396 - protein, 7 aa, Artificial Sequence
  Synthetic construct
YIGFILF

SEQ ID NO: 16397 - protein, 7 aa, Artificial Sequence
  Synthetic construct
YIGFILY

SEQ ID NO: 16398 - protein, 7 aa, Artificial Sequence
  Synthetic construct
YIGFIAF

SEQ ID NO: 16399 - protein, 7 aa, Artificial Sequence
  Synthetic construct
YIGFIAY

SEQ ID NO: 16400 - protein, 7 aa, Artificial Sequence
  Synthetic construct
YIGFIQF

SEQ ID NO: 16401 - protein, 7 aa, Artificial Sequence
  Synthetic construct
YIGFIQY

SEQ ID NO: 16402 - protein, 7 aa, Artificial Sequence
  Synthetic construct
YIGFIDF

SEQ ID NO: 16403 - protein, 7 aa, Artificial Sequence
  Synthetic construct
YIGFIDY

SEQ ID NO: 16404 - protein, 7 aa, Artificial Sequence
  Synthetic construct
YIGFIVF

SEQ ID NO: 16405 - protein, 7 aa, Artificial Sequence
  Synthetic construct
YIGFIVY

SEQ ID NO: 16406 - protein, 7 aa, Artificial Sequence
  Synthetic construct
YIGFDFF

SEQ ID NO: 16407 - protein, 7 aa, Artificial Sequence
  Synthetic construct
YIGFDFY

SEQ ID NO: 16408 - protein, 7 aa, Artificial Sequence
  Synthetic construct
YIGFDRF

SEQ ID NO: 16409 - protein, 7 aa, Artificial Sequence
  Synthetic construct
YIGFDRY

SEQ ID NO: 16410 - protein, 7 aa, Artificial Sequence
  Synthetic construct
YIGFDCF

SEQ ID NO: 16411 - protein, 7 aa, Artificial Sequence
  Synthetic construct
YIGFDCY

SEQ ID NO: 16412 - protein, 7 aa, Artificial Sequence
  Synthetic construct
YIGFDLF

SEQ ID NO: 16413 - protein, 7 aa, Artificial Sequence
  Synthetic construct
YIGFDLY

SEQ ID NO: 16414 - protein, 7 aa, Artificial Sequence
  Synthetic construct
YIGFDAF

SEQ ID NO: 16415 - protein, 7 aa, Artificial Sequence
  Synthetic construct
YIGFDAY

SEQ ID NO: 16416 - protein, 7 aa, Artificial Sequence
  Synthetic construct
YIGFDQF

SEQ ID NO: 16417 - protein, 7 aa, Artificial Sequence
  Synthetic construct
YIGFDQY

SEQ ID NO: 16418 - protein, 7 aa, Artificial Sequence
  Synthetic construct
YIGFDDF

SEQ ID NO: 16419 - protein, 7 aa, Artificial Sequence
  Synthetic construct
YIGFDDY

SEQ ID NO: 16420 - protein, 7 aa, Artificial Sequence
  Synthetic construct
YIGFDVF

SEQ ID NO: 16421 - protein, 7 aa, Artificial Sequence
  Synthetic construct
YIGFDVY

SEQ ID NO: 16422 - protein, 7 aa, Artificial Sequence
  Synthetic construct
YIGFYFF

SEQ ID NO: 16423 - protein, 7 aa, Artificial Sequence
  Synthetic construct
YIGFYFY

SEQ ID NO: 16424 - protein, 7 aa, Artificial Sequence
  Synthetic construct
YIGFYRF

SEQ ID NO: 16425 - protein, 7 aa, Artificial Sequence
  Synthetic construct
YIGFYRY

SEQ ID NO: 16426 - protein, 7 aa, Artificial Sequence
  Synthetic construct
YIGFYCF

SEQ ID NO: 16427 - protein, 7 aa, Artificial Sequence
  Synthetic construct
YIGFYCY

SEQ ID NO: 16428 - protein, 7 aa, Artificial Sequence
  Synthetic construct
YIGFYLF

SEQ ID NO: 16429 - protein, 7 aa, Artificial Sequence
  Synthetic construct
YIGFYLY

SEQ ID NO: 16430 - protein, 7 aa, Artificial Sequence
  Synthetic construct
YIGFYAF

SEQ ID NO: 16431 - protein, 7 aa, Artificial Sequence
  Synthetic construct
YIGFYAY

SEQ ID NO: 16432 - protein, 7 aa, Artificial Sequence
  Synthetic construct
YIGFYQF

SEQ ID NO: 16433 - protein, 7 aa, Artificial Sequence
  Synthetic construct
YIGFYQY

SEQ ID NO: 16434 - protein, 7 aa, Artificial Sequence
  Synthetic construct
YIGFYDF

SEQ ID NO: 16435 - protein, 7 aa, Artificial Sequence
  Synthetic construct
YIGFYDY

SEQ ID NO: 16436 - protein, 7 aa, Artificial Sequence
  Synthetic construct
YIGFYVF

SEQ ID NO: 16437 - protein, 7 aa, Artificial Sequence
  Synthetic construct
YIGFYVY

SEQ ID NO: 16438 - protein, 7 aa, Artificial Sequence
  Synthetic construct
YIGFFFF

SEQ ID NO: 16439 - protein, 7 aa, Artificial Sequence
  Synthetic construct
YIGFFFY

SEQ ID NO: 16440 - protein, 7 aa, Artificial Sequence
  Synthetic construct
YIGFFRF

SEQ ID NO: 16441 - protein, 7 aa, Artificial Sequence
  Synthetic construct
YIGFFRY

SEQ ID NO: 16442 - protein, 7 aa, Artificial Sequence
  Synthetic construct
YIGFFCF

SEQ ID NO: 16443 - protein, 7 aa, Artificial Sequence
  Synthetic construct
YIGFFCY

SEQ ID NO: 16444 - protein, 7 aa, Artificial Sequence
  Synthetic construct
YIGFFLF

SEQ ID NO: 16445 - protein, 7 aa, Artificial Sequence
  Synthetic construct
YIGFFLY

SEQ ID NO: 16446 - protein, 7 aa, Artificial Sequence
  Synthetic construct
YIGFFAF

SEQ ID NO: 16447 - protein, 7 aa, Artificial Sequence
  Synthetic construct
YIGFFAY

SEQ ID NO: 16448 - protein, 7 aa, Artificial Sequence
  Synthetic construct
YIGFFQF

SEQ ID NO: 16449 - protein, 7 aa, Artificial Sequence
  Synthetic construct
YIGFFQY

SEQ ID NO: 16450 - protein, 7 aa, Artificial Sequence
  Synthetic construct
YIGFFDF

SEQ ID NO: 16451 - protein, 7 aa, Artificial Sequence
  Synthetic construct
YIGFFDY

SEQ ID NO: 16452 - protein, 7 aa, Artificial Sequence
  Synthetic construct
YIGFFVF

SEQ ID NO: 16453 - protein, 7 aa, Artificial Sequence
  Synthetic construct
YIGFFVY

SEQ ID NO: 16454 - protein, 7 aa, Artificial Sequence
  Synthetic construct
YIGFVFF

SEQ ID NO: 16455 - protein, 7 aa, Artificial Sequence
  Synthetic construct
YIGFVFY

SEQ ID NO: 16456 - protein, 7 aa, Artificial Sequence
  Synthetic construct
YIGFVRF

SEQ ID NO: 16457 - protein, 7 aa, Artificial Sequence
  Synthetic construct
YIGFVRY

SEQ ID NO: 16458 - protein, 7 aa, Artificial Sequence
  Synthetic construct
YIGFVCF

SEQ ID NO: 16459 - protein, 7 aa, Artificial Sequence
  Synthetic construct
YIGFVCY

SEQ ID NO: 16460 - protein, 7 aa, Artificial Sequence
  Synthetic construct
YIGFVLF

SEQ ID NO: 16461 - protein, 7 aa, Artificial Sequence
  Synthetic construct
YIGFVLY

SEQ ID NO: 16462 - protein, 7 aa, Artificial Sequence
  Synthetic construct
YIGFVAF

SEQ ID NO: 16463 - protein, 7 aa, Artificial Sequence
  Synthetic construct
YIGFVAY

SEQ ID NO: 16464 - protein, 7 aa, Artificial Sequence
  Synthetic construct
YIGFVQF

SEQ ID NO: 16465 - protein, 7 aa, Artificial Sequence
  Synthetic construct
YIGFVQY

SEQ ID NO: 16466 - protein, 7 aa, Artificial Sequence
  Synthetic construct
YIGFVDF

SEQ ID NO: 16467 - protein, 7 aa, Artificial Sequence
  Synthetic construct
YIGFVDY

SEQ ID NO: 16468 - protein, 7 aa, Artificial Sequence
  Synthetic construct
YIGFVVF

SEQ ID NO: 16469 - protein, 7 aa, Artificial Sequence
  Synthetic construct
YIGFVVY

SEQ ID NO: 16470 - protein, 7 aa, Artificial Sequence
  Synthetic construct
YIGFTFF

SEQ ID NO: 16471 - protein, 7 aa, Artificial Sequence
  Synthetic construct
YIGFTFY

SEQ ID NO: 16472 - protein, 7 aa, Artificial Sequence
  Synthetic construct
YIGFTRF

SEQ ID NO: 16473 - protein, 7 aa, Artificial Sequence
  Synthetic construct
YIGFTRY

SEQ ID NO: 16474 - protein, 7 aa, Artificial Sequence
  Synthetic construct
YIGFTCF

SEQ ID NO: 16475 - protein, 7 aa, Artificial Sequence
  Synthetic construct
YIGFTCY

SEQ ID NO: 16476 - protein, 7 aa, Artificial Sequence
  Synthetic construct
YIGFTLF

SEQ ID NO: 16477 - protein, 7 aa, Artificial Sequence
  Synthetic construct
YIGFTLY

SEQ ID NO: 16478 - protein, 7 aa, Artificial Sequence
  Synthetic construct
YIGFTAF

SEQ ID NO: 16479 - protein, 7 aa, Artificial Sequence
  Synthetic construct
YIGFTAY

SEQ ID NO: 16480 - protein, 7 aa, Artificial Sequence
  Synthetic construct
YIGFTQF

SEQ ID NO: 16481 - protein, 7 aa, Artificial Sequence
  Synthetic construct
YIGFTQY

SEQ ID NO: 16482 - protein, 7 aa, Artificial Sequence
  Synthetic construct
YIGFTDF

SEQ ID NO: 16483 - protein, 7 aa, Artificial Sequence
  Synthetic construct
YIGFTDY

SEQ ID NO: 16484 - protein, 7 aa, Artificial Sequence
  Synthetic construct
YIGFTVF

SEQ ID NO: 16485 - protein, 7 aa, Artificial Sequence
  Synthetic construct
YIGFTVY

SEQ ID NO: 16486 - protein, 7 aa, Artificial Sequence
  Synthetic construct
YIGFGFF

SEQ ID NO: 16487 - protein, 7 aa, Artificial Sequence
  Synthetic construct
YIGFGFY

SEQ ID NO: 16488 - protein, 7 aa, Artificial Sequence
  Synthetic construct
YIGFGRF

SEQ ID NO: 16489 - protein, 7 aa, Artificial Sequence
  Synthetic construct
YIGFGRY

SEQ ID NO: 16490 - protein, 7 aa, Artificial Sequence
  Synthetic construct
YIGFGCF

SEQ ID NO: 16491 - protein, 7 aa, Artificial Sequence
  Synthetic construct
YIGFGCY

SEQ ID NO: 16492 - protein, 7 aa, Artificial Sequence
  Synthetic construct
YIGFGLF

SEQ ID NO: 16493 - protein, 7 aa, Artificial Sequence
  Synthetic construct
YIGFGLY

SEQ ID NO: 16494 - protein, 7 aa, Artificial Sequence
  Synthetic construct
YIGFGAF

SEQ ID NO: 16495 - protein, 7 aa, Artificial Sequence
  Synthetic construct
YIGFGAY

SEQ ID NO: 16496 - protein, 7 aa, Artificial Sequence
  Synthetic construct
YIGFGQF

SEQ ID NO: 16497 - protein, 7 aa, Artificial Sequence
  Synthetic construct
YIGFGQY

SEQ ID NO: 16498 - protein, 7 aa, Artificial Sequence
  Synthetic construct
YIGFGDF

SEQ ID NO: 16499 - protein, 7 aa, Artificial Sequence
  Synthetic construct
YIGFGDY

SEQ ID NO: 16500 - protein, 7 aa, Artificial Sequence
  Synthetic construct
YIGFGVF

SEQ ID NO: 16501 - protein, 7 aa, Artificial Sequence
  Synthetic construct
YIGFGVY

SEQ ID NO: 16502 - protein, 7 aa, Artificial Sequence
  Synthetic construct
YIGFAFF

SEQ ID NO: 16503 - protein, 7 aa, Artificial Sequence
  Synthetic construct
YIGFAFY

SEQ ID NO: 16504 - protein, 7 aa, Artificial Sequence
  Synthetic construct
YIGFARF

SEQ ID NO: 16505 - protein, 7 aa, Artificial Sequence
  Synthetic construct
YIGFARY

SEQ ID NO: 16506 - protein, 7 aa, Artificial Sequence
  Synthetic construct
YIGFACF

SEQ ID NO: 16507 - protein, 7 aa, Artificial Sequence
  Synthetic construct
YIGFACY

SEQ ID NO: 16508 - protein, 7 aa, Artificial Sequence
  Synthetic construct
YIGFALF

SEQ ID NO: 16509 - protein, 7 aa, Artificial Sequence
  Synthetic construct
YIGFALY

SEQ ID NO: 16510 - protein, 7 aa, Artificial Sequence
  Synthetic construct
YIGFAAF

SEQ ID NO: 16511 - protein, 7 aa, Artificial Sequence
  Synthetic construct
YIGFAAY

SEQ ID NO: 16512 - protein, 7 aa, Artificial Sequence
  Synthetic construct
YIGFAQF

SEQ ID NO: 16513 - protein, 7 aa, Artificial Sequence
  Synthetic construct
YIGFAQY

SEQ ID NO: 16514 - protein, 7 aa, Artificial Sequence
  Synthetic construct
YIGFADF

SEQ ID NO: 16515 - protein, 7 aa, Artificial Sequence
  Synthetic construct
YIGFADY

SEQ ID NO: 16516 - protein, 7 aa, Artificial Sequence
  Synthetic construct
YIGFAVF

SEQ ID NO: 16517 - protein, 7 aa, Artificial Sequence
  Synthetic construct
YIGFAVY

SEQ ID NO: 16518 - protein, 7 aa, Artificial Sequence
  Synthetic construct
YIGFQFF

SEQ ID NO: 16519 - protein, 7 aa, Artificial Sequence
  Synthetic construct
YIGFQFY

SEQ ID NO: 16520 - protein, 7 aa, Artificial Sequence
  Synthetic construct
YIGFQRF

SEQ ID NO: 16521 - protein, 7 aa, Artificial Sequence
  Synthetic construct
YIGFQRY

SEQ ID NO: 16522 - protein, 7 aa, Artificial Sequence
  Synthetic construct
YIGFQCF

SEQ ID NO: 16523 - protein, 7 aa, Artificial Sequence
  Synthetic construct
YIGFQCY

SEQ ID NO: 16524 - protein, 7 aa, Artificial Sequence
  Synthetic construct
YIGFQLF

SEQ ID NO: 16525 - protein, 7 aa, Artificial Sequence
  Synthetic construct
YIGFQLY

SEQ ID NO: 16526 - protein, 7 aa, Artificial Sequence
  Synthetic construct
YIGFQAF

SEQ ID NO: 16527 - protein, 7 aa, Artificial Sequence
  Synthetic construct
YIGFQAY

SEQ ID NO: 16528 - protein, 7 aa, Artificial Sequence
  Synthetic construct
YIGFQQF

SEQ ID NO: 16529 - protein, 7 aa, Artificial Sequence
  Synthetic construct
YIGFQQY

SEQ ID NO: 16530 - protein, 7 aa, Artificial Sequence
  Synthetic construct
YIGFQDF

SEQ ID NO: 16531 - protein, 7 aa, Artificial Sequence
  Synthetic construct
YIGFQDY

SEQ ID NO: 16532 - protein, 7 aa, Artificial Sequence
  Synthetic construct
YIGFQVF

SEQ ID NO: 16533 - protein, 7 aa, Artificial Sequence
  Synthetic construct
YIGFQVY

SEQ ID NO: 16534 - protein, 7 aa, Artificial Sequence
  Synthetic construct
YFIYIFF

SEQ ID NO: 16535 - protein, 7 aa, Artificial Sequence
  Synthetic construct
YFIYIFY

SEQ ID NO: 16536 - protein, 7 aa, Artificial Sequence
  Synthetic construct
YFIYIRF

SEQ ID NO: 16537 - protein, 7 aa, Artificial Sequence
  Synthetic construct
YFIYIRY

SEQ ID NO: 16538 - protein, 7 aa, Artificial Sequence
  Synthetic construct
YFIYICF

SEQ ID NO: 16539 - protein, 7 aa, Artificial Sequence
  Synthetic construct
YFIYICY

SEQ ID NO: 16540 - protein, 7 aa, Artificial Sequence
  Synthetic construct
YFIYILF

SEQ ID NO: 16541 - protein, 7 aa, Artificial Sequence
  Synthetic construct
YFIYILY

SEQ ID NO: 16542 - protein, 7 aa, Artificial Sequence
  Synthetic construct
YFIYIAF

SEQ ID NO: 16543 - protein, 7 aa, Artificial Sequence
  Synthetic construct
YFIYIAY

SEQ ID NO: 16544 - protein, 7 aa, Artificial Sequence
  Synthetic construct
YFIYIQF

SEQ ID NO: 16545 - protein, 7 aa, Artificial Sequence
  Synthetic construct
YFIYIQY

SEQ ID NO: 16546 - protein, 7 aa, Artificial Sequence
  Synthetic construct
YFIYIDF

SEQ ID NO: 16547 - protein, 7 aa, Artificial Sequence
  Synthetic construct
YFIYIDY

SEQ ID NO: 16548 - protein, 7 aa, Artificial Sequence
  Synthetic construct
YFIYIVF

SEQ ID NO: 16549 - protein, 7 aa, Artificial Sequence
  Synthetic construct
YFIYIVY

SEQ ID NO: 16550 - protein, 7 aa, Artificial Sequence
  Synthetic construct
YFIYDFF

SEQ ID NO: 16551 - protein, 7 aa, Artificial Sequence
  Synthetic construct
YFIYDFY

SEQ ID NO: 16552 - protein, 7 aa, Artificial Sequence
  Synthetic construct
YFIYDRF

SEQ ID NO: 16553 - protein, 7 aa, Artificial Sequence
  Synthetic construct
YFIYDRY

SEQ ID NO: 16554 - protein, 7 aa, Artificial Sequence
  Synthetic construct
YFIYDCF

SEQ ID NO: 16555 - protein, 7 aa, Artificial Sequence
  Synthetic construct
YFIYDCY

SEQ ID NO: 16556 - protein, 7 aa, Artificial Sequence
  Synthetic construct
YFIYDLF

SEQ ID NO: 16557 - protein, 7 aa, Artificial Sequence
  Synthetic construct
YFIYDLY

SEQ ID NO: 16558 - protein, 7 aa, Artificial Sequence
  Synthetic construct
YFIYDAF

SEQ ID NO: 16559 - protein, 7 aa, Artificial Sequence
  Synthetic construct
YFIYDAY

SEQ ID NO: 16560 - protein, 7 aa, Artificial Sequence
  Synthetic construct
YFIYDQF

SEQ ID NO: 16561 - protein, 7 aa, Artificial Sequence
  Synthetic construct
YFIYDQY

SEQ ID NO: 16562 - protein, 7 aa, Artificial Sequence
  Synthetic construct
YFIYDDF

SEQ ID NO: 16563 - protein, 7 aa, Artificial Sequence
  Synthetic construct
YFIYDDY

SEQ ID NO: 16564 - protein, 7 aa, Artificial Sequence
  Synthetic construct
YFIYDVF

SEQ ID NO: 16565 - protein, 7 aa, Artificial Sequence
  Synthetic construct
YFIYDVY

SEQ ID NO: 16566 - protein, 7 aa, Artificial Sequence
  Synthetic construct
YFIYYFF

SEQ ID NO: 16567 - protein, 7 aa, Artificial Sequence
  Synthetic construct
YFIYYFY

SEQ ID NO: 16568 - protein, 7 aa, Artificial Sequence
  Synthetic construct
YFIYYRF

SEQ ID NO: 16569 - protein, 7 aa, Artificial Sequence
  Synthetic construct
YFIYYRY

SEQ ID NO: 16570 - protein, 7 aa, Artificial Sequence
  Synthetic construct
YFIYYCF

SEQ ID NO: 16571 - protein, 7 aa, Artificial Sequence
  Synthetic construct
YFIYYCY

SEQ ID NO: 16572 - protein, 7 aa, Artificial Sequence
  Synthetic construct
YFIYYLF

SEQ ID NO: 16573 - protein, 7 aa, Artificial Sequence
  Synthetic construct
YFIYYLY

SEQ ID NO: 16574 - protein, 7 aa, Artificial Sequence
  Synthetic construct
YFIYYAF

SEQ ID NO: 16575 - protein, 7 aa, Artificial Sequence
  Synthetic construct
YFIYYAY

SEQ ID NO: 16576 - protein, 7 aa, Artificial Sequence
  Synthetic construct
YFIYYQF

SEQ ID NO: 16577 - protein, 7 aa, Artificial Sequence
  Synthetic construct
YFIYYQY

SEQ ID NO: 16578 - protein, 7 aa, Artificial Sequence
  Synthetic construct
YFIYYDF

SEQ ID NO: 16579 - protein, 7 aa, Artificial Sequence
  Synthetic construct
YFIYYDY

SEQ ID NO: 16580 - protein, 7 aa, Artificial Sequence
  Synthetic construct
YFIYYVF

SEQ ID NO: 16581 - protein, 7 aa, Artificial Sequence
  Synthetic construct
YFIYYVY

SEQ ID NO: 16582 - protein, 7 aa, Artificial Sequence
  Synthetic construct
YFIYFFF

SEQ ID NO: 16583 - protein, 7 aa, Artificial Sequence
  Synthetic construct
YFIYFFY

SEQ ID NO: 16584 - protein, 7 aa, Artificial Sequence
  Synthetic construct
YFIYFRF

SEQ ID NO: 16585 - protein, 7 aa, Artificial Sequence
  Synthetic construct
YFIYFRY

SEQ ID NO: 16586 - protein, 7 aa, Artificial Sequence
  Synthetic construct
YFIYFCF

SEQ ID NO: 16587 - protein, 7 aa, Artificial Sequence
  Synthetic construct
YFIYFCY

SEQ ID NO: 16588 - protein, 7 aa, Artificial Sequence
  Synthetic construct
YFIYFLF

SEQ ID NO: 16589 - protein, 7 aa, Artificial Sequence
  Synthetic construct
YFIYFLY

SEQ ID NO: 16590 - protein, 7 aa, Artificial Sequence
  Synthetic construct
YFIYFAF

SEQ ID NO: 16591 - protein, 7 aa, Artificial Sequence
  Synthetic construct
YFIYFAY

SEQ ID NO: 16592 - protein, 7 aa, Artificial Sequence
  Synthetic construct
YFIYFQF

SEQ ID NO: 16593 - protein, 7 aa, Artificial Sequence
  Synthetic construct
YFIYFQY

SEQ ID NO: 16594 - protein, 7 aa, Artificial Sequence
  Synthetic construct
YFIYFDF

SEQ ID NO: 16595 - protein, 7 aa, Artificial Sequence
  Synthetic construct
YFIYFDY

SEQ ID NO: 16596 - protein, 7 aa, Artificial Sequence
  Synthetic construct
YFIYFVF

SEQ ID NO: 16597 - protein, 7 aa, Artificial Sequence
  Synthetic construct
YFIYFVY

SEQ ID NO: 16598 - protein, 7 aa, Artificial Sequence
  Synthetic construct
YFIYVFF

SEQ ID NO: 16599 - protein, 7 aa, Artificial Sequence
  Synthetic construct
YFIYVFY

SEQ ID NO: 16600 - protein, 7 aa, Artificial Sequence
  Synthetic construct
YFIYVRF

SEQ ID NO: 16601 - protein, 7 aa, Artificial Sequence
  Synthetic construct
YFIYVRY

SEQ ID NO: 16602 - protein, 7 aa, Artificial Sequence
  Synthetic construct
YFIYVCF

SEQ ID NO: 16603 - protein, 7 aa, Artificial Sequence
  Synthetic construct
YFIYVCY

SEQ ID NO: 16604 - protein, 7 aa, Artificial Sequence
  Synthetic construct
YFIYVLF

SEQ ID NO: 16605 - protein, 7 aa, Artificial Sequence
  Synthetic construct
YFIYVLY

SEQ ID NO: 16606 - protein, 7 aa, Artificial Sequence
  Synthetic construct
YFIYVAF

SEQ ID NO: 16607 - protein, 7 aa, Artificial Sequence
  Synthetic construct
YFIYVAY

SEQ ID NO: 16608 - protein, 7 aa, Artificial Sequence
  Synthetic construct
YFIYVQF

SEQ ID NO: 16609 - protein, 7 aa, Artificial Sequence
  Synthetic construct
YFIYVQY

SEQ ID NO: 16610 - protein, 7 aa, Artificial Sequence
  Synthetic construct
YFIYVDF

SEQ ID NO: 16611 - protein, 7 aa, Artificial Sequence
  Synthetic construct
YFIYVDY

SEQ ID NO: 16612 - protein, 7 aa, Artificial Sequence
  Synthetic construct
YFIYVVF

SEQ ID NO: 16613 - protein, 7 aa, Artificial Sequence
  Synthetic construct
YFIYVVY

SEQ ID NO: 16614 - protein, 7 aa, Artificial Sequence
  Synthetic construct
YFIYTFF

SEQ ID NO: 16615 - protein, 7 aa, Artificial Sequence
  Synthetic construct
YFIYTFY

SEQ ID NO: 16616 - protein, 7 aa, Artificial Sequence
  Synthetic construct
YFIYTRF

SEQ ID NO: 16617 - protein, 7 aa, Artificial Sequence
  Synthetic construct
YFIYTRY

SEQ ID NO: 16618 - protein, 7 aa, Artificial Sequence
  Synthetic construct
YFIYTCF

SEQ ID NO: 16619 - protein, 7 aa, Artificial Sequence
  Synthetic construct
YFIYTCY

SEQ ID NO: 16620 - protein, 7 aa, Artificial Sequence
  Synthetic construct
YFIYTLF

SEQ ID NO: 16621 - protein, 7 aa, Artificial Sequence
  Synthetic construct
YFIYTLY

SEQ ID NO: 16622 - protein, 7 aa, Artificial Sequence
  Synthetic construct
YFIYTAF

SEQ ID NO: 16623 - protein, 7 aa, Artificial Sequence
  Synthetic construct
YFIYTAY

SEQ ID NO: 16624 - protein, 7 aa, Artificial Sequence
  Synthetic construct
YFIYTQF

SEQ ID NO: 16625 - protein, 7 aa, Artificial Sequence
  Synthetic construct
YFIYTQY

SEQ ID NO: 16626 - protein, 7 aa, Artificial Sequence
  Synthetic construct
YFIYTDF

SEQ ID NO: 16627 - protein, 7 aa, Artificial Sequence
  Synthetic construct
YFIYTDY

SEQ ID NO: 16628 - protein, 7 aa, Artificial Sequence
  Synthetic construct
YFIYTVF

SEQ ID NO: 16629 - protein, 7 aa, Artificial Sequence
  Synthetic construct
YFIYTVY

SEQ ID NO: 16630 - protein, 7 aa, Artificial Sequence
  Synthetic construct
YFIYGFF

SEQ ID NO: 16631 - protein, 7 aa, Artificial Sequence
  Synthetic construct
YFIYGFY

SEQ ID NO: 16632 - protein, 7 aa, Artificial Sequence
  Synthetic construct
YFIYGRF

SEQ ID NO: 16633 - protein, 7 aa, Artificial Sequence
  Synthetic construct
YFIYGRY

SEQ ID NO: 16634 - protein, 7 aa, Artificial Sequence
  Synthetic construct
YFIYGCF

SEQ ID NO: 16635 - protein, 7 aa, Artificial Sequence
  Synthetic construct
YFIYGCY

SEQ ID NO: 16636 - protein, 7 aa, Artificial Sequence
  Synthetic construct
YFIYGLF

SEQ ID NO: 16637 - protein, 7 aa, Artificial Sequence
  Synthetic construct
YFIYGLY

SEQ ID NO: 16638 - protein, 7 aa, Artificial Sequence
  Synthetic construct
YFIYGAF

SEQ ID NO: 16639 - protein, 7 aa, Artificial Sequence
  Synthetic construct
YFIYGAY

SEQ ID NO: 16640 - protein, 7 aa, Artificial Sequence
  Synthetic construct
YFIYGQF

SEQ ID NO: 16641 - protein, 7 aa, Artificial Sequence
  Synthetic construct
YFIYGQY

SEQ ID NO: 16642 - protein, 7 aa, Artificial Sequence
  Synthetic construct
YFIYGDF

SEQ ID NO: 16643 - protein, 7 aa, Artificial Sequence
  Synthetic construct
YFIYGDY

SEQ ID NO: 16644 - protein, 7 aa, Artificial Sequence
  Synthetic construct
YFIYGVF

SEQ ID NO: 16645 - protein, 7 aa, Artificial Sequence
  Synthetic construct
YFIYGVY

SEQ ID NO: 16646 - protein, 7 aa, Artificial Sequence
  Synthetic construct
YFIYAFF

SEQ ID NO: 16647 - protein, 7 aa, Artificial Sequence
  Synthetic construct
YFIYAFY

SEQ ID NO: 16648 - protein, 7 aa, Artificial Sequence
  Synthetic construct
YFIYARF

SEQ ID NO: 16649 - protein, 7 aa, Artificial Sequence
  Synthetic construct
YFIYARY

SEQ ID NO: 16650 - protein, 7 aa, Artificial Sequence
  Synthetic construct
YFIYACF

SEQ ID NO: 16651 - protein, 7 aa, Artificial Sequence
  Synthetic construct
YFIYACY

SEQ ID NO: 16652 - protein, 7 aa, Artificial Sequence
  Synthetic construct
YFIYALF

SEQ ID NO: 16653 - protein, 7 aa, Artificial Sequence
  Synthetic construct
YFIYALY

SEQ ID NO: 16654 - protein, 7 aa, Artificial Sequence
  Synthetic construct
YFIYAAF

SEQ ID NO: 16655 - protein, 7 aa, Artificial Sequence
  Synthetic construct
YFIYAAY

SEQ ID NO: 16656 - protein, 7 aa, Artificial Sequence
  Synthetic construct
YFIYAQF

SEQ ID NO: 16657 - protein, 7 aa, Artificial Sequence
  Synthetic construct
YFIYAQY

SEQ ID NO: 16658 - protein, 7 aa, Artificial Sequence
  Synthetic construct
YFIYADF

SEQ ID NO: 16659 - protein, 7 aa, Artificial Sequence
  Synthetic construct
YFIYADY

SEQ ID NO: 16660 - protein, 7 aa, Artificial Sequence
  Synthetic construct
YFIYAVF

SEQ ID NO: 16661 - protein, 7 aa, Artificial Sequence
  Synthetic construct
YFIYAVY

SEQ ID NO: 16662 - protein, 7 aa, Artificial Sequence
  Synthetic construct
YFIYQFF

SEQ ID NO: 16663 - protein, 7 aa, Artificial Sequence
  Synthetic construct
YFIYQFY

SEQ ID NO: 16664 - protein, 7 aa, Artificial Sequence
  Synthetic construct
YFIYQRF

SEQ ID NO: 16665 - protein, 7 aa, Artificial Sequence
  Synthetic construct
YFIYQRY

SEQ ID NO: 16666 - protein, 7 aa, Artificial Sequence
  Synthetic construct
YFIYQCF

SEQ ID NO: 16667 - protein, 7 aa, Artificial Sequence
  Synthetic construct
YFIYQCY

SEQ ID NO: 16668 - protein, 7 aa, Artificial Sequence
  Synthetic construct
YFIYQLF

SEQ ID NO: 16669 - protein, 7 aa, Artificial Sequence
  Synthetic construct
YFIYQLY

SEQ ID NO: 16670 - protein, 7 aa, Artificial Sequence
  Synthetic construct
YFIYQAF

SEQ ID NO: 16671 - protein, 7 aa, Artificial Sequence
  Synthetic construct
YFIYQAY

SEQ ID NO: 16672 - protein, 7 aa, Artificial Sequence
  Synthetic construct
YFIYQQF

SEQ ID NO: 16673 - protein, 7 aa, Artificial Sequence
  Synthetic construct
YFIYQQY

SEQ ID NO: 16674 - protein, 7 aa, Artificial Sequence
  Synthetic construct
YFIYQDF

SEQ ID NO: 16675 - protein, 7 aa, Artificial Sequence
  Synthetic construct
YFIYQDY

SEQ ID NO: 16676 - protein, 7 aa, Artificial Sequence
  Synthetic construct
YFIYQVF

SEQ ID NO: 16677 - protein, 7 aa, Artificial Sequence
  Synthetic construct
YFIYQVY

SEQ ID NO: 16678 - protein, 7 aa, Artificial Sequence
  Synthetic construct
YFIPIFF

SEQ ID NO: 16679 - protein, 7 aa, Artificial Sequence
  Synthetic construct
YFIPIFY

SEQ ID NO: 16680 - protein, 7 aa, Artificial Sequence
  Synthetic construct
YFIPIRF

SEQ ID NO: 16681 - protein, 7 aa, Artificial Sequence
  Synthetic construct
YFIPIRY

SEQ ID NO: 16682 - protein, 7 aa, Artificial Sequence
  Synthetic construct
YFIPICF

SEQ ID NO: 16683 - protein, 7 aa, Artificial Sequence
  Synthetic construct
YFIPICY

SEQ ID NO: 16684 - protein, 7 aa, Artificial Sequence
  Synthetic construct
YFIPILF

SEQ ID NO: 16685 - protein, 7 aa, Artificial Sequence
  Synthetic construct
YFIPILY

SEQ ID NO: 16686 - protein, 7 aa, Artificial Sequence
  Synthetic construct
YFIPIAF

SEQ ID NO: 16687 - protein, 7 aa, Artificial Sequence
  Synthetic construct
YFIPIAY

SEQ ID NO: 16688 - protein, 7 aa, Artificial Sequence
  Synthetic construct
YFIPIQF

SEQ ID NO: 16689 - protein, 7 aa, Artificial Sequence
  Synthetic construct
YFIPIQY

SEQ ID NO: 16690 - protein, 7 aa, Artificial Sequence
  Synthetic construct
YFIPIDF

SEQ ID NO: 16691 - protein, 7 aa, Artificial Sequence
  Synthetic construct
YFIPIDY

SEQ ID NO: 16692 - protein, 7 aa, Artificial Sequence
  Synthetic construct
YFIPIVF

SEQ ID NO: 16693 - protein, 7 aa, Artificial Sequence
  Synthetic construct
YFIPIVY

SEQ ID NO: 16694 - protein, 7 aa, Artificial Sequence
  Synthetic construct
YFIPDFF

SEQ ID NO: 16695 - protein, 7 aa, Artificial Sequence
  Synthetic construct
YFIPDFY

SEQ ID NO: 16696 - protein, 7 aa, Artificial Sequence
  Synthetic construct
YFIPDRF

SEQ ID NO: 16697 - protein, 7 aa, Artificial Sequence
  Synthetic construct
YFIPDRY

SEQ ID NO: 16698 - protein, 7 aa, Artificial Sequence
  Synthetic construct
YFIPDCF

SEQ ID NO: 16699 - protein, 7 aa, Artificial Sequence
  Synthetic construct
YFIPDCY

SEQ ID NO: 16700 - protein, 7 aa, Artificial Sequence
  Synthetic construct
YFIPDLF

SEQ ID NO: 16701 - protein, 7 aa, Artificial Sequence
  Synthetic construct
YFIPDLY

SEQ ID NO: 16702 - protein, 7 aa, Artificial Sequence
  Synthetic construct
YFIPDAF

SEQ ID NO: 16703 - protein, 7 aa, Artificial Sequence
  Synthetic construct
YFIPDAY

SEQ ID NO: 16704 - protein, 7 aa, Artificial Sequence
  Synthetic construct
YFIPDQF

SEQ ID NO: 16705 - protein, 7 aa, Artificial Sequence
  Synthetic construct
YFIPDQY

SEQ ID NO: 16706 - protein, 7 aa, Artificial Sequence
  Synthetic construct
YFIPDDF

SEQ ID NO: 16707 - protein, 7 aa, Artificial Sequence
  Synthetic construct
YFIPDDY

SEQ ID NO: 16708 - protein, 7 aa, Artificial Sequence
  Synthetic construct
YFIPDVF

SEQ ID NO: 16709 - protein, 7 aa, Artificial Sequence
  Synthetic construct
YFIPDVY

SEQ ID NO: 16710 - protein, 7 aa, Artificial Sequence
  Synthetic construct
YFIPYFF

SEQ ID NO: 16711 - protein, 7 aa, Artificial Sequence
  Synthetic construct
YFIPYFY

SEQ ID NO: 16712 - protein, 7 aa, Artificial Sequence
  Synthetic construct
YFIPYRF

SEQ ID NO: 16713 - protein, 7 aa, Artificial Sequence
  Synthetic construct
YFIPYRY

SEQ ID NO: 16714 - protein, 7 aa, Artificial Sequence
  Synthetic construct
YFIPYCF

SEQ ID NO: 16715 - protein, 7 aa, Artificial Sequence
  Synthetic construct
YFIPYCY

SEQ ID NO: 16716 - protein, 7 aa, Artificial Sequence
  Synthetic construct
YFIPYLF

SEQ ID NO: 16717 - protein, 7 aa, Artificial Sequence
  Synthetic construct
YFIPYLY

SEQ ID NO: 16718 - protein, 7 aa, Artificial Sequence
  Synthetic construct
YFIPYAF

SEQ ID NO: 16719 - protein, 7 aa, Artificial Sequence
  Synthetic construct
YFIPYAY

SEQ ID NO: 16720 - protein, 7 aa, Artificial Sequence
  Synthetic construct
YFIPYQF

SEQ ID NO: 16721 - protein, 7 aa, Artificial Sequence
  Synthetic construct
YFIPYQY

SEQ ID NO: 16722 - protein, 7 aa, Artificial Sequence
  Synthetic construct
YFIPYDF

SEQ ID NO: 16723 - protein, 7 aa, Artificial Sequence
  Synthetic construct
YFIPYDY

SEQ ID NO: 16724 - protein, 7 aa, Artificial Sequence
  Synthetic construct
YFIPYVF

SEQ ID NO: 16725 - protein, 7 aa, Artificial Sequence
  Synthetic construct
YFIPYVY

SEQ ID NO: 16726 - protein, 7 aa, Artificial Sequence
  Synthetic construct
YFIPFFF

SEQ ID NO: 16727 - protein, 7 aa, Artificial Sequence
  Synthetic construct
YFIPFFY

SEQ ID NO: 16728 - protein, 7 aa, Artificial Sequence
  Synthetic construct
YFIPFRF

SEQ ID NO: 16729 - protein, 7 aa, Artificial Sequence
  Synthetic construct
YFIPFRY

SEQ ID NO: 16730 - protein, 7 aa, Artificial Sequence
  Synthetic construct
YFIPFCF

SEQ ID NO: 16731 - protein, 7 aa, Artificial Sequence
  Synthetic construct
YFIPFCY

SEQ ID NO: 16732 - protein, 7 aa, Artificial Sequence
  Synthetic construct
YFIPFLF

SEQ ID NO: 16733 - protein, 7 aa, Artificial Sequence
  Synthetic construct
YFIPFLY

SEQ ID NO: 16734 - protein, 7 aa, Artificial Sequence
  Synthetic construct
YFIPFAF

SEQ ID NO: 16735 - protein, 7 aa, Artificial Sequence
  Synthetic construct
YFIPFAY

SEQ ID NO: 16736 - protein, 7 aa, Artificial Sequence
  Synthetic construct
YFIPFQF

SEQ ID NO: 16737 - protein, 7 aa, Artificial Sequence
  Synthetic construct
YFIPFQY

SEQ ID NO: 16738 - protein, 7 aa, Artificial Sequence
  Synthetic construct
YFIPFDF

SEQ ID NO: 16739 - protein, 7 aa, Artificial Sequence
  Synthetic construct
YFIPFDY

SEQ ID NO: 16740 - protein, 7 aa, Artificial Sequence
  Synthetic construct
YFIPFVF

SEQ ID NO: 16741 - protein, 7 aa, Artificial Sequence
  Synthetic construct
YFIPFVY

SEQ ID NO: 16742 - protein, 7 aa, Artificial Sequence
  Synthetic construct
YFIPVFF

SEQ ID NO: 16743 - protein, 7 aa, Artificial Sequence
  Synthetic construct
YFIPVFY

SEQ ID NO: 16744 - protein, 7 aa, Artificial Sequence
  Synthetic construct
YFIPVRF

SEQ ID NO: 16745 - protein, 7 aa, Artificial Sequence
  Synthetic construct
YFIPVRY

SEQ ID NO: 16746 - protein, 7 aa, Artificial Sequence
  Synthetic construct
YFIPVCF

SEQ ID NO: 16747 - protein, 7 aa, Artificial Sequence
  Synthetic construct
YFIPVCY

SEQ ID NO: 16748 - protein, 7 aa, Artificial Sequence
  Synthetic construct
YFIPVLF

SEQ ID NO: 16749 - protein, 7 aa, Artificial Sequence
  Synthetic construct
YFIPVLY

SEQ ID NO: 16750 - protein, 7 aa, Artificial Sequence
  Synthetic construct
YFIPVAF

SEQ ID NO: 16751 - protein, 7 aa, Artificial Sequence
  Synthetic construct
YFIPVAY

SEQ ID NO: 16752 - protein, 7 aa, Artificial Sequence
  Synthetic construct
YFIPVQF

SEQ ID NO: 16753 - protein, 7 aa, Artificial Sequence
  Synthetic construct
YFIPVQY

SEQ ID NO: 16754 - protein, 7 aa, Artificial Sequence
  Synthetic construct
YFIPVDF

SEQ ID NO: 16755 - protein, 7 aa, Artificial Sequence
  Synthetic construct
YFIPVDY

SEQ ID NO: 16756 - protein, 7 aa, Artificial Sequence
  Synthetic construct
YFIPVVF

SEQ ID NO: 16757 - protein, 7 aa, Artificial Sequence
  Synthetic construct
YFIPVVY

SEQ ID NO: 16758 - protein, 7 aa, Artificial Sequence
  Synthetic construct
YFIPTFF

SEQ ID NO: 16759 - protein, 7 aa, Artificial Sequence
  Synthetic construct
YFIPTFY

SEQ ID NO: 16760 - protein, 7 aa, Artificial Sequence
  Synthetic construct
YFIPTRF

SEQ ID NO: 16761 - protein, 7 aa, Artificial Sequence
  Synthetic construct
YFIPTRY

SEQ ID NO: 16762 - protein, 7 aa, Artificial Sequence
  Synthetic construct
YFIPTCF

SEQ ID NO: 16763 - protein, 7 aa, Artificial Sequence
  Synthetic construct
YFIPTCY

SEQ ID NO: 16764 - protein, 7 aa, Artificial Sequence
  Synthetic construct
YFIPTLF

SEQ ID NO: 16765 - protein, 7 aa, Artificial Sequence
  Synthetic construct
YFIPTLY

SEQ ID NO: 16766 - protein, 7 aa, Artificial Sequence
  Synthetic construct
YFIPTAF

SEQ ID NO: 16767 - protein, 7 aa, Artificial Sequence
  Synthetic construct
YFIPTAY

SEQ ID NO: 16768 - protein, 7 aa, Artificial Sequence
  Synthetic construct
YFIPTQF

SEQ ID NO: 16769 - protein, 7 aa, Artificial Sequence
  Synthetic construct
YFIPTQY

SEQ ID NO: 16770 - protein, 7 aa, Artificial Sequence
  Synthetic construct
YFIPTDF

SEQ ID NO: 16771 - protein, 7 aa, Artificial Sequence
  Synthetic construct
YFIPTDY

SEQ ID NO: 16772 - protein, 7 aa, Artificial Sequence
  Synthetic construct
YFIPTVF

SEQ ID NO: 16773 - protein, 7 aa, Artificial Sequence
  Synthetic construct
YFIPTVY

SEQ ID NO: 16774 - protein, 7 aa, Artificial Sequence
  Synthetic construct
YFIPGFF

SEQ ID NO: 16775 - protein, 7 aa, Artificial Sequence
  Synthetic construct
YFIPGFY

SEQ ID NO: 16776 - protein, 7 aa, Artificial Sequence
  Synthetic construct
YFIPGRF

SEQ ID NO: 16777 - protein, 7 aa, Artificial Sequence
  Synthetic construct
YFIPGRY

SEQ ID NO: 16778 - protein, 7 aa, Artificial Sequence
  Synthetic construct
YFIPGCF

SEQ ID NO: 16779 - protein, 7 aa, Artificial Sequence
  Synthetic construct
YFIPGCY

SEQ ID NO: 16780 - protein, 7 aa, Artificial Sequence
  Synthetic construct
YFIPGLF

SEQ ID NO: 16781 - protein, 7 aa, Artificial Sequence
  Synthetic construct
YFIPGLY

SEQ ID NO: 16782 - protein, 7 aa, Artificial Sequence
  Synthetic construct
YFIPGAF

SEQ ID NO: 16783 - protein, 7 aa, Artificial Sequence
  Synthetic construct
YFIPGAY

SEQ ID NO: 16784 - protein, 7 aa, Artificial Sequence
  Synthetic construct
YFIPGQF

SEQ ID NO: 16785 - protein, 7 aa, Artificial Sequence
  Synthetic construct
YFIPGQY

SEQ ID NO: 16786 - protein, 7 aa, Artificial Sequence
  Synthetic construct
YFIPGDF

SEQ ID NO: 16787 - protein, 7 aa, Artificial Sequence
  Synthetic construct
YFIPGDY

SEQ ID NO: 16788 - protein, 7 aa, Artificial Sequence
  Synthetic construct
YFIPGVF

SEQ ID NO: 16789 - protein, 7 aa, Artificial Sequence
  Synthetic construct
YFIPGVY

SEQ ID NO: 16790 - protein, 7 aa, Artificial Sequence
  Synthetic construct
YFIPAFF

SEQ ID NO: 16791 - protein, 7 aa, Artificial Sequence
  Synthetic construct
YFIPAFY

SEQ ID NO: 16792 - protein, 7 aa, Artificial Sequence
  Synthetic construct
YFIPARF

SEQ ID NO: 16793 - protein, 7 aa, Artificial Sequence
  Synthetic construct
YFIPARY

SEQ ID NO: 16794 - protein, 7 aa, Artificial Sequence
  Synthetic construct
YFIPACF

SEQ ID NO: 16795 - protein, 7 aa, Artificial Sequence
  Synthetic construct
YFIPACY

SEQ ID NO: 16796 - protein, 7 aa, Artificial Sequence
  Synthetic construct
YFIPALF

SEQ ID NO: 16797 - protein, 7 aa, Artificial Sequence
  Synthetic construct
YFIPALY

SEQ ID NO: 16798 - protein, 7 aa, Artificial Sequence
  Synthetic construct
YFIPAAF

SEQ ID NO: 16799 - protein, 7 aa, Artificial Sequence
  Synthetic construct
YFIPAAY

SEQ ID NO: 16800 - protein, 7 aa, Artificial Sequence
  Synthetic construct
YFIPAQF

SEQ ID NO: 16801 - protein, 7 aa, Artificial Sequence
  Synthetic construct
YFIPAQY

SEQ ID NO: 16802 - protein, 7 aa, Artificial Sequence
  Synthetic construct
YFIPADF

SEQ ID NO: 16803 - protein, 7 aa, Artificial Sequence
  Synthetic construct
YFIPADY

SEQ ID NO: 16804 - protein, 7 aa, Artificial Sequence
  Synthetic construct
YFIPAVF

SEQ ID NO: 16805 - protein, 7 aa, Artificial Sequence
  Synthetic construct
YFIPAVY

SEQ ID NO: 16806 - protein, 7 aa, Artificial Sequence
  Synthetic construct
YFIPQFF

SEQ ID NO: 16807 - protein, 7 aa, Artificial Sequence
  Synthetic construct
YFIPQFY

SEQ ID NO: 16808 - protein, 7 aa, Artificial Sequence
  Synthetic construct
YFIPQRF

SEQ ID NO: 16809 - protein, 7 aa, Artificial Sequence
  Synthetic construct
YFIPQRY

SEQ ID NO: 16810 - protein, 7 aa, Artificial Sequence
  Synthetic construct
YFIPQCF

SEQ ID NO: 16811 - protein, 7 aa, Artificial Sequence
  Synthetic construct
YFIPQCY

SEQ ID NO: 16812 - protein, 7 aa, Artificial Sequence
  Synthetic construct
YFIPQLF

SEQ ID NO: 16813 - protein, 7 aa, Artificial Sequence
  Synthetic construct
YFIPQLY

SEQ ID NO: 16814 - protein, 7 aa, Artificial Sequence
  Synthetic construct
YFIPQAF

SEQ ID NO: 16815 - protein, 7 aa, Artificial Sequence
  Synthetic construct
YFIPQAY

SEQ ID NO: 16816 - protein, 7 aa, Artificial Sequence
  Synthetic construct
YFIPQQF

SEQ ID NO: 16817 - protein, 7 aa, Artificial Sequence
  Synthetic construct
YFIPQQY

SEQ ID NO: 16818 - protein, 7 aa, Artificial Sequence
  Synthetic construct
YFIPQDF

SEQ ID NO: 16819 - protein, 7 aa, Artificial Sequence
  Synthetic construct
YFIPQDY

SEQ ID NO: 16820 - protein, 7 aa, Artificial Sequence
  Synthetic construct
YFIPQVF

SEQ ID NO: 16821 - protein, 7 aa, Artificial Sequence
  Synthetic construct
YFIPQVY

SEQ ID NO: 16822 - protein, 7 aa, Artificial Sequence
  Synthetic construct
YFIHIFF

SEQ ID NO: 16823 - protein, 7 aa, Artificial Sequence
  Synthetic construct
YFIHIFY

SEQ ID NO: 16824 - protein, 7 aa, Artificial Sequence
  Synthetic construct
YFIHIRF

SEQ ID NO: 16825 - protein, 7 aa, Artificial Sequence
  Synthetic construct
YFIHIRY

SEQ ID NO: 16826 - protein, 7 aa, Artificial Sequence
  Synthetic construct
YFIHICF

SEQ ID NO: 16827 - protein, 7 aa, Artificial Sequence
  Synthetic construct
YFIHICY

SEQ ID NO: 16828 - protein, 7 aa, Artificial Sequence
  Synthetic construct
YFIHILF

SEQ ID NO: 16829 - protein, 7 aa, Artificial Sequence
  Synthetic construct
YFIHILY

SEQ ID NO: 16830 - protein, 7 aa, Artificial Sequence
  Synthetic construct
YFIHIAF

SEQ ID NO: 16831 - protein, 7 aa, Artificial Sequence
  Synthetic construct
YFIHIAY

SEQ ID NO: 16832 - protein, 7 aa, Artificial Sequence
  Synthetic construct
YFIHIQF

SEQ ID NO: 16833 - protein, 7 aa, Artificial Sequence
  Synthetic construct
YFIHIQY

SEQ ID NO: 16834 - protein, 7 aa, Artificial Sequence
  Synthetic construct
YFIHIDF

SEQ ID NO: 16835 - protein, 7 aa, Artificial Sequence
  Synthetic construct
YFIHIDY

SEQ ID NO: 16836 - protein, 7 aa, Artificial Sequence
  Synthetic construct
YFIHIVF

SEQ ID NO: 16837 - protein, 7 aa, Artificial Sequence
  Synthetic construct
YFIHIVY

SEQ ID NO: 16838 - protein, 7 aa, Artificial Sequence
  Synthetic construct
YFIHDFF

SEQ ID NO: 16839 - protein, 7 aa, Artificial Sequence
  Synthetic construct
YFIHDFY

SEQ ID NO: 16840 - protein, 7 aa, Artificial Sequence
  Synthetic construct
YFIHDRF

SEQ ID NO: 16841 - protein, 7 aa, Artificial Sequence
  Synthetic construct
YFIHDRY

SEQ ID NO: 16842 - protein, 7 aa, Artificial Sequence
  Synthetic construct
YFIHDCF

SEQ ID NO: 16843 - protein, 7 aa, Artificial Sequence
  Synthetic construct
YFIHDCY

SEQ ID NO: 16844 - protein, 7 aa, Artificial Sequence
  Synthetic construct
YFIHDLF

SEQ ID NO: 16845 - protein, 7 aa, Artificial Sequence
  Synthetic construct
YFIHDLY

SEQ ID NO: 16846 - protein, 7 aa, Artificial Sequence
  Synthetic construct
YFIHDAF

SEQ ID NO: 16847 - protein, 7 aa, Artificial Sequence
  Synthetic construct
YFIHDAY

SEQ ID NO: 16848 - protein, 7 aa, Artificial Sequence
  Synthetic construct
YFIHDQF

SEQ ID NO: 16849 - protein, 7 aa, Artificial Sequence
  Synthetic construct
YFIHDQY

SEQ ID NO: 16850 - protein, 7 aa, Artificial Sequence
  Synthetic construct
YFIHDDF

SEQ ID NO: 16851 - protein, 7 aa, Artificial Sequence
  Synthetic construct
YFIHDDY

SEQ ID NO: 16852 - protein, 7 aa, Artificial Sequence
  Synthetic construct
YFIHDVF

SEQ ID NO: 16853 - protein, 7 aa, Artificial Sequence
  Synthetic construct
YFIHDVY

SEQ ID NO: 16854 - protein, 7 aa, Artificial Sequence
  Synthetic construct
YFIHYFF

SEQ ID NO: 16855 - protein, 7 aa, Artificial Sequence
  Synthetic construct
YFIHYFY

SEQ ID NO: 16856 - protein, 7 aa, Artificial Sequence
  Synthetic construct
YFIHYRF

SEQ ID NO: 16857 - protein, 7 aa, Artificial Sequence
  Synthetic construct
YFIHYRY

SEQ ID NO: 16858 - protein, 7 aa, Artificial Sequence
  Synthetic construct
YFIHYCF

SEQ ID NO: 16859 - protein, 7 aa, Artificial Sequence
  Synthetic construct
YFIHYCY

SEQ ID NO: 16860 - protein, 7 aa, Artificial Sequence
  Synthetic construct
YFIHYLF

SEQ ID NO: 16861 - protein, 7 aa, Artificial Sequence
  Synthetic construct
YFIHYLY

SEQ ID NO: 16862 - protein, 7 aa, Artificial Sequence
  Synthetic construct
YFIHYAF

SEQ ID NO: 16863 - protein, 7 aa, Artificial Sequence
  Synthetic construct
YFIHYAY

SEQ ID NO: 16864 - protein, 7 aa, Artificial Sequence
  Synthetic construct
YFIHYQF

SEQ ID NO: 16865 - protein, 7 aa, Artificial Sequence
  Synthetic construct
YFIHYQY

SEQ ID NO: 16866 - protein, 7 aa, Artificial Sequence
  Synthetic construct
YFIHYDF

SEQ ID NO: 16867 - protein, 7 aa, Artificial Sequence
  Synthetic construct
YFIHYDY

SEQ ID NO: 16868 - protein, 7 aa, Artificial Sequence
  Synthetic construct
YFIHYVF

SEQ ID NO: 16869 - protein, 7 aa, Artificial Sequence
  Synthetic construct
YFIHYVY

SEQ ID NO: 16870 - protein, 7 aa, Artificial Sequence
  Synthetic construct
YFIHFFF

SEQ ID NO: 16871 - protein, 7 aa, Artificial Sequence
  Synthetic construct
YFIHFFY

SEQ ID NO: 16872 - protein, 7 aa, Artificial Sequence
  Synthetic construct
YFIHFRF

SEQ ID NO: 16873 - protein, 7 aa, Artificial Sequence
  Synthetic construct
YFIHFRY

SEQ ID NO: 16874 - protein, 7 aa, Artificial Sequence
  Synthetic construct
YFIHFCF

SEQ ID NO: 16875 - protein, 7 aa, Artificial Sequence
  Synthetic construct
YFIHFCY

SEQ ID NO: 16876 - protein, 7 aa, Artificial Sequence
  Synthetic construct
YFIHFLF

SEQ ID NO: 16877 - protein, 7 aa, Artificial Sequence
  Synthetic construct
YFIHFLY

SEQ ID NO: 16878 - protein, 7 aa, Artificial Sequence
  Synthetic construct
YFIHFAF

SEQ ID NO: 16879 - protein, 7 aa, Artificial Sequence
  Synthetic construct
YFIHFAY

SEQ ID NO: 16880 - protein, 7 aa, Artificial Sequence
  Synthetic construct
YFIHFQF

SEQ ID NO: 16881 - protein, 7 aa, Artificial Sequence
  Synthetic construct
YFIHFQY

SEQ ID NO: 16882 - protein, 7 aa, Artificial Sequence
  Synthetic construct
YFIHFDF

SEQ ID NO: 16883 - protein, 7 aa, Artificial Sequence
  Synthetic construct
YFIHFDY

SEQ ID NO: 16884 - protein, 7 aa, Artificial Sequence
  Synthetic construct
YFIHFVF

SEQ ID NO: 16885 - protein, 7 aa, Artificial Sequence
  Synthetic construct
YFIHFVY

SEQ ID NO: 16886 - protein, 7 aa, Artificial Sequence
  Synthetic construct
YFIHVFF

SEQ ID NO: 16887 - protein, 7 aa, Artificial Sequence
  Synthetic construct
YFIHVFY

SEQ ID NO: 16888 - protein, 7 aa, Artificial Sequence
  Synthetic construct
YFIHVRF

SEQ ID NO: 16889 - protein, 7 aa, Artificial Sequence
  Synthetic construct
YFIHVRY

SEQ ID NO: 16890 - protein, 7 aa, Artificial Sequence
  Synthetic construct
YFIHVCF

SEQ ID NO: 16891 - protein, 7 aa, Artificial Sequence
  Synthetic construct
YFIHVCY

SEQ ID NO: 16892 - protein, 7 aa, Artificial Sequence
  Synthetic construct
YFIHVLF

SEQ ID NO: 16893 - protein, 7 aa, Artificial Sequence
  Synthetic construct
YFIHVLY

SEQ ID NO: 16894 - protein, 7 aa, Artificial Sequence
  Synthetic construct
YFIHVAF

SEQ ID NO: 16895 - protein, 7 aa, Artificial Sequence
  Synthetic construct
YFIHVAY

SEQ ID NO: 16896 - protein, 7 aa, Artificial Sequence
  Synthetic construct
YFIHVQF

SEQ ID NO: 16897 - protein, 7 aa, Artificial Sequence
  Synthetic construct
YFIHVQY

SEQ ID NO: 16898 - protein, 7 aa, Artificial Sequence
  Synthetic construct
YFIHVDF

SEQ ID NO: 16899 - protein, 7 aa, Artificial Sequence
  Synthetic construct
YFIHVDY

SEQ ID NO: 16900 - protein, 7 aa, Artificial Sequence
  Synthetic construct
YFIHVVF

SEQ ID NO: 16901 - protein, 7 aa, Artificial Sequence
  Synthetic construct
YFIHVVY

SEQ ID NO: 16902 - protein, 7 aa, Artificial Sequence
  Synthetic construct
YFIHTFF

SEQ ID NO: 16903 - protein, 7 aa, Artificial Sequence
  Synthetic construct
YFIHTFY

SEQ ID NO: 16904 - protein, 7 aa, Artificial Sequence
  Synthetic construct
YFIHTRF

SEQ ID NO: 16905 - protein, 7 aa, Artificial Sequence
  Synthetic construct
YFIHTRY

SEQ ID NO: 16906 - protein, 7 aa, Artificial Sequence
  Synthetic construct
YFIHTCF

SEQ ID NO: 16907 - protein, 7 aa, Artificial Sequence
  Synthetic construct
YFIHTCY

SEQ ID NO: 16908 - protein, 7 aa, Artificial Sequence
  Synthetic construct
YFIHTLF

SEQ ID NO: 16909 - protein, 7 aa, Artificial Sequence
  Synthetic construct
YFIHTLY

SEQ ID NO: 16910 - protein, 7 aa, Artificial Sequence
  Synthetic construct
YFIHTAF

SEQ ID NO: 16911 - protein, 7 aa, Artificial Sequence
  Synthetic construct
YFIHTAY

SEQ ID NO: 16912 - protein, 7 aa, Artificial Sequence
  Synthetic construct
YFIHTQF

SEQ ID NO: 16913 - protein, 7 aa, Artificial Sequence
  Synthetic construct
YFIHTQY

SEQ ID NO: 16914 - protein, 7 aa, Artificial Sequence
  Synthetic construct
YFIHTDF

SEQ ID NO: 16915 - protein, 7 aa, Artificial Sequence
  Synthetic construct
YFIHTDY

SEQ ID NO: 16916 - protein, 7 aa, Artificial Sequence
  Synthetic construct
YFIHTVF

SEQ ID NO: 16917 - protein, 7 aa, Artificial Sequence
  Synthetic construct
YFIHTVY

SEQ ID NO: 16918 - protein, 7 aa, Artificial Sequence
  Synthetic construct
YFIHGFF

SEQ ID NO: 16919 - protein, 7 aa, Artificial Sequence
  Synthetic construct
YFIHGFY

SEQ ID NO: 16920 - protein, 7 aa, Artificial Sequence
  Synthetic construct
YFIHGRF

SEQ ID NO: 16921 - protein, 7 aa, Artificial Sequence
  Synthetic construct
YFIHGRY

SEQ ID NO: 16922 - protein, 7 aa, Artificial Sequence
  Synthetic construct
YFIHGCF

SEQ ID NO: 16923 - protein, 7 aa, Artificial Sequence
  Synthetic construct
YFIHGCY

SEQ ID NO: 16924 - protein, 7 aa, Artificial Sequence
  Synthetic construct
YFIHGLF

SEQ ID NO: 16925 - protein, 7 aa, Artificial Sequence
  Synthetic construct
YFIHGLY

SEQ ID NO: 16926 - protein, 7 aa, Artificial Sequence
  Synthetic construct
YFIHGAF

SEQ ID NO: 16927 - protein, 7 aa, Artificial Sequence
  Synthetic construct
YFIHGAY

SEQ ID NO: 16928 - protein, 7 aa, Artificial Sequence
  Synthetic construct
YFIHGQF

SEQ ID NO: 16929 - protein, 7 aa, Artificial Sequence
  Synthetic construct
YFIHGQY

SEQ ID NO: 16930 - protein, 7 aa, Artificial Sequence
  Synthetic construct
YFIHGDF

SEQ ID NO: 16931 - protein, 7 aa, Artificial Sequence
  Synthetic construct
YFIHGDY

SEQ ID NO: 16932 - protein, 7 aa, Artificial Sequence
  Synthetic construct
YFIHGVF

SEQ ID NO: 16933 - protein, 7 aa, Artificial Sequence
  Synthetic construct
YFIHGVY

SEQ ID NO: 16934 - protein, 7 aa, Artificial Sequence
  Synthetic construct
YFIHAFF

SEQ ID NO: 16935 - protein, 7 aa, Artificial Sequence
  Synthetic construct
YFIHAFY

SEQ ID NO: 16936 - protein, 7 aa, Artificial Sequence
  Synthetic construct
YFIHARF

SEQ ID NO: 16937 - protein, 7 aa, Artificial Sequence
  Synthetic construct
YFIHARY

SEQ ID NO: 16938 - protein, 7 aa, Artificial Sequence
  Synthetic construct
YFIHACF

SEQ ID NO: 16939 - protein, 7 aa, Artificial Sequence
  Synthetic construct
YFIHACY

SEQ ID NO: 16940 - protein, 7 aa, Artificial Sequence
  Synthetic construct
YFIHALF

SEQ ID NO: 16941 - protein, 7 aa, Artificial Sequence
  Synthetic construct
YFIHALY

SEQ ID NO: 16942 - protein, 7 aa, Artificial Sequence
  Synthetic construct
YFIHAAF

SEQ ID NO: 16943 - protein, 7 aa, Artificial Sequence
  Synthetic construct
YFIHAAY

SEQ ID NO: 16944 - protein, 7 aa, Artificial Sequence
  Synthetic construct
YFIHAQF

SEQ ID NO: 16945 - protein, 7 aa, Artificial Sequence
  Synthetic construct
YFIHAQY

SEQ ID NO: 16946 - protein, 7 aa, Artificial Sequence
  Synthetic construct
YFIHADF

SEQ ID NO: 16947 - protein, 7 aa, Artificial Sequence
  Synthetic construct
YFIHADY

SEQ ID NO: 16948 - protein, 7 aa, Artificial Sequence
  Synthetic construct
YFIHAVF

SEQ ID NO: 16949 - protein, 7 aa, Artificial Sequence
  Synthetic construct
YFIHAVY

SEQ ID NO: 16950 - protein, 7 aa, Artificial Sequence
  Synthetic construct
YFIHQFF

SEQ ID NO: 16951 - protein, 7 aa, Artificial Sequence
  Synthetic construct
YFIHQFY

SEQ ID NO: 16952 - protein, 7 aa, Artificial Sequence
  Synthetic construct
YFIHQRF

SEQ ID NO: 16953 - protein, 7 aa, Artificial Sequence
  Synthetic construct
YFIHQRY

SEQ ID NO: 16954 - protein, 7 aa, Artificial Sequence
  Synthetic construct
YFIHQCF

SEQ ID NO: 16955 - protein, 7 aa, Artificial Sequence
  Synthetic construct
YFIHQCY

SEQ ID NO: 16956 - protein, 7 aa, Artificial Sequence
  Synthetic construct
YFIHQLF

SEQ ID NO: 16957 - protein, 7 aa, Artificial Sequence
  Synthetic construct
YFIHQLY

SEQ ID NO: 16958 - protein, 7 aa, Artificial Sequence
  Synthetic construct
YFIHQAF

SEQ ID NO: 16959 - protein, 7 aa, Artificial Sequence
  Synthetic construct
YFIHQAY

SEQ ID NO: 16960 - protein, 7 aa, Artificial Sequence
  Synthetic construct
YFIHQQF

SEQ ID NO: 16961 - protein, 7 aa, Artificial Sequence
  Synthetic construct
YFIHQQY

SEQ ID NO: 16962 - protein, 7 aa, Artificial Sequence
  Synthetic construct
YFIHQDF

SEQ ID NO: 16963 - protein, 7 aa, Artificial Sequence
  Synthetic construct
YFIHQDY

SEQ ID NO: 16964 - protein, 7 aa, Artificial Sequence
  Synthetic construct
YFIHQVF

SEQ ID NO: 16965 - protein, 7 aa, Artificial Sequence
  Synthetic construct
YFIHQVY

SEQ ID NO: 16966 - protein, 7 aa, Artificial Sequence
  Synthetic construct
YFILIFF

SEQ ID NO: 16967 - protein, 7 aa, Artificial Sequence
  Synthetic construct
YFILIFY

SEQ ID NO: 16968 - protein, 7 aa, Artificial Sequence
  Synthetic construct
YFILIRF

SEQ ID NO: 16969 - protein, 7 aa, Artificial Sequence
  Synthetic construct
YFILIRY

SEQ ID NO: 16970 - protein, 7 aa, Artificial Sequence
  Synthetic construct
YFILICF

SEQ ID NO: 16971 - protein, 7 aa, Artificial Sequence
  Synthetic construct
YFILICY

SEQ ID NO: 16972 - protein, 7 aa, Artificial Sequence
  Synthetic construct
YFILILF

SEQ ID NO: 16973 - protein, 7 aa, Artificial Sequence
  Synthetic construct
YFILILY

SEQ ID NO: 16974 - protein, 7 aa, Artificial Sequence
  Synthetic construct
YFILIAF

SEQ ID NO: 16975 - protein, 7 aa, Artificial Sequence
  Synthetic construct
YFILIAY

SEQ ID NO: 16976 - protein, 7 aa, Artificial Sequence
  Synthetic construct
YFILIQF

SEQ ID NO: 16977 - protein, 7 aa, Artificial Sequence
  Synthetic construct
YFILIQY

SEQ ID NO: 16978 - protein, 7 aa, Artificial Sequence
  Synthetic construct
YFILIDF

SEQ ID NO: 16979 - protein, 7 aa, Artificial Sequence
  Synthetic construct
YFILIDY

SEQ ID NO: 16980 - protein, 7 aa, Artificial Sequence
  Synthetic construct
YFILIVF

SEQ ID NO: 16981 - protein, 7 aa, Artificial Sequence
  Synthetic construct
YFILIVY

SEQ ID NO: 16982 - protein, 7 aa, Artificial Sequence
  Synthetic construct
YFILDFF

SEQ ID NO: 16983 - protein, 7 aa, Artificial Sequence
  Synthetic construct
YFILDFY

SEQ ID NO: 16984 - protein, 7 aa, Artificial Sequence
  Synthetic construct
YFILDRF

SEQ ID NO: 16985 - protein, 7 aa, Artificial Sequence
  Synthetic construct
YFILDRY

SEQ ID NO: 16986 - protein, 7 aa, Artificial Sequence
  Synthetic construct
YFILDCF

SEQ ID NO: 16987 - protein, 7 aa, Artificial Sequence
  Synthetic construct
YFILDCY

SEQ ID NO: 16988 - protein, 7 aa, Artificial Sequence
  Synthetic construct
YFILDLF

SEQ ID NO: 16989 - protein, 7 aa, Artificial Sequence
  Synthetic construct
YFILDLY

SEQ ID NO: 16990 - protein, 7 aa, Artificial Sequence
  Synthetic construct
YFILDAF

SEQ ID NO: 16991 - protein, 7 aa, Artificial Sequence
  Synthetic construct
YFILDAY

SEQ ID NO: 16992 - protein, 7 aa, Artificial Sequence
  Synthetic construct
YFILDQF

SEQ ID NO: 16993 - protein, 7 aa, Artificial Sequence
  Synthetic construct
YFILDQY

SEQ ID NO: 16994 - protein, 7 aa, Artificial Sequence
  Synthetic construct
YFILDDF

SEQ ID NO: 16995 - protein, 7 aa, Artificial Sequence
  Synthetic construct
YFILDDY

SEQ ID NO: 16996 - protein, 7 aa, Artificial Sequence
  Synthetic construct
YFILDVF

SEQ ID NO: 16997 - protein, 7 aa, Artificial Sequence
  Synthetic construct
YFILDVY

SEQ ID NO: 16998 - protein, 7 aa, Artificial Sequence
  Synthetic construct
YFILYFF

SEQ ID NO: 16999 - protein, 7 aa, Artificial Sequence
  Synthetic construct
YFILYFY

SEQ ID NO: 17000 - protein, 7 aa, Artificial Sequence
  Synthetic construct
YFILYRF

SEQ ID NO: 17001 - protein, 7 aa, Artificial Sequence
  Synthetic construct
YFILYRY

SEQ ID NO: 17002 - protein, 7 aa, Artificial Sequence
  Synthetic construct
YFILYCF

SEQ ID NO: 17003 - protein, 7 aa, Artificial Sequence
  Synthetic construct
YFILYCY

SEQ ID NO: 17004 - protein, 7 aa, Artificial Sequence
  Synthetic construct
YFILYLF

SEQ ID NO: 17005 - protein, 7 aa, Artificial Sequence
  Synthetic construct
YFILYLY

SEQ ID NO: 17006 - protein, 7 aa, Artificial Sequence
  Synthetic construct
YFILYAF

SEQ ID NO: 17007 - protein, 7 aa, Artificial Sequence
  Synthetic construct
YFILYAY

SEQ ID NO: 17008 - protein, 7 aa, Artificial Sequence
  Synthetic construct
YFILYQF

SEQ ID NO: 17009 - protein, 7 aa, Artificial Sequence
  Synthetic construct
YFILYQY

SEQ ID NO: 17010 - protein, 7 aa, Artificial Sequence
  Synthetic construct
YFILYDF

SEQ ID NO: 17011 - protein, 7 aa, Artificial Sequence
  Synthetic construct
YFILYDY

SEQ ID NO: 17012 - protein, 7 aa, Artificial Sequence
  Synthetic construct
YFILYVF

SEQ ID NO: 17013 - protein, 7 aa, Artificial Sequence
  Synthetic construct
YFILYVY

SEQ ID NO: 17014 - protein, 7 aa, Artificial Sequence
  Synthetic construct
YFILFFF

SEQ ID NO: 17015 - protein, 7 aa, Artificial Sequence
  Synthetic construct
YFILFFY

SEQ ID NO: 17016 - protein, 7 aa, Artificial Sequence
  Synthetic construct
YFILFRF

SEQ ID NO: 17017 - protein, 7 aa, Artificial Sequence
  Synthetic construct
YFILFRY

SEQ ID NO: 17018 - protein, 7 aa, Artificial Sequence
  Synthetic construct
YFILFCF

SEQ ID NO: 17019 - protein, 7 aa, Artificial Sequence
  Synthetic construct
YFILFCY

SEQ ID NO: 17020 - protein, 7 aa, Artificial Sequence
  Synthetic construct
YFILFLF

SEQ ID NO: 17021 - protein, 7 aa, Artificial Sequence
  Synthetic construct
YFILFLY

SEQ ID NO: 17022 - protein, 7 aa, Artificial Sequence
  Synthetic construct
YFILFAF

SEQ ID NO: 17023 - protein, 7 aa, Artificial Sequence
  Synthetic construct
YFILFAY

SEQ ID NO: 17024 - protein, 7 aa, Artificial Sequence
  Synthetic construct
YFILFQF

SEQ ID NO: 17025 - protein, 7 aa, Artificial Sequence
  Synthetic construct
YFILFQY

SEQ ID NO: 17026 - protein, 7 aa, Artificial Sequence
  Synthetic construct
YFILFDF

SEQ ID NO: 17027 - protein, 7 aa, Artificial Sequence
  Synthetic construct
YFILFDY

SEQ ID NO: 17028 - protein, 7 aa, Artificial Sequence
  Synthetic construct
YFILFVF

SEQ ID NO: 17029 - protein, 7 aa, Artificial Sequence
  Synthetic construct
YFILFVY

SEQ ID NO: 17030 - protein, 7 aa, Artificial Sequence
  Synthetic construct
YFILVFF

SEQ ID NO: 17031 - protein, 7 aa, Artificial Sequence
  Synthetic construct
YFILVFY

SEQ ID NO: 17032 - protein, 7 aa, Artificial Sequence
  Synthetic construct
YFILVRF

SEQ ID NO: 17033 - protein, 7 aa, Artificial Sequence
  Synthetic construct
YFILVRY

SEQ ID NO: 17034 - protein, 7 aa, Artificial Sequence
  Synthetic construct
YFILVCF

SEQ ID NO: 17035 - protein, 7 aa, Artificial Sequence
  Synthetic construct
YFILVCY

SEQ ID NO: 17036 - protein, 7 aa, Artificial Sequence
  Synthetic construct
YFILVLF

SEQ ID NO: 17037 - protein, 7 aa, Artificial Sequence
  Synthetic construct
YFILVLY

SEQ ID NO: 17038 - protein, 7 aa, Artificial Sequence
  Synthetic construct
YFILVAF

SEQ ID NO: 17039 - protein, 7 aa, Artificial Sequence
  Synthetic construct
YFILVAY

SEQ ID NO: 17040 - protein, 7 aa, Artificial Sequence
  Synthetic construct
YFILVQF

SEQ ID NO: 17041 - protein, 7 aa, Artificial Sequence
  Synthetic construct
YFILVQY

SEQ ID NO: 17042 - protein, 7 aa, Artificial Sequence
  Synthetic construct
YFILVDF

SEQ ID NO: 17043 - protein, 7 aa, Artificial Sequence
  Synthetic construct
YFILVDY

SEQ ID NO: 17044 - protein, 7 aa, Artificial Sequence
  Synthetic construct
YFILVVF

SEQ ID NO: 17045 - protein, 7 aa, Artificial Sequence
  Synthetic construct
YFILVVY

SEQ ID NO: 17046 - protein, 7 aa, Artificial Sequence
  Synthetic construct
YFILTFF

SEQ ID NO: 17047 - protein, 7 aa, Artificial Sequence
  Synthetic construct
YFILTFY

SEQ ID NO: 17048 - protein, 7 aa, Artificial Sequence
  Synthetic construct
YFILTRF

SEQ ID NO: 17049 - protein, 7 aa, Artificial Sequence
  Synthetic construct
YFILTRY

SEQ ID NO: 17050 - protein, 7 aa, Artificial Sequence
  Synthetic construct
YFILTCF

SEQ ID NO: 17051 - protein, 7 aa, Artificial Sequence
  Synthetic construct
YFILTCY

SEQ ID NO: 17052 - protein, 7 aa, Artificial Sequence
  Synthetic construct
YFILTLF

SEQ ID NO: 17053 - protein, 7 aa, Artificial Sequence
  Synthetic construct
YFILTLY

SEQ ID NO: 17054 - protein, 7 aa, Artificial Sequence
  Synthetic construct
YFILTAF

SEQ ID NO: 17055 - protein, 7 aa, Artificial Sequence
  Synthetic construct
YFILTAY

SEQ ID NO: 17056 - protein, 7 aa, Artificial Sequence
  Synthetic construct
YFILTQF

SEQ ID NO: 17057 - protein, 7 aa, Artificial Sequence
  Synthetic construct
YFILTQY

SEQ ID NO: 17058 - protein, 7 aa, Artificial Sequence
  Synthetic construct
YFILTDF

SEQ ID NO: 17059 - protein, 7 aa, Artificial Sequence
  Synthetic construct
YFILTDY

SEQ ID NO: 17060 - protein, 7 aa, Artificial Sequence
  Synthetic construct
YFILTVF

SEQ ID NO: 17061 - protein, 7 aa, Artificial Sequence
  Synthetic construct
YFILTVY

SEQ ID NO: 17062 - protein, 7 aa, Artificial Sequence
  Synthetic construct
YFILGFF

SEQ ID NO: 17063 - protein, 7 aa, Artificial Sequence
  Synthetic construct
YFILGFY

SEQ ID NO: 17064 - protein, 7 aa, Artificial Sequence
  Synthetic construct
YFILGRF

SEQ ID NO: 17065 - protein, 7 aa, Artificial Sequence
  Synthetic construct
YFILGRY

SEQ ID NO: 17066 - protein, 7 aa, Artificial Sequence
  Synthetic construct
YFILGCF

SEQ ID NO: 17067 - protein, 7 aa, Artificial Sequence
  Synthetic construct
YFILGCY

SEQ ID NO: 17068 - protein, 7 aa, Artificial Sequence
  Synthetic construct
YFILGLF

SEQ ID NO: 17069 - protein, 7 aa, Artificial Sequence
  Synthetic construct
YFILGLY

SEQ ID NO: 17070 - protein, 7 aa, Artificial Sequence
  Synthetic construct
YFILGAF

SEQ ID NO: 17071 - protein, 7 aa, Artificial Sequence
  Synthetic construct
YFILGAY

SEQ ID NO: 17072 - protein, 7 aa, Artificial Sequence
  Synthetic construct
YFILGQF

SEQ ID NO: 17073 - protein, 7 aa, Artificial Sequence
  Synthetic construct
YFILGQY

SEQ ID NO: 17074 - protein, 7 aa, Artificial Sequence
  Synthetic construct
YFILGDF

SEQ ID NO: 17075 - protein, 7 aa, Artificial Sequence
  Synthetic construct
YFILGDY

SEQ ID NO: 17076 - protein, 7 aa, Artificial Sequence
  Synthetic construct
YFILGVF

SEQ ID NO: 17077 - protein, 7 aa, Artificial Sequence
  Synthetic construct
YFILGVY

SEQ ID NO: 17078 - protein, 7 aa, Artificial Sequence
  Synthetic construct
YFILAFF

SEQ ID NO: 17079 - protein, 7 aa, Artificial Sequence
  Synthetic construct
YFILAFY

SEQ ID NO: 17080 - protein, 7 aa, Artificial Sequence
  Synthetic construct
YFILARF

SEQ ID NO: 17081 - protein, 7 aa, Artificial Sequence
  Synthetic construct
YFILARY

SEQ ID NO: 17082 - protein, 7 aa, Artificial Sequence
  Synthetic construct
YFILACF

SEQ ID NO: 17083 - protein, 7 aa, Artificial Sequence
  Synthetic construct
YFILACY

SEQ ID NO: 17084 - protein, 7 aa, Artificial Sequence
  Synthetic construct
YFILALF

SEQ ID NO: 17085 - protein, 7 aa, Artificial Sequence
  Synthetic construct
YFILALY

SEQ ID NO: 17086 - protein, 7 aa, Artificial Sequence
  Synthetic construct
YFILAAF

SEQ ID NO: 17087 - protein, 7 aa, Artificial Sequence
  Synthetic construct
YFILAAY

SEQ ID NO: 17088 - protein, 7 aa, Artificial Sequence
  Synthetic construct
YFILAQF

SEQ ID NO: 17089 - protein, 7 aa, Artificial Sequence
  Synthetic construct
YFILAQY

SEQ ID NO: 17090 - protein, 7 aa, Artificial Sequence
  Synthetic construct
YFILADF

SEQ ID NO: 17091 - protein, 7 aa, Artificial Sequence
  Synthetic construct
YFILADY

SEQ ID NO: 17092 - protein, 7 aa, Artificial Sequence
  Synthetic construct
YFILAVF

SEQ ID NO: 17093 - protein, 7 aa, Artificial Sequence
  Synthetic construct
YFILAVY

SEQ ID NO: 17094 - protein, 7 aa, Artificial Sequence
  Synthetic construct
YFILQFF

SEQ ID NO: 17095 - protein, 7 aa, Artificial Sequence
  Synthetic construct
YFILQFY

SEQ ID NO: 17096 - protein, 7 aa, Artificial Sequence
  Synthetic construct
YFILQRF

SEQ ID NO: 17097 - protein, 7 aa, Artificial Sequence
  Synthetic construct
YFILQRY

SEQ ID NO: 17098 - protein, 7 aa, Artificial Sequence
  Synthetic construct
YFILQCF

SEQ ID NO: 17099 - protein, 7 aa, Artificial Sequence
  Synthetic construct
YFILQCY

SEQ ID NO: 17100 - protein, 7 aa, Artificial Sequence
  Synthetic construct
YFILQLF

SEQ ID NO: 17101 - protein, 7 aa, Artificial Sequence
  Synthetic construct
YFILQLY

SEQ ID NO: 17102 - protein, 7 aa, Artificial Sequence
  Synthetic construct
YFILQAF

SEQ ID NO: 17103 - protein, 7 aa, Artificial Sequence
  Synthetic construct
YFILQAY

SEQ ID NO: 17104 - protein, 7 aa, Artificial Sequence
  Synthetic construct
YFILQQF

SEQ ID NO: 17105 - protein, 7 aa, Artificial Sequence
  Synthetic construct
YFILQQY

SEQ ID NO: 17106 - protein, 7 aa, Artificial Sequence
  Synthetic construct
YFILQDF

SEQ ID NO: 17107 - protein, 7 aa, Artificial Sequence
  Synthetic construct
YFILQDY

SEQ ID NO: 17108 - protein, 7 aa, Artificial Sequence
  Synthetic construct
YFILQVF

SEQ ID NO: 17109 - protein, 7 aa, Artificial Sequence
  Synthetic construct
YFILQVY

SEQ ID NO: 17110 - protein, 7 aa, Artificial Sequence
  Synthetic construct
YFIFIFF

SEQ ID NO: 17111 - protein, 7 aa, Artificial Sequence
  Synthetic construct
YFIFIFY

SEQ ID NO: 17112 - protein, 7 aa, Artificial Sequence
  Synthetic construct
YFIFIRF

SEQ ID NO: 17113 - protein, 7 aa, Artificial Sequence
  Synthetic construct
YFIFIRY

SEQ ID NO: 17114 - protein, 7 aa, Artificial Sequence
  Synthetic construct
YFIFICF

SEQ ID NO: 17115 - protein, 7 aa, Artificial Sequence
  Synthetic construct
YFIFICY

SEQ ID NO: 17116 - protein, 7 aa, Artificial Sequence
  Synthetic construct
YFIFILF

SEQ ID NO: 17117 - protein, 7 aa, Artificial Sequence
  Synthetic construct
YFIFILY

SEQ ID NO: 17118 - protein, 7 aa, Artificial Sequence
  Synthetic construct
YFIFIAF

SEQ ID NO: 17119 - protein, 7 aa, Artificial Sequence
  Synthetic construct
YFIFIAY

SEQ ID NO: 17120 - protein, 7 aa, Artificial Sequence
  Synthetic construct
YFIFIQF

SEQ ID NO: 17121 - protein, 7 aa, Artificial Sequence
  Synthetic construct
YFIFIQY

SEQ ID NO: 17122 - protein, 7 aa, Artificial Sequence
  Synthetic construct
YFIFIDF

SEQ ID NO: 17123 - protein, 7 aa, Artificial Sequence
  Synthetic construct
YFIFIDY

SEQ ID NO: 17124 - protein, 7 aa, Artificial Sequence
  Synthetic construct
YFIFIVF

SEQ ID NO: 17125 - protein, 7 aa, Artificial Sequence
  Synthetic construct
YFIFIVY

SEQ ID NO: 17126 - protein, 7 aa, Artificial Sequence
  Synthetic construct
YFIFDFF

SEQ ID NO: 17127 - protein, 7 aa, Artificial Sequence
  Synthetic construct
YFIFDFY

SEQ ID NO: 17128 - protein, 7 aa, Artificial Sequence
  Synthetic construct
YFIFDRF

SEQ ID NO: 17129 - protein, 7 aa, Artificial Sequence
  Synthetic construct
YFIFDRY

SEQ ID NO: 17130 - protein, 7 aa, Artificial Sequence
  Synthetic construct
YFIFDCF

SEQ ID NO: 17131 - protein, 7 aa, Artificial Sequence
  Synthetic construct
YFIFDCY

SEQ ID NO: 17132 - protein, 7 aa, Artificial Sequence
  Synthetic construct
YFIFDLF

SEQ ID NO: 17133 - protein, 7 aa, Artificial Sequence
  Synthetic construct
YFIFDLY

SEQ ID NO: 17134 - protein, 7 aa, Artificial Sequence
  Synthetic construct
YFIFDAF

SEQ ID NO: 17135 - protein, 7 aa, Artificial Sequence
  Synthetic construct
YFIFDAY

SEQ ID NO: 17136 - protein, 7 aa, Artificial Sequence
  Synthetic construct
YFIFDQF

SEQ ID NO: 17137 - protein, 7 aa, Artificial Sequence
  Synthetic construct
YFIFDQY

SEQ ID NO: 17138 - protein, 7 aa, Artificial Sequence
  Synthetic construct
YFIFDDF

SEQ ID NO: 17139 - protein, 7 aa, Artificial Sequence
  Synthetic construct
YFIFDDY

SEQ ID NO: 17140 - protein, 7 aa, Artificial Sequence
  Synthetic construct
YFIFDVF

SEQ ID NO: 17141 - protein, 7 aa, Artificial Sequence
  Synthetic construct
YFIFDVY

SEQ ID NO: 17142 - protein, 7 aa, Artificial Sequence
  Synthetic construct
YFIFYFF

SEQ ID NO: 17143 - protein, 7 aa, Artificial Sequence
  Synthetic construct
YFIFYFY

SEQ ID NO: 17144 - protein, 7 aa, Artificial Sequence
  Synthetic construct
YFIFYRF

SEQ ID NO: 17145 - protein, 7 aa, Artificial Sequence
  Synthetic construct
YFIFYRY

SEQ ID NO: 17146 - protein, 7 aa, Artificial Sequence
  Synthetic construct
YFIFYCF

SEQ ID NO: 17147 - protein, 7 aa, Artificial Sequence
  Synthetic construct
YFIFYCY

SEQ ID NO: 17148 - protein, 7 aa, Artificial Sequence
  Synthetic construct
YFIFYLF

SEQ ID NO: 17149 - protein, 7 aa, Artificial Sequence
  Synthetic construct
YFIFYLY

SEQ ID NO: 17150 - protein, 7 aa, Artificial Sequence
  Synthetic construct
YFIFYAF

SEQ ID NO: 17151 - protein, 7 aa, Artificial Sequence
  Synthetic construct
YFIFYAY

SEQ ID NO: 17152 - protein, 7 aa, Artificial Sequence
  Synthetic construct
YFIFYQF

SEQ ID NO: 17153 - protein, 7 aa, Artificial Sequence
  Synthetic construct
YFIFYQY

SEQ ID NO: 17154 - protein, 7 aa, Artificial Sequence
  Synthetic construct
YFIFYDF

SEQ ID NO: 17155 - protein, 7 aa, Artificial Sequence
  Synthetic construct
YFIFYDY

SEQ ID NO: 17156 - protein, 7 aa, Artificial Sequence
  Synthetic construct
YFIFYVF

SEQ ID NO: 17157 - protein, 7 aa, Artificial Sequence
  Synthetic construct
YFIFYVY

SEQ ID NO: 17158 - protein, 7 aa, Artificial Sequence
  Synthetic construct
YFIFFFF

SEQ ID NO: 17159 - protein, 7 aa, Artificial Sequence
  Synthetic construct
YFIFFFY

SEQ ID NO: 17160 - protein, 7 aa, Artificial Sequence
  Synthetic construct
YFIFFRF

SEQ ID NO: 17161 - protein, 7 aa, Artificial Sequence
  Synthetic construct
YFIFFRY

SEQ ID NO: 17162 - protein, 7 aa, Artificial Sequence
  Synthetic construct
YFIFFCF

SEQ ID NO: 17163 - protein, 7 aa, Artificial Sequence
  Synthetic construct
YFIFFCY

SEQ ID NO: 17164 - protein, 7 aa, Artificial Sequence
  Synthetic construct
YFIFFLF

SEQ ID NO: 17165 - protein, 7 aa, Artificial Sequence
  Synthetic construct
YFIFFLY

SEQ ID NO: 17166 - protein, 7 aa, Artificial Sequence
  Synthetic construct
YFIFFAF

SEQ ID NO: 17167 - protein, 7 aa, Artificial Sequence
  Synthetic construct
YFIFFAY

SEQ ID NO: 17168 - protein, 7 aa, Artificial Sequence
  Synthetic construct
YFIFFQF

SEQ ID NO: 17169 - protein, 7 aa, Artificial Sequence
  Synthetic construct
YFIFFQY

SEQ ID NO: 17170 - protein, 7 aa, Artificial Sequence
  Synthetic construct
YFIFFDF

SEQ ID NO: 17171 - protein, 7 aa, Artificial Sequence
  Synthetic construct
YFIFFDY

SEQ ID NO: 17172 - protein, 7 aa, Artificial Sequence
  Synthetic construct
YFIFFVF

SEQ ID NO: 17173 - protein, 7 aa, Artificial Sequence
  Synthetic construct
YFIFFVY

SEQ ID NO: 17174 - protein, 7 aa, Artificial Sequence
  Synthetic construct
YFIFVFF

SEQ ID NO: 17175 - protein, 7 aa, Artificial Sequence
  Synthetic construct
YFIFVFY

SEQ ID NO: 17176 - protein, 7 aa, Artificial Sequence
  Synthetic construct
YFIFVRF

SEQ ID NO: 17177 - protein, 7 aa, Artificial Sequence
  Synthetic construct
YFIFVRY

SEQ ID NO: 17178 - protein, 7 aa, Artificial Sequence
  Synthetic construct
YFIFVCF

SEQ ID NO: 17179 - protein, 7 aa, Artificial Sequence
  Synthetic construct
YFIFVCY

SEQ ID NO: 17180 - protein, 7 aa, Artificial Sequence
  Synthetic construct
YFIFVLF

SEQ ID NO: 17181 - protein, 7 aa, Artificial Sequence
  Synthetic construct
YFIFVLY

SEQ ID NO: 17182 - protein, 7 aa, Artificial Sequence
  Synthetic construct
YFIFVAF

SEQ ID NO: 17183 - protein, 7 aa, Artificial Sequence
  Synthetic construct
YFIFVAY

SEQ ID NO: 17184 - protein, 7 aa, Artificial Sequence
  Synthetic construct
YFIFVQF

SEQ ID NO: 17185 - protein, 7 aa, Artificial Sequence
  Synthetic construct
YFIFVQY

SEQ ID NO: 17186 - protein, 7 aa, Artificial Sequence
  Synthetic construct
YFIFVDF

SEQ ID NO: 17187 - protein, 7 aa, Artificial Sequence
  Synthetic construct
YFIFVDY

SEQ ID NO: 17188 - protein, 7 aa, Artificial Sequence
  Synthetic construct
YFIFVVF

SEQ ID NO: 17189 - protein, 7 aa, Artificial Sequence
  Synthetic construct
YFIFVVY

SEQ ID NO: 17190 - protein, 7 aa, Artificial Sequence
  Synthetic construct
YFIFTFF

SEQ ID NO: 17191 - protein, 7 aa, Artificial Sequence
  Synthetic construct
YFIFTFY

SEQ ID NO: 17192 - protein, 7 aa, Artificial Sequence
  Synthetic construct
YFIFTRF

SEQ ID NO: 17193 - protein, 7 aa, Artificial Sequence
  Synthetic construct
YFIFTRY

SEQ ID NO: 17194 - protein, 7 aa, Artificial Sequence
  Synthetic construct
YFIFTCF

SEQ ID NO: 17195 - protein, 7 aa, Artificial Sequence
  Synthetic construct
YFIFTCY

SEQ ID NO: 17196 - protein, 7 aa, Artificial Sequence
  Synthetic construct
YFIFTLF

SEQ ID NO: 17197 - protein, 7 aa, Artificial Sequence
  Synthetic construct
YFIFTLY

SEQ ID NO: 17198 - protein, 7 aa, Artificial Sequence
  Synthetic construct
YFIFTAF

SEQ ID NO: 17199 - protein, 7 aa, Artificial Sequence
  Synthetic construct
YFIFTAY

SEQ ID NO: 17200 - protein, 7 aa, Artificial Sequence
  Synthetic construct
YFIFTQF

SEQ ID NO: 17201 - protein, 7 aa, Artificial Sequence
  Synthetic construct
YFIFTQY

SEQ ID NO: 17202 - protein, 7 aa, Artificial Sequence
  Synthetic construct
YFIFTDF

SEQ ID NO: 17203 - protein, 7 aa, Artificial Sequence
  Synthetic construct
YFIFTDY

SEQ ID NO: 17204 - protein, 7 aa, Artificial Sequence
  Synthetic construct
YFIFTVF

SEQ ID NO: 17205 - protein, 7 aa, Artificial Sequence
  Synthetic construct
YFIFTVY

SEQ ID NO: 17206 - protein, 7 aa, Artificial Sequence
  Synthetic construct
YFIFGFF

SEQ ID NO: 17207 - protein, 7 aa, Artificial Sequence
  Synthetic construct
YFIFGFY

SEQ ID NO: 17208 - protein, 7 aa, Artificial Sequence
  Synthetic construct
YFIFGRF

SEQ ID NO: 17209 - protein, 7 aa, Artificial Sequence
  Synthetic construct
YFIFGRY

SEQ ID NO: 17210 - protein, 7 aa, Artificial Sequence
  Synthetic construct
YFIFGCF

SEQ ID NO: 17211 - protein, 7 aa, Artificial Sequence
  Synthetic construct
YFIFGCY

SEQ ID NO: 17212 - protein, 7 aa, Artificial Sequence
  Synthetic construct
YFIFGLF

SEQ ID NO: 17213 - protein, 7 aa, Artificial Sequence
  Synthetic construct
YFIFGLY

SEQ ID NO: 17214 - protein, 7 aa, Artificial Sequence
  Synthetic construct
YFIFGAF

SEQ ID NO: 17215 - protein, 7 aa, Artificial Sequence
  Synthetic construct
YFIFGAY

SEQ ID NO: 17216 - protein, 7 aa, Artificial Sequence
  Synthetic construct
YFIFGQF

SEQ ID NO: 17217 - protein, 7 aa, Artificial Sequence
  Synthetic construct
YFIFGQY

SEQ ID NO: 17218 - protein, 7 aa, Artificial Sequence
  Synthetic construct
YFIFGDF

SEQ ID NO: 17219 - protein, 7 aa, Artificial Sequence
  Synthetic construct
YFIFGDY

SEQ ID NO: 17220 - protein, 7 aa, Artificial Sequence
  Synthetic construct
YFIFGVF

SEQ ID NO: 17221 - protein, 7 aa, Artificial Sequence
  Synthetic construct
YFIFGVY

SEQ ID NO: 17222 - protein, 7 aa, Artificial Sequence
  Synthetic construct
YFIFAFF

SEQ ID NO: 17223 - protein, 7 aa, Artificial Sequence
  Synthetic construct
YFIFAFY

SEQ ID NO: 17224 - protein, 7 aa, Artificial Sequence
  Synthetic construct
YFIFARF

SEQ ID NO: 17225 - protein, 7 aa, Artificial Sequence
  Synthetic construct
YFIFARY

SEQ ID NO: 17226 - protein, 7 aa, Artificial Sequence
  Synthetic construct
YFIFACF

SEQ ID NO: 17227 - protein, 7 aa, Artificial Sequence
  Synthetic construct
YFIFACY

SEQ ID NO: 17228 - protein, 7 aa, Artificial Sequence
  Synthetic construct
YFIFALF

SEQ ID NO: 17229 - protein, 7 aa, Artificial Sequence
  Synthetic construct
YFIFALY

SEQ ID NO: 17230 - protein, 7 aa, Artificial Sequence
  Synthetic construct
YFIFAAF

SEQ ID NO: 17231 - protein, 7 aa, Artificial Sequence
  Synthetic construct
YFIFAAY

SEQ ID NO: 17232 - protein, 7 aa, Artificial Sequence
  Synthetic construct
YFIFAQF

SEQ ID NO: 17233 - protein, 7 aa, Artificial Sequence
  Synthetic construct
YFIFAQY

SEQ ID NO: 17234 - protein, 7 aa, Artificial Sequence
  Synthetic construct
YFIFADF

SEQ ID NO: 17235 - protein, 7 aa, Artificial Sequence
  Synthetic construct
YFIFADY

SEQ ID NO: 17236 - protein, 7 aa, Artificial Sequence
  Synthetic construct
YFIFAVF

SEQ ID NO: 17237 - protein, 7 aa, Artificial Sequence
  Synthetic construct
YFIFAVY

SEQ ID NO: 17238 - protein, 7 aa, Artificial Sequence
  Synthetic construct
YFIFQFF

SEQ ID NO: 17239 - protein, 7 aa, Artificial Sequence
  Synthetic construct
YFIFQFY

SEQ ID NO: 17240 - protein, 7 aa, Artificial Sequence
  Synthetic construct
YFIFQRF

SEQ ID NO: 17241 - protein, 7 aa, Artificial Sequence
  Synthetic construct
YFIFQRY

SEQ ID NO: 17242 - protein, 7 aa, Artificial Sequence
  Synthetic construct
YFIFQCF

SEQ ID NO: 17243 - protein, 7 aa, Artificial Sequence
  Synthetic construct
YFIFQCY

SEQ ID NO: 17244 - protein, 7 aa, Artificial Sequence
  Synthetic construct
YFIFQLF

SEQ ID NO: 17245 - protein, 7 aa, Artificial Sequence
  Synthetic construct
YFIFQLY

SEQ ID NO: 17246 - protein, 7 aa, Artificial Sequence
  Synthetic construct
YFIFQAF

SEQ ID NO: 17247 - protein, 7 aa, Artificial Sequence
  Synthetic construct
YFIFQAY

SEQ ID NO: 17248 - protein, 7 aa, Artificial Sequence
  Synthetic construct
YFIFQQF

SEQ ID NO: 17249 - protein, 7 aa, Artificial Sequence
  Synthetic construct
YFIFQQY

SEQ ID NO: 17250 - protein, 7 aa, Artificial Sequence
  Synthetic construct
YFIFQDF

SEQ ID NO: 17251 - protein, 7 aa, Artificial Sequence
  Synthetic construct
YFIFQDY

SEQ ID NO: 17252 - protein, 7 aa, Artificial Sequence
  Synthetic construct
YFIFQVF

SEQ ID NO: 17253 - protein, 7 aa, Artificial Sequence
  Synthetic construct
YFIFQVY

SEQ ID NO: 17254 - protein, 7 aa, Artificial Sequence
  Synthetic construct
YFGYIFF

SEQ ID NO: 17255 - protein, 7 aa, Artificial Sequence
  Synthetic construct
YFGYIFY

SEQ ID NO: 17256 - protein, 7 aa, Artificial Sequence
  Synthetic construct
YFGYIRF

SEQ ID NO: 17257 - protein, 7 aa, Artificial Sequence
  Synthetic construct
YFGYIRY

SEQ ID NO: 17258 - protein, 7 aa, Artificial Sequence
  Synthetic construct
YFGYICF

SEQ ID NO: 17259 - protein, 7 aa, Artificial Sequence
  Synthetic construct
YFGYICY

SEQ ID NO: 17260 - protein, 7 aa, Artificial Sequence
  Synthetic construct
YFGYILF

SEQ ID NO: 17261 - protein, 7 aa, Artificial Sequence
  Synthetic construct
YFGYILY

SEQ ID NO: 17262 - protein, 7 aa, Artificial Sequence
  Synthetic construct
YFGYIAF

SEQ ID NO: 17263 - protein, 7 aa, Artificial Sequence
  Synthetic construct
YFGYIAY

SEQ ID NO: 17264 - protein, 7 aa, Artificial Sequence
  Synthetic construct
YFGYIQF

SEQ ID NO: 17265 - protein, 7 aa, Artificial Sequence
  Synthetic construct
YFGYIQY

SEQ ID NO: 17266 - protein, 7 aa, Artificial Sequence
  Synthetic construct
YFGYIDF

SEQ ID NO: 17267 - protein, 7 aa, Artificial Sequence
  Synthetic construct
YFGYIDY

SEQ ID NO: 17268 - protein, 7 aa, Artificial Sequence
  Synthetic construct
YFGYIVF

SEQ ID NO: 17269 - protein, 7 aa, Artificial Sequence
  Synthetic construct
YFGYIVY

SEQ ID NO: 17270 - protein, 7 aa, Artificial Sequence
  Synthetic construct
YFGYDFF

SEQ ID NO: 17271 - protein, 7 aa, Artificial Sequence
  Synthetic construct
YFGYDFY

SEQ ID NO: 17272 - protein, 7 aa, Artificial Sequence
  Synthetic construct
YFGYDRF

SEQ ID NO: 17273 - protein, 7 aa, Artificial Sequence
  Synthetic construct
YFGYDRY

SEQ ID NO: 17274 - protein, 7 aa, Artificial Sequence
  Synthetic construct
YFGYDCF

SEQ ID NO: 17275 - protein, 7 aa, Artificial Sequence
  Synthetic construct
YFGYDCY

SEQ ID NO: 17276 - protein, 7 aa, Artificial Sequence
  Synthetic construct
YFGYDLF

SEQ ID NO: 17277 - protein, 7 aa, Artificial Sequence
  Synthetic construct
YFGYDLY

SEQ ID NO: 17278 - protein, 7 aa, Artificial Sequence
  Synthetic construct
YFGYDAF

SEQ ID NO: 17279 - protein, 7 aa, Artificial Sequence
  Synthetic construct
YFGYDAY

SEQ ID NO: 17280 - protein, 7 aa, Artificial Sequence
  Synthetic construct
YFGYDQF

SEQ ID NO: 17281 - protein, 7 aa, Artificial Sequence
  Synthetic construct
YFGYDQY

SEQ ID NO: 17282 - protein, 7 aa, Artificial Sequence
  Synthetic construct
YFGYDDF

SEQ ID NO: 17283 - protein, 7 aa, Artificial Sequence
  Synthetic construct
YFGYDDY

SEQ ID NO: 17284 - protein, 7 aa, Artificial Sequence
  Synthetic construct
YFGYDVF

SEQ ID NO: 17285 - protein, 7 aa, Artificial Sequence
  Synthetic construct
YFGYDVY

SEQ ID NO: 17286 - protein, 7 aa, Artificial Sequence
  Synthetic construct
YFGYYFF

SEQ ID NO: 17287 - protein, 7 aa, Artificial Sequence
  Synthetic construct
YFGYYFY

SEQ ID NO: 17288 - protein, 7 aa, Artificial Sequence
  Synthetic construct
YFGYYRF

SEQ ID NO: 17289 - protein, 7 aa, Artificial Sequence
  Synthetic construct
YFGYYRY

SEQ ID NO: 17290 - protein, 7 aa, Artificial Sequence
  Synthetic construct
YFGYYCF

SEQ ID NO: 17291 - protein, 7 aa, Artificial Sequence
  Synthetic construct
YFGYYCY

SEQ ID NO: 17292 - protein, 7 aa, Artificial Sequence
  Synthetic construct
YFGYYLF

SEQ ID NO: 17293 - protein, 7 aa, Artificial Sequence
  Synthetic construct
YFGYYLY

SEQ ID NO: 17294 - protein, 7 aa, Artificial Sequence
  Synthetic construct
YFGYYAF

SEQ ID NO: 17295 - protein, 7 aa, Artificial Sequence
  Synthetic construct
YFGYYAY

SEQ ID NO: 17296 - protein, 7 aa, Artificial Sequence
  Synthetic construct
YFGYYQF

SEQ ID NO: 17297 - protein, 7 aa, Artificial Sequence
  Synthetic construct
YFGYYQY

SEQ ID NO: 17298 - protein, 7 aa, Artificial Sequence
  Synthetic construct
YFGYYDF

SEQ ID NO: 17299 - protein, 7 aa, Artificial Sequence
  Synthetic construct
YFGYYDY

SEQ ID NO: 17300 - protein, 7 aa, Artificial Sequence
  Synthetic construct
YFGYYVF

SEQ ID NO: 17301 - protein, 7 aa, Artificial Sequence
  Synthetic construct
YFGYYVY

SEQ ID NO: 17302 - protein, 7 aa, Artificial Sequence
  Synthetic construct
YFGYFFF

SEQ ID NO: 17303 - protein, 7 aa, Artificial Sequence
  Synthetic construct
YFGYFFY

SEQ ID NO: 17304 - protein, 7 aa, Artificial Sequence
  Synthetic construct
YFGYFRF

SEQ ID NO: 17305 - protein, 7 aa, Artificial Sequence
  Synthetic construct
YFGYFRY

SEQ ID NO: 17306 - protein, 7 aa, Artificial Sequence
  Synthetic construct
YFGYFCF

SEQ ID NO: 17307 - protein, 7 aa, Artificial Sequence
  Synthetic construct
YFGYFCY

SEQ ID NO: 17308 - protein, 7 aa, Artificial Sequence
  Synthetic construct
YFGYFLF

SEQ ID NO: 17309 - protein, 7 aa, Artificial Sequence
  Synthetic construct
YFGYFLY

SEQ ID NO: 17310 - protein, 7 aa, Artificial Sequence
  Synthetic construct
YFGYFAF

SEQ ID NO: 17311 - protein, 7 aa, Artificial Sequence
  Synthetic construct
YFGYFAY

SEQ ID NO: 17312 - protein, 7 aa, Artificial Sequence
  Synthetic construct
YFGYFQF

SEQ ID NO: 17313 - protein, 7 aa, Artificial Sequence
  Synthetic construct
YFGYFQY

SEQ ID NO: 17314 - protein, 7 aa, Artificial Sequence
  Synthetic construct
YFGYFDF

SEQ ID NO: 17315 - protein, 7 aa, Artificial Sequence
  Synthetic construct
YFGYFDY

SEQ ID NO: 17316 - protein, 7 aa, Artificial Sequence
  Synthetic construct
YFGYFVF

SEQ ID NO: 17317 - protein, 7 aa, Artificial Sequence
  Synthetic construct
YFGYFVY

SEQ ID NO: 17318 - protein, 7 aa, Artificial Sequence
  Synthetic construct
YFGYVFF

SEQ ID NO: 17319 - protein, 7 aa, Artificial Sequence
  Synthetic construct
YFGYVFY

SEQ ID NO: 17320 - protein, 7 aa, Artificial Sequence
  Synthetic construct
YFGYVRF

SEQ ID NO: 17321 - protein, 7 aa, Artificial Sequence
  Synthetic construct
YFGYVRY

SEQ ID NO: 17322 - protein, 7 aa, Artificial Sequence
  Synthetic construct
YFGYVCF

SEQ ID NO: 17323 - protein, 7 aa, Artificial Sequence
  Synthetic construct
YFGYVCY

SEQ ID NO: 17324 - protein, 7 aa, Artificial Sequence
  Synthetic construct
YFGYVLF

SEQ ID NO: 17325 - protein, 7 aa, Artificial Sequence
  Synthetic construct
YFGYVLY

SEQ ID NO: 17326 - protein, 7 aa, Artificial Sequence
  Synthetic construct
YFGYVAF

SEQ ID NO: 17327 - protein, 7 aa, Artificial Sequence
  Synthetic construct
YFGYVAY

SEQ ID NO: 17328 - protein, 7 aa, Artificial Sequence
  Synthetic construct
YFGYVQF

SEQ ID NO: 17329 - protein, 7 aa, Artificial Sequence
  Synthetic construct
YFGYVQY

SEQ ID NO: 17330 - protein, 7 aa, Artificial Sequence
  Synthetic construct
YFGYVDF

SEQ ID NO: 17331 - protein, 7 aa, Artificial Sequence
  Synthetic construct
YFGYVDY

SEQ ID NO: 17332 - protein, 7 aa, Artificial Sequence
  Synthetic construct
YFGYVVF

SEQ ID NO: 17333 - protein, 7 aa, Artificial Sequence
  Synthetic construct
YFGYVVY

SEQ ID NO: 17334 - protein, 7 aa, Artificial Sequence
  Synthetic construct
YFGYTFF

SEQ ID NO: 17335 - protein, 7 aa, Artificial Sequence
  Synthetic construct
YFGYTFY

SEQ ID NO: 17336 - protein, 7 aa, Artificial Sequence
  Synthetic construct
YFGYTRF

SEQ ID NO: 17337 - protein, 7 aa, Artificial Sequence
  Synthetic construct
YFGYTRY

SEQ ID NO: 17338 - protein, 7 aa, Artificial Sequence
  Synthetic construct
YFGYTCF

SEQ ID NO: 17339 - protein, 7 aa, Artificial Sequence
  Synthetic construct
YFGYTCY

SEQ ID NO: 17340 - protein, 7 aa, Artificial Sequence
  Synthetic construct
YFGYTLF

SEQ ID NO: 17341 - protein, 7 aa, Artificial Sequence
  Synthetic construct
YFGYTLY

SEQ ID NO: 17342 - protein, 7 aa, Artificial Sequence
  Synthetic construct
YFGYTAF

SEQ ID NO: 17343 - protein, 7 aa, Artificial Sequence
  Synthetic construct
YFGYTAY

SEQ ID NO: 17344 - protein, 7 aa, Artificial Sequence
  Synthetic construct
YFGYTQF

SEQ ID NO: 17345 - protein, 7 aa, Artificial Sequence
  Synthetic construct
YFGYTQY

SEQ ID NO: 17346 - protein, 7 aa, Artificial Sequence
  Synthetic construct
YFGYTDF

SEQ ID NO: 17347 - protein, 7 aa, Artificial Sequence
  Synthetic construct
YFGYTDY

SEQ ID NO: 17348 - protein, 7 aa, Artificial Sequence
  Synthetic construct
YFGYTVF

SEQ ID NO: 17349 - protein, 7 aa, Artificial Sequence
  Synthetic construct
YFGYTVY

SEQ ID NO: 17350 - protein, 7 aa, Artificial Sequence
  Synthetic construct
YFGYGFF

SEQ ID NO: 17351 - protein, 7 aa, Artificial Sequence
  Synthetic construct
YFGYGFY

SEQ ID NO: 17352 - protein, 7 aa, Artificial Sequence
  Synthetic construct
YFGYGRF

SEQ ID NO: 17353 - protein, 7 aa, Artificial Sequence
  Synthetic construct
YFGYGRY

SEQ ID NO: 17354 - protein, 7 aa, Artificial Sequence
  Synthetic construct
YFGYGCF

SEQ ID NO: 17355 - protein, 7 aa, Artificial Sequence
  Synthetic construct
YFGYGCY

SEQ ID NO: 17356 - protein, 7 aa, Artificial Sequence
  Synthetic construct
YFGYGLF

SEQ ID NO: 17357 - protein, 7 aa, Artificial Sequence
  Synthetic construct
YFGYGLY

SEQ ID NO: 17358 - protein, 7 aa, Artificial Sequence
  Synthetic construct
YFGYGAF

SEQ ID NO: 17359 - protein, 7 aa, Artificial Sequence
  Synthetic construct
YFGYGAY

SEQ ID NO: 17360 - protein, 7 aa, Artificial Sequence
  Synthetic construct
YFGYGQF

SEQ ID NO: 17361 - protein, 7 aa, Artificial Sequence
  Synthetic construct
YFGYGQY

SEQ ID NO: 17362 - protein, 7 aa, Artificial Sequence
  Synthetic construct
YFGYGDF

SEQ ID NO: 17363 - protein, 7 aa, Artificial Sequence
  Synthetic construct
YFGYGDY

SEQ ID NO: 17364 - protein, 7 aa, Artificial Sequence
  Synthetic construct
YFGYGVF

SEQ ID NO: 17365 - protein, 7 aa, Artificial Sequence
  Synthetic construct
YFGYGVY

SEQ ID NO: 17366 - protein, 7 aa, Artificial Sequence
  Synthetic construct
YFGYAFF

SEQ ID NO: 17367 - protein, 7 aa, Artificial Sequence
  Synthetic construct
YFGYAFY

SEQ ID NO: 17368 - protein, 7 aa, Artificial Sequence
  Synthetic construct
YFGYARF

SEQ ID NO: 17369 - protein, 7 aa, Artificial Sequence
  Synthetic construct
YFGYARY

SEQ ID NO: 17370 - protein, 7 aa, Artificial Sequence
  Synthetic construct
YFGYACF

SEQ ID NO: 17371 - protein, 7 aa, Artificial Sequence
  Synthetic construct
YFGYACY

SEQ ID NO: 17372 - protein, 7 aa, Artificial Sequence
  Synthetic construct
YFGYALF

SEQ ID NO: 17373 - protein, 7 aa, Artificial Sequence
  Synthetic construct
YFGYALY

SEQ ID NO: 17374 - protein, 7 aa, Artificial Sequence
  Synthetic construct
YFGYAAF

SEQ ID NO: 17375 - protein, 7 aa, Artificial Sequence
  Synthetic construct
YFGYAAY

SEQ ID NO: 17376 - protein, 7 aa, Artificial Sequence
  Synthetic construct
YFGYAQF

SEQ ID NO: 17377 - protein, 7 aa, Artificial Sequence
  Synthetic construct
YFGYAQY

SEQ ID NO: 17378 - protein, 7 aa, Artificial Sequence
  Synthetic construct
YFGYADF

SEQ ID NO: 17379 - protein, 7 aa, Artificial Sequence
  Synthetic construct
YFGYADY

SEQ ID NO: 17380 - protein, 7 aa, Artificial Sequence
  Synthetic construct
YFGYAVF

SEQ ID NO: 17381 - protein, 7 aa, Artificial Sequence
  Synthetic construct
YFGYAVY

SEQ ID NO: 17382 - protein, 7 aa, Artificial Sequence
  Synthetic construct
YFGYQFF

SEQ ID NO: 17383 - protein, 7 aa, Artificial Sequence
  Synthetic construct
YFGYQFY

SEQ ID NO: 17384 - protein, 7 aa, Artificial Sequence
  Synthetic construct
YFGYQRF

SEQ ID NO: 17385 - protein, 7 aa, Artificial Sequence
  Synthetic construct
YFGYQRY

SEQ ID NO: 17386 - protein, 7 aa, Artificial Sequence
  Synthetic construct
YFGYQCF

SEQ ID NO: 17387 - protein, 7 aa, Artificial Sequence
  Synthetic construct
YFGYQCY

SEQ ID NO: 17388 - protein, 7 aa, Artificial Sequence
  Synthetic construct
YFGYQLF

SEQ ID NO: 17389 - protein, 7 aa, Artificial Sequence
  Synthetic construct
YFGYQLY

SEQ ID NO: 17390 - protein, 7 aa, Artificial Sequence
  Synthetic construct
YFGYQAF

SEQ ID NO: 17391 - protein, 7 aa, Artificial Sequence
  Synthetic construct
YFGYQAY

SEQ ID NO: 17392 - protein, 7 aa, Artificial Sequence
  Synthetic construct
YFGYQQF

SEQ ID NO: 17393 - protein, 7 aa, Artificial Sequence
  Synthetic construct
YFGYQQY

SEQ ID NO: 17394 - protein, 7 aa, Artificial Sequence
  Synthetic construct
YFGYQDF

SEQ ID NO: 17395 - protein, 7 aa, Artificial Sequence
  Synthetic construct
YFGYQDY

SEQ ID NO: 17396 - protein, 7 aa, Artificial Sequence
  Synthetic construct
YFGYQVF

SEQ ID NO: 17397 - protein, 7 aa, Artificial Sequence
  Synthetic construct
YFGYQVY

SEQ ID NO: 17398 - protein, 7 aa, Artificial Sequence
  Synthetic construct
YFGPIFF

SEQ ID NO: 17399 - protein, 7 aa, Artificial Sequence
  Synthetic construct
YFGPIFY

SEQ ID NO: 17400 - protein, 7 aa, Artificial Sequence
  Synthetic construct
YFGPIRF

SEQ ID NO: 17401 - protein, 7 aa, Artificial Sequence
  Synthetic construct
YFGPIRY

SEQ ID NO: 17402 - protein, 7 aa, Artificial Sequence
  Synthetic construct
YFGPICF

SEQ ID NO: 17403 - protein, 7 aa, Artificial Sequence
  Synthetic construct
YFGPICY

SEQ ID NO: 17404 - protein, 7 aa, Artificial Sequence
  Synthetic construct
YFGPILF

SEQ ID NO: 17405 - protein, 7 aa, Artificial Sequence
  Synthetic construct
YFGPILY

SEQ ID NO: 17406 - protein, 7 aa, Artificial Sequence
  Synthetic construct
YFGPIAF

SEQ ID NO: 17407 - protein, 7 aa, Artificial Sequence
  Synthetic construct
YFGPIAY

SEQ ID NO: 17408 - protein, 7 aa, Artificial Sequence
  Synthetic construct
YFGPIQF

SEQ ID NO: 17409 - protein, 7 aa, Artificial Sequence
  Synthetic construct
YFGPIQY

SEQ ID NO: 17410 - protein, 7 aa, Artificial Sequence
  Synthetic construct
YFGPIDF

SEQ ID NO: 17411 - protein, 7 aa, Artificial Sequence
  Synthetic construct
YFGPIDY

SEQ ID NO: 17412 - protein, 7 aa, Artificial Sequence
  Synthetic construct
YFGPIVF

SEQ ID NO: 17413 - protein, 7 aa, Artificial Sequence
  Synthetic construct
YFGPIVY

SEQ ID NO: 17414 - protein, 7 aa, Artificial Sequence
  Synthetic construct
YFGPDFF

SEQ ID NO: 17415 - protein, 7 aa, Artificial Sequence
  Synthetic construct
YFGPDFY

SEQ ID NO: 17416 - protein, 7 aa, Artificial Sequence
  Synthetic construct
YFGPDRF

SEQ ID NO: 17417 - protein, 7 aa, Artificial Sequence
  Synthetic construct
YFGPDRY

SEQ ID NO: 17418 - protein, 7 aa, Artificial Sequence
  Synthetic construct
YFGPDCF

SEQ ID NO: 17419 - protein, 7 aa, Artificial Sequence
  Synthetic construct
YFGPDCY

SEQ ID NO: 17420 - protein, 7 aa, Artificial Sequence
  Synthetic construct
YFGPDLF

SEQ ID NO: 17421 - protein, 7 aa, Artificial Sequence
  Synthetic construct
YFGPDLY

SEQ ID NO: 17422 - protein, 7 aa, Artificial Sequence
  Synthetic construct
YFGPDAF

SEQ ID NO: 17423 - protein, 7 aa, Artificial Sequence
  Synthetic construct
YFGPDAY

SEQ ID NO: 17424 - protein, 7 aa, Artificial Sequence
  Synthetic construct
YFGPDQF

SEQ ID NO: 17425 - protein, 7 aa, Artificial Sequence
  Synthetic construct
YFGPDQY

SEQ ID NO: 17426 - protein, 7 aa, Artificial Sequence
  Synthetic construct
YFGPDDF

SEQ ID NO: 17427 - protein, 7 aa, Artificial Sequence
  Synthetic construct
YFGPDDY

SEQ ID NO: 17428 - protein, 7 aa, Artificial Sequence
  Synthetic construct
YFGPDVF

SEQ ID NO: 17429 - protein, 7 aa, Artificial Sequence
  Synthetic construct
YFGPDVY

SEQ ID NO: 17430 - protein, 7 aa, Artificial Sequence
  Synthetic construct
YFGPYFF

SEQ ID NO: 17431 - protein, 7 aa, Artificial Sequence
  Synthetic construct
YFGPYFY

SEQ ID NO: 17432 - protein, 7 aa, Artificial Sequence
  Synthetic construct
YFGPYRF

SEQ ID NO: 17433 - protein, 7 aa, Artificial Sequence
  Synthetic construct
YFGPYRY

SEQ ID NO: 17434 - protein, 7 aa, Artificial Sequence
  Synthetic construct
YFGPYCF

SEQ ID NO: 17435 - protein, 7 aa, Artificial Sequence
  Synthetic construct
YFGPYCY

SEQ ID NO: 17436 - protein, 7 aa, Artificial Sequence
  Synthetic construct
YFGPYLF

SEQ ID NO: 17437 - protein, 7 aa, Artificial Sequence
  Synthetic construct
YFGPYLY

SEQ ID NO: 17438 - protein, 7 aa, Artificial Sequence
  Synthetic construct
YFGPYAF

SEQ ID NO: 17439 - protein, 7 aa, Artificial Sequence
  Synthetic construct
YFGPYAY

SEQ ID NO: 17440 - protein, 7 aa, Artificial Sequence
  Synthetic construct
YFGPYQF

SEQ ID NO: 17441 - protein, 7 aa, Artificial Sequence
  Synthetic construct
YFGPYQY

SEQ ID NO: 17442 - protein, 7 aa, Artificial Sequence
  Synthetic construct
YFGPYDF

SEQ ID NO: 17443 - protein, 7 aa, Artificial Sequence
  Synthetic construct
YFGPYDY

SEQ ID NO: 17444 - protein, 7 aa, Artificial Sequence
  Synthetic construct
YFGPYVF

SEQ ID NO: 17445 - protein, 7 aa, Artificial Sequence
  Synthetic construct
YFGPYVY

SEQ ID NO: 17446 - protein, 7 aa, Artificial Sequence
  Synthetic construct
YFGPFFF

SEQ ID NO: 17447 - protein, 7 aa, Artificial Sequence
  Synthetic construct
YFGPFFY

SEQ ID NO: 17448 - protein, 7 aa, Artificial Sequence
  Synthetic construct
YFGPFRF

SEQ ID NO: 17449 - protein, 7 aa, Artificial Sequence
  Synthetic construct
YFGPFRY

SEQ ID NO: 17450 - protein, 7 aa, Artificial Sequence
  Synthetic construct
YFGPFCF

SEQ ID NO: 17451 - protein, 7 aa, Artificial Sequence
  Synthetic construct
YFGPFCY

SEQ ID NO: 17452 - protein, 7 aa, Artificial Sequence
  Synthetic construct
YFGPFLF

SEQ ID NO: 17453 - protein, 7 aa, Artificial Sequence
  Synthetic construct
YFGPFLY

SEQ ID NO: 17454 - protein, 7 aa, Artificial Sequence
  Synthetic construct
YFGPFAF

SEQ ID NO: 17455 - protein, 7 aa, Artificial Sequence
  Synthetic construct
YFGPFAY

SEQ ID NO: 17456 - protein, 7 aa, Artificial Sequence
  Synthetic construct
YFGPFQF

SEQ ID NO: 17457 - protein, 7 aa, Artificial Sequence
  Synthetic construct
YFGPFQY

SEQ ID NO: 17458 - protein, 7 aa, Artificial Sequence
  Synthetic construct
YFGPFDF

SEQ ID NO: 17459 - protein, 7 aa, Artificial Sequence
  Synthetic construct
YFGPFDY

SEQ ID NO: 17460 - protein, 7 aa, Artificial Sequence
  Synthetic construct
YFGPFVF

SEQ ID NO: 17461 - protein, 7 aa, Artificial Sequence
  Synthetic construct
YFGPFVY

SEQ ID NO: 17462 - protein, 7 aa, Artificial Sequence
  Synthetic construct
YFGPVFF

SEQ ID NO: 17463 - protein, 7 aa, Artificial Sequence
  Synthetic construct
YFGPVFY

SEQ ID NO: 17464 - protein, 7 aa, Artificial Sequence
  Synthetic construct
YFGPVRF

SEQ ID NO: 17465 - protein, 7 aa, Artificial Sequence
  Synthetic construct
YFGPVRY

SEQ ID NO: 17466 - protein, 7 aa, Artificial Sequence
  Synthetic construct
YFGPVCF

SEQ ID NO: 17467 - protein, 7 aa, Artificial Sequence
  Synthetic construct
YFGPVCY

SEQ ID NO: 17468 - protein, 7 aa, Artificial Sequence
  Synthetic construct
YFGPVLF

SEQ ID NO: 17469 - protein, 7 aa, Artificial Sequence
  Synthetic construct
YFGPVLY

SEQ ID NO: 17470 - protein, 7 aa, Artificial Sequence
  Synthetic construct
YFGPVAF

SEQ ID NO: 17471 - protein, 7 aa, Artificial Sequence
  Synthetic construct
YFGPVAY

SEQ ID NO: 17472 - protein, 7 aa, Artificial Sequence
  Synthetic construct
YFGPVQF

SEQ ID NO: 17473 - protein, 7 aa, Artificial Sequence
  Synthetic construct
YFGPVQY

SEQ ID NO: 17474 - protein, 7 aa, Artificial Sequence
  Synthetic construct
YFGPVDF

SEQ ID NO: 17475 - protein, 7 aa, Artificial Sequence
  Synthetic construct
YFGPVDY

SEQ ID NO: 17476 - protein, 7 aa, Artificial Sequence
  Synthetic construct
YFGPVVF

SEQ ID NO: 17477 - protein, 7 aa, Artificial Sequence
  Synthetic construct
YFGPVVY

SEQ ID NO: 17478 - protein, 7 aa, Artificial Sequence
  Synthetic construct
YFGPTFF

SEQ ID NO: 17479 - protein, 7 aa, Artificial Sequence
  Synthetic construct
YFGPTFY

SEQ ID NO: 17480 - protein, 7 aa, Artificial Sequence
  Synthetic construct
YFGPTRF

SEQ ID NO: 17481 - protein, 7 aa, Artificial Sequence
  Synthetic construct
YFGPTRY

SEQ ID NO: 17482 - protein, 7 aa, Artificial Sequence
  Synthetic construct
YFGPTCF

SEQ ID NO: 17483 - protein, 7 aa, Artificial Sequence
  Synthetic construct
YFGPTCY

SEQ ID NO: 17484 - protein, 7 aa, Artificial Sequence
  Synthetic construct
YFGPTLF

SEQ ID NO: 17485 - protein, 7 aa, Artificial Sequence
  Synthetic construct
YFGPTLY

SEQ ID NO: 17486 - protein, 7 aa, Artificial Sequence
  Synthetic construct
YFGPTAF

SEQ ID NO: 17487 - protein, 7 aa, Artificial Sequence
  Synthetic construct
YFGPTAY

SEQ ID NO: 17488 - protein, 7 aa, Artificial Sequence
  Synthetic construct
YFGPTQF

SEQ ID NO: 17489 - protein, 7 aa, Artificial Sequence
  Synthetic construct
YFGPTQY

SEQ ID NO: 17490 - protein, 7 aa, Artificial Sequence
  Synthetic construct
YFGPTDF

SEQ ID NO: 17491 - protein, 7 aa, Artificial Sequence
  Synthetic construct
YFGPTDY

SEQ ID NO: 17492 - protein, 7 aa, Artificial Sequence
  Synthetic construct
YFGPTVF

SEQ ID NO: 17493 - protein, 7 aa, Artificial Sequence
  Synthetic construct
YFGPTVY

SEQ ID NO: 17494 - protein, 7 aa, Artificial Sequence
  Synthetic construct
YFGPGFF

SEQ ID NO: 17495 - protein, 7 aa, Artificial Sequence
  Synthetic construct
YFGPGFY

SEQ ID NO: 17496 - protein, 7 aa, Artificial Sequence
  Synthetic construct
YFGPGRF

SEQ ID NO: 17497 - protein, 7 aa, Artificial Sequence
  Synthetic construct
YFGPGRY

SEQ ID NO: 17498 - protein, 7 aa, Artificial Sequence
  Synthetic construct
YFGPGCF

SEQ ID NO: 17499 - protein, 7 aa, Artificial Sequence
  Synthetic construct
YFGPGCY

SEQ ID NO: 17500 - protein, 7 aa, Artificial Sequence
  Synthetic construct
YFGPGLF

SEQ ID NO: 17501 - protein, 7 aa, Artificial Sequence
  Synthetic construct
YFGPGLY

SEQ ID NO: 17502 - protein, 7 aa, Artificial Sequence
  Synthetic construct
YFGPGAF

SEQ ID NO: 17503 - protein, 7 aa, Artificial Sequence
  Synthetic construct
YFGPGAY

SEQ ID NO: 17504 - protein, 7 aa, Artificial Sequence
  Synthetic construct
YFGPGQF

SEQ ID NO: 17505 - protein, 7 aa, Artificial Sequence
  Synthetic construct
YFGPGQY

SEQ ID NO: 17506 - protein, 7 aa, Artificial Sequence
  Synthetic construct
YFGPGDF

SEQ ID NO: 17507 - protein, 7 aa, Artificial Sequence
  Synthetic construct
YFGPGDY

SEQ ID NO: 17508 - protein, 7 aa, Artificial Sequence
  Synthetic construct
YFGPGVF

SEQ ID NO: 17509 - protein, 7 aa, Artificial Sequence
  Synthetic construct
YFGPGVY

SEQ ID NO: 17510 - protein, 7 aa, Artificial Sequence
  Synthetic construct
YFGPAFF

SEQ ID NO: 17511 - protein, 7 aa, Artificial Sequence
  Synthetic construct
YFGPAFY

SEQ ID NO: 17512 - protein, 7 aa, Artificial Sequence
  Synthetic construct
YFGPARF

SEQ ID NO: 17513 - protein, 7 aa, Artificial Sequence
  Synthetic construct
YFGPARY

SEQ ID NO: 17514 - protein, 7 aa, Artificial Sequence
  Synthetic construct
YFGPACF

SEQ ID NO: 17515 - protein, 7 aa, Artificial Sequence
  Synthetic construct
YFGPACY

SEQ ID NO: 17516 - protein, 7 aa, Artificial Sequence
  Synthetic construct
YFGPALF

SEQ ID NO: 17517 - protein, 7 aa, Artificial Sequence
  Synthetic construct
YFGPALY

SEQ ID NO: 17518 - protein, 7 aa, Artificial Sequence
  Synthetic construct
YFGPAAF

SEQ ID NO: 17519 - protein, 7 aa, Artificial Sequence
  Synthetic construct
YFGPAAY

SEQ ID NO: 17520 - protein, 7 aa, Artificial Sequence
  Synthetic construct
YFGPAQF

SEQ ID NO: 17521 - protein, 7 aa, Artificial Sequence
  Synthetic construct
YFGPAQY

SEQ ID NO: 17522 - protein, 7 aa, Artificial Sequence
  Synthetic construct
YFGPADF

SEQ ID NO: 17523 - protein, 7 aa, Artificial Sequence
  Synthetic construct
YFGPADY

SEQ ID NO: 17524 - protein, 7 aa, Artificial Sequence
  Synthetic construct
YFGPAVF

SEQ ID NO: 17525 - protein, 7 aa, Artificial Sequence
  Synthetic construct
YFGPAVY

SEQ ID NO: 17526 - protein, 7 aa, Artificial Sequence
  Synthetic construct
YFGPQFF

SEQ ID NO: 17527 - protein, 7 aa, Artificial Sequence
  Synthetic construct
YFGPQFY

SEQ ID NO: 17528 - protein, 7 aa, Artificial Sequence
  Synthetic construct
YFGPQRF

SEQ ID NO: 17529 - protein, 7 aa, Artificial Sequence
  Synthetic construct
YFGPQRY

SEQ ID NO: 17530 - protein, 7 aa, Artificial Sequence
  Synthetic construct
YFGPQCF

SEQ ID NO: 17531 - protein, 7 aa, Artificial Sequence
  Synthetic construct
YFGPQCY

SEQ ID NO: 17532 - protein, 7 aa, Artificial Sequence
  Synthetic construct
YFGPQLF

SEQ ID NO: 17533 - protein, 7 aa, Artificial Sequence
  Synthetic construct
YFGPQLY

SEQ ID NO: 17534 - protein, 7 aa, Artificial Sequence
  Synthetic construct
YFGPQAF

SEQ ID NO: 17535 - protein, 7 aa, Artificial Sequence
  Synthetic construct
YFGPQAY

SEQ ID NO: 17536 - protein, 7 aa, Artificial Sequence
  Synthetic construct
YFGPQQF

SEQ ID NO: 17537 - protein, 7 aa, Artificial Sequence
  Synthetic construct
YFGPQQY

SEQ ID NO: 17538 - protein, 7 aa, Artificial Sequence
  Synthetic construct
YFGPQDF

SEQ ID NO: 17539 - protein, 7 aa, Artificial Sequence
  Synthetic construct
YFGPQDY

SEQ ID NO: 17540 - protein, 7 aa, Artificial Sequence
  Synthetic construct
YFGPQVF

SEQ ID NO: 17541 - protein, 7 aa, Artificial Sequence
  Synthetic construct
YFGPQVY

SEQ ID NO: 17542 - protein, 7 aa, Artificial Sequence
  Synthetic construct
YFGHIFF

SEQ ID NO: 17543 - protein, 7 aa, Artificial Sequence
  Synthetic construct
YFGHIFY

SEQ ID NO: 17544 - protein, 7 aa, Artificial Sequence
  Synthetic construct
YFGHIRF

SEQ ID NO: 17545 - protein, 7 aa, Artificial Sequence
  Synthetic construct
YFGHIRY

SEQ ID NO: 17546 - protein, 7 aa, Artificial Sequence
  Synthetic construct
YFGHICF

SEQ ID NO: 17547 - protein, 7 aa, Artificial Sequence
  Synthetic construct
YFGHICY

SEQ ID NO: 17548 - protein, 7 aa, Artificial Sequence
  Synthetic construct
YFGHILF

SEQ ID NO: 17549 - protein, 7 aa, Artificial Sequence
  Synthetic construct
YFGHILY

SEQ ID NO: 17550 - protein, 7 aa, Artificial Sequence
  Synthetic construct
YFGHIAF

SEQ ID NO: 17551 - protein, 7 aa, Artificial Sequence
  Synthetic construct
YFGHIAY

SEQ ID NO: 17552 - protein, 7 aa, Artificial Sequence
  Synthetic construct
YFGHIQF

SEQ ID NO: 17553 - protein, 7 aa, Artificial Sequence
  Synthetic construct
YFGHIQY

SEQ ID NO: 17554 - protein, 7 aa, Artificial Sequence
  Synthetic construct
YFGHIDF

SEQ ID NO: 17555 - protein, 7 aa, Artificial Sequence
  Synthetic construct
YFGHIDY

SEQ ID NO: 17556 - protein, 7 aa, Artificial Sequence
  Synthetic construct
YFGHIVF

SEQ ID NO: 17557 - protein, 7 aa, Artificial Sequence
  Synthetic construct
YFGHIVY

SEQ ID NO: 17558 - protein, 7 aa, Artificial Sequence
  Synthetic construct
YFGHDFF

SEQ ID NO: 17559 - protein, 7 aa, Artificial Sequence
  Synthetic construct
YFGHDFY

SEQ ID NO: 17560 - protein, 7 aa, Artificial Sequence
  Synthetic construct
YFGHDRF

SEQ ID NO: 17561 - protein, 7 aa, Artificial Sequence
  Synthetic construct
YFGHDRY

SEQ ID NO: 17562 - protein, 7 aa, Artificial Sequence
  Synthetic construct
YFGHDCF

SEQ ID NO: 17563 - protein, 7 aa, Artificial Sequence
  Synthetic construct
YFGHDCY

SEQ ID NO: 17564 - protein, 7 aa, Artificial Sequence
  Synthetic construct
YFGHDLF

SEQ ID NO: 17565 - protein, 7 aa, Artificial Sequence
  Synthetic construct
YFGHDLY

SEQ ID NO: 17566 - protein, 7 aa, Artificial Sequence
  Synthetic construct
YFGHDAF

SEQ ID NO: 17567 - protein, 7 aa, Artificial Sequence
  Synthetic construct
YFGHDAY

SEQ ID NO: 17568 - protein, 7 aa, Artificial Sequence
  Synthetic construct
YFGHDQF

SEQ ID NO: 17569 - protein, 7 aa, Artificial Sequence
  Synthetic construct
YFGHDQY

SEQ ID NO: 17570 - protein, 7 aa, Artificial Sequence
  Synthetic construct
YFGHDDF

SEQ ID NO: 17571 - protein, 7 aa, Artificial Sequence
  Synthetic construct
YFGHDDY

SEQ ID NO: 17572 - protein, 7 aa, Artificial Sequence
  Synthetic construct
YFGHDVF

SEQ ID NO: 17573 - protein, 7 aa, Artificial Sequence
  Synthetic construct
YFGHDVY

SEQ ID NO: 17574 - protein, 7 aa, Artificial Sequence
  Synthetic construct
YFGHYFF

SEQ ID NO: 17575 - protein, 7 aa, Artificial Sequence
  Synthetic construct
YFGHYFY

SEQ ID NO: 17576 - protein, 7 aa, Artificial Sequence
  Synthetic construct
YFGHYRF

SEQ ID NO: 17577 - protein, 7 aa, Artificial Sequence
  Synthetic construct
YFGHYRY

SEQ ID NO: 17578 - protein, 7 aa, Artificial Sequence
  Synthetic construct
YFGHYCF

SEQ ID NO: 17579 - protein, 7 aa, Artificial Sequence
  Synthetic construct
YFGHYCY

SEQ ID NO: 17580 - protein, 7 aa, Artificial Sequence
  Synthetic construct
YFGHYLF

SEQ ID NO: 17581 - protein, 7 aa, Artificial Sequence
  Synthetic construct
YFGHYLY

SEQ ID NO: 17582 - protein, 7 aa, Artificial Sequence
  Synthetic construct
YFGHYAF

SEQ ID NO: 17583 - protein, 7 aa, Artificial Sequence
  Synthetic construct
YFGHYAY

SEQ ID NO: 17584 - protein, 7 aa, Artificial Sequence
  Synthetic construct
YFGHYQF

SEQ ID NO: 17585 - protein, 7 aa, Artificial Sequence
  Synthetic construct
YFGHYQY

SEQ ID NO: 17586 - protein, 7 aa, Artificial Sequence
  Synthetic construct
YFGHYDF

SEQ ID NO: 17587 - protein, 7 aa, Artificial Sequence
  Synthetic construct
YFGHYDY

SEQ ID NO: 17588 - protein, 7 aa, Artificial Sequence
  Synthetic construct
YFGHYVF

SEQ ID NO: 17589 - protein, 7 aa, Artificial Sequence
  Synthetic construct
YFGHYVY

SEQ ID NO: 17590 - protein, 7 aa, Artificial Sequence
  Synthetic construct
YFGHFFF

SEQ ID NO: 17591 - protein, 7 aa, Artificial Sequence
  Synthetic construct
YFGHFFY

SEQ ID NO: 17592 - protein, 7 aa, Artificial Sequence
  Synthetic construct
YFGHFRF

SEQ ID NO: 17593 - protein, 7 aa, Artificial Sequence
  Synthetic construct
YFGHFRY

SEQ ID NO: 17594 - protein, 7 aa, Artificial Sequence
  Synthetic construct
YFGHFCF

SEQ ID NO: 17595 - protein, 7 aa, Artificial Sequence
  Synthetic construct
YFGHFCY

SEQ ID NO: 17596 - protein, 7 aa, Artificial Sequence
  Synthetic construct
YFGHFLF

SEQ ID NO: 17597 - protein, 7 aa, Artificial Sequence
  Synthetic construct
YFGHFLY

SEQ ID NO: 17598 - protein, 7 aa, Artificial Sequence
  Synthetic construct
YFGHFAF

SEQ ID NO: 17599 - protein, 7 aa, Artificial Sequence
  Synthetic construct
YFGHFAY

SEQ ID NO: 17600 - protein, 7 aa, Artificial Sequence
  Synthetic construct
YFGHFQF

SEQ ID NO: 17601 - protein, 7 aa, Artificial Sequence
  Synthetic construct
YFGHFQY

SEQ ID NO: 17602 - protein, 7 aa, Artificial Sequence
  Synthetic construct
YFGHFDF

SEQ ID NO: 17603 - protein, 7 aa, Artificial Sequence
  Synthetic construct
YFGHFDY

SEQ ID NO: 17604 - protein, 7 aa, Artificial Sequence
  Synthetic construct
YFGHFVF

SEQ ID NO: 17605 - protein, 7 aa, Artificial Sequence
  Synthetic construct
YFGHFVY

SEQ ID NO: 17606 - protein, 7 aa, Artificial Sequence
  Synthetic construct
YFGHVFF

SEQ ID NO: 17607 - protein, 7 aa, Artificial Sequence
  Synthetic construct
YFGHVFY

SEQ ID NO: 17608 - protein, 7 aa, Artificial Sequence
  Synthetic construct
YFGHVRF

SEQ ID NO: 17609 - protein, 7 aa, Artificial Sequence
  Synthetic construct
YFGHVRY

SEQ ID NO: 17610 - protein, 7 aa, Artificial Sequence
  Synthetic construct
YFGHVCF

SEQ ID NO: 17611 - protein, 7 aa, Artificial Sequence
  Synthetic construct
YFGHVCY

SEQ ID NO: 17612 - protein, 7 aa, Artificial Sequence
  Synthetic construct
YFGHVLF

SEQ ID NO: 17613 - protein, 7 aa, Artificial Sequence
  Synthetic construct
YFGHVLY

SEQ ID NO: 17614 - protein, 7 aa, Artificial Sequence
  Synthetic construct
YFGHVAF

SEQ ID NO: 17615 - protein, 7 aa, Artificial Sequence
  Synthetic construct
YFGHVAY

SEQ ID NO: 17616 - protein, 7 aa, Artificial Sequence
  Synthetic construct
YFGHVQF

SEQ ID NO: 17617 - protein, 7 aa, Artificial Sequence
  Synthetic construct
YFGHVQY

SEQ ID NO: 17618 - protein, 7 aa, Artificial Sequence
  Synthetic construct
YFGHVDF

SEQ ID NO: 17619 - protein, 7 aa, Artificial Sequence
  Synthetic construct
YFGHVDY

SEQ ID NO: 17620 - protein, 7 aa, Artificial Sequence
  Synthetic construct
YFGHVVF

SEQ ID NO: 17621 - protein, 7 aa, Artificial Sequence
  Synthetic construct
YFGHVVY

SEQ ID NO: 17622 - protein, 7 aa, Artificial Sequence
  Synthetic construct
YFGHTFF

SEQ ID NO: 17623 - protein, 7 aa, Artificial Sequence
  Synthetic construct
YFGHTFY

SEQ ID NO: 17624 - protein, 7 aa, Artificial Sequence
  Synthetic construct
YFGHTRF

SEQ ID NO: 17625 - protein, 7 aa, Artificial Sequence
  Synthetic construct
YFGHTRY

SEQ ID NO: 17626 - protein, 7 aa, Artificial Sequence
  Synthetic construct
YFGHTCF

SEQ ID NO: 17627 - protein, 7 aa, Artificial Sequence
  Synthetic construct
YFGHTCY

SEQ ID NO: 17628 - protein, 7 aa, Artificial Sequence
  Synthetic construct
YFGHTLF

SEQ ID NO: 17629 - protein, 7 aa, Artificial Sequence
  Synthetic construct
YFGHTLY

SEQ ID NO: 17630 - protein, 7 aa, Artificial Sequence
  Synthetic construct
YFGHTAF

SEQ ID NO: 17631 - protein, 7 aa, Artificial Sequence
  Synthetic construct
YFGHTAY

SEQ ID NO: 17632 - protein, 7 aa, Artificial Sequence
  Synthetic construct
YFGHTQF

SEQ ID NO: 17633 - protein, 7 aa, Artificial Sequence
  Synthetic construct
YFGHTQY

SEQ ID NO: 17634 - protein, 7 aa, Artificial Sequence
  Synthetic construct
YFGHTDF

SEQ ID NO: 17635 - protein, 7 aa, Artificial Sequence
  Synthetic construct
YFGHTDY

SEQ ID NO: 17636 - protein, 7 aa, Artificial Sequence
  Synthetic construct
YFGHTVF

SEQ ID NO: 17637 - protein, 7 aa, Artificial Sequence
  Synthetic construct
YFGHTVY

SEQ ID NO: 17638 - protein, 7 aa, Artificial Sequence
  Synthetic construct
YFGHGFF

SEQ ID NO: 17639 - protein, 7 aa, Artificial Sequence
  Synthetic construct
YFGHGFY

SEQ ID NO: 17640 - protein, 7 aa, Artificial Sequence
  Synthetic construct
YFGHGRF

SEQ ID NO: 17641 - protein, 7 aa, Artificial Sequence
  Synthetic construct
YFGHGRY

SEQ ID NO: 17642 - protein, 7 aa, Artificial Sequence
  Synthetic construct
YFGHGCF

SEQ ID NO: 17643 - protein, 7 aa, Artificial Sequence
  Synthetic construct
YFGHGCY

SEQ ID NO: 17644 - protein, 7 aa, Artificial Sequence
  Synthetic construct
YFGHGLF

SEQ ID NO: 17645 - protein, 7 aa, Artificial Sequence
  Synthetic construct
YFGHGLY

SEQ ID NO: 17646 - protein, 7 aa, Artificial Sequence
  Synthetic construct
YFGHGAF

SEQ ID NO: 17647 - protein, 7 aa, Artificial Sequence
  Synthetic construct
YFGHGAY

SEQ ID NO: 17648 - protein, 7 aa, Artificial Sequence
  Synthetic construct
YFGHGQF

SEQ ID NO: 17649 - protein, 7 aa, Artificial Sequence
  Synthetic construct
YFGHGQY

SEQ ID NO: 17650 - protein, 7 aa, Artificial Sequence
  Synthetic construct
YFGHGDF

SEQ ID NO: 17651 - protein, 7 aa, Artificial Sequence
  Synthetic construct
YFGHGDY

SEQ ID NO: 17652 - protein, 7 aa, Artificial Sequence
  Synthetic construct
YFGHGVF

SEQ ID NO: 17653 - protein, 7 aa, Artificial Sequence
  Synthetic construct
YFGHGVY

SEQ ID NO: 17654 - protein, 7 aa, Artificial Sequence
  Synthetic construct
YFGHAFF

SEQ ID NO: 17655 - protein, 7 aa, Artificial Sequence
  Synthetic construct
YFGHAFY

SEQ ID NO: 17656 - protein, 7 aa, Artificial Sequence
  Synthetic construct
YFGHARF

SEQ ID NO: 17657 - protein, 7 aa, Artificial Sequence
  Synthetic construct
YFGHARY

SEQ ID NO: 17658 - protein, 7 aa, Artificial Sequence
  Synthetic construct
YFGHACF

SEQ ID NO: 17659 - protein, 7 aa, Artificial Sequence
  Synthetic construct
YFGHACY

SEQ ID NO: 17660 - protein, 7 aa, Artificial Sequence
  Synthetic construct
YFGHALF

SEQ ID NO: 17661 - protein, 7 aa, Artificial Sequence
  Synthetic construct
YFGHALY

SEQ ID NO: 17662 - protein, 7 aa, Artificial Sequence
  Synthetic construct
YFGHAAF

SEQ ID NO: 17663 - protein, 7 aa, Artificial Sequence
  Synthetic construct
YFGHAAY

SEQ ID NO: 17664 - protein, 7 aa, Artificial Sequence
  Synthetic construct
YFGHAQF

SEQ ID NO: 17665 - protein, 7 aa, Artificial Sequence
  Synthetic construct
YFGHAQY

SEQ ID NO: 17666 - protein, 7 aa, Artificial Sequence
  Synthetic construct
YFGHADF

SEQ ID NO: 17667 - protein, 7 aa, Artificial Sequence
  Synthetic construct
YFGHADY

SEQ ID NO: 17668 - protein, 7 aa, Artificial Sequence
  Synthetic construct
YFGHAVF

SEQ ID NO: 17669 - protein, 7 aa, Artificial Sequence
  Synthetic construct
YFGHAVY

SEQ ID NO: 17670 - protein, 7 aa, Artificial Sequence
  Synthetic construct
YFGHQFF

SEQ ID NO: 17671 - protein, 7 aa, Artificial Sequence
  Synthetic construct
YFGHQFY

SEQ ID NO: 17672 - protein, 7 aa, Artificial Sequence
  Synthetic construct
YFGHQRF

SEQ ID NO: 17673 - protein, 7 aa, Artificial Sequence
  Synthetic construct
YFGHQRY

SEQ ID NO: 17674 - protein, 7 aa, Artificial Sequence
  Synthetic construct
YFGHQCF

SEQ ID NO: 17675 - protein, 7 aa, Artificial Sequence
  Synthetic construct
YFGHQCY

SEQ ID NO: 17676 - protein, 7 aa, Artificial Sequence
  Synthetic construct
YFGHQLF

SEQ ID NO: 17677 - protein, 7 aa, Artificial Sequence
  Synthetic construct
YFGHQLY

SEQ ID NO: 17678 - protein, 7 aa, Artificial Sequence
  Synthetic construct
YFGHQAF

SEQ ID NO: 17679 - protein, 7 aa, Artificial Sequence
  Synthetic construct
YFGHQAY

SEQ ID NO: 17680 - protein, 7 aa, Artificial Sequence
  Synthetic construct
YFGHQQF

SEQ ID NO: 17681 - protein, 7 aa, Artificial Sequence
  Synthetic construct
YFGHQQY

SEQ ID NO: 17682 - protein, 7 aa, Artificial Sequence
  Synthetic construct
YFGHQDF

SEQ ID NO: 17683 - protein, 7 aa, Artificial Sequence
  Synthetic construct
YFGHQDY

SEQ ID NO: 17684 - protein, 7 aa, Artificial Sequence
  Synthetic construct
YFGHQVF

SEQ ID NO: 17685 - protein, 7 aa, Artificial Sequence
  Synthetic construct
YFGHQVY

SEQ ID NO: 17686 - protein, 7 aa, Artificial Sequence
  Synthetic construct
YFGLIFF

SEQ ID NO: 17687 - protein, 7 aa, Artificial Sequence
  Synthetic construct
YFGLIFY

SEQ ID NO: 17688 - protein, 7 aa, Artificial Sequence
  Synthetic construct
YFGLIRF

SEQ ID NO: 17689 - protein, 7 aa, Artificial Sequence
  Synthetic construct
YFGLIRY

SEQ ID NO: 17690 - protein, 7 aa, Artificial Sequence
  Synthetic construct
YFGLICF

SEQ ID NO: 17691 - protein, 7 aa, Artificial Sequence
  Synthetic construct
YFGLICY

SEQ ID NO: 17692 - protein, 7 aa, Artificial Sequence
  Synthetic construct
YFGLILF

SEQ ID NO: 17693 - protein, 7 aa, Artificial Sequence
  Synthetic construct
YFGLILY

SEQ ID NO: 17694 - protein, 7 aa, Artificial Sequence
  Synthetic construct
YFGLIAF

SEQ ID NO: 17695 - protein, 7 aa, Artificial Sequence
  Synthetic construct
YFGLIAY

SEQ ID NO: 17696 - protein, 7 aa, Artificial Sequence
  Synthetic construct
YFGLIQF

SEQ ID NO: 17697 - protein, 7 aa, Artificial Sequence
  Synthetic construct
YFGLIQY

SEQ ID NO: 17698 - protein, 7 aa, Artificial Sequence
  Synthetic construct
YFGLIDF

SEQ ID NO: 17699 - protein, 7 aa, Artificial Sequence
  Synthetic construct
YFGLIDY

SEQ ID NO: 17700 - protein, 7 aa, Artificial Sequence
  Synthetic construct
YFGLIVF

SEQ ID NO: 17701 - protein, 7 aa, Artificial Sequence
  Synthetic construct
YFGLIVY

SEQ ID NO: 17702 - protein, 7 aa, Artificial Sequence
  Synthetic construct
YFGLDFF

SEQ ID NO: 17703 - protein, 7 aa, Artificial Sequence
  Synthetic construct
YFGLDFY

SEQ ID NO: 17704 - protein, 7 aa, Artificial Sequence
  Synthetic construct
YFGLDRF

SEQ ID NO: 17705 - protein, 7 aa, Artificial Sequence
  Synthetic construct
YFGLDRY

SEQ ID NO: 17706 - protein, 7 aa, Artificial Sequence
  Synthetic construct
YFGLDCF

SEQ ID NO: 17707 - protein, 7 aa, Artificial Sequence
  Synthetic construct
YFGLDCY

SEQ ID NO: 17708 - protein, 7 aa, Artificial Sequence
  Synthetic construct
YFGLDLF

SEQ ID NO: 17709 - protein, 7 aa, Artificial Sequence
  Synthetic construct
YFGLDLY

SEQ ID NO: 17710 - protein, 7 aa, Artificial Sequence
  Synthetic construct
YFGLDAF

SEQ ID NO: 17711 - protein, 7 aa, Artificial Sequence
  Synthetic construct
YFGLDAY

SEQ ID NO: 17712 - protein, 7 aa, Artificial Sequence
  Synthetic construct
YFGLDQF

SEQ ID NO: 17713 - protein, 7 aa, Artificial Sequence
  Synthetic construct
YFGLDQY

SEQ ID NO: 17714 - protein, 7 aa, Artificial Sequence
  Synthetic construct
YFGLDDF

SEQ ID NO: 17715 - protein, 7 aa, Artificial Sequence
  Synthetic construct
YFGLDDY

SEQ ID NO: 17716 - protein, 7 aa, Artificial Sequence
  Synthetic construct
YFGLDVF

SEQ ID NO: 17717 - protein, 7 aa, Artificial Sequence
  Synthetic construct
YFGLDVY

SEQ ID NO: 17718 - protein, 7 aa, Artificial Sequence
  Synthetic construct
YFGLYFF

SEQ ID NO: 17719 - protein, 7 aa, Artificial Sequence
  Synthetic construct
YFGLYFY

SEQ ID NO: 17720 - protein, 7 aa, Artificial Sequence
  Synthetic construct
YFGLYRF

SEQ ID NO: 17721 - protein, 7 aa, Artificial Sequence
  Synthetic construct
YFGLYRY

SEQ ID NO: 17722 - protein, 7 aa, Artificial Sequence
  Synthetic construct
YFGLYCF

SEQ ID NO: 17723 - protein, 7 aa, Artificial Sequence
  Synthetic construct
YFGLYCY

SEQ ID NO: 17724 - protein, 7 aa, Artificial Sequence
  Synthetic construct
YFGLYLF

SEQ ID NO: 17725 - protein, 7 aa, Artificial Sequence
  Synthetic construct
YFGLYLY

SEQ ID NO: 17726 - protein, 7 aa, Artificial Sequence
  Synthetic construct
YFGLYAF

SEQ ID NO: 17727 - protein, 7 aa, Artificial Sequence
  Synthetic construct
YFGLYAY

SEQ ID NO: 17728 - protein, 7 aa, Artificial Sequence
  Synthetic construct
YFGLYQF

SEQ ID NO: 17729 - protein, 7 aa, Artificial Sequence
  Synthetic construct
YFGLYQY

SEQ ID NO: 17730 - protein, 7 aa, Artificial Sequence
  Synthetic construct
YFGLYDF

SEQ ID NO: 17731 - protein, 7 aa, Artificial Sequence
  Synthetic construct
YFGLYDY

SEQ ID NO: 17732 - protein, 7 aa, Artificial Sequence
  Synthetic construct
YFGLYVF

SEQ ID NO: 17733 - protein, 7 aa, Artificial Sequence
  Synthetic construct
YFGLYVY

SEQ ID NO: 17734 - protein, 7 aa, Artificial Sequence
  Synthetic construct
YFGLFFF

SEQ ID NO: 17735 - protein, 7 aa, Artificial Sequence
  Synthetic construct
YFGLFFY

SEQ ID NO: 17736 - protein, 7 aa, Artificial Sequence
  Synthetic construct
YFGLFRF

SEQ ID NO: 17737 - protein, 7 aa, Artificial Sequence
  Synthetic construct
YFGLFRY

SEQ ID NO: 17738 - protein, 7 aa, Artificial Sequence
  Synthetic construct
YFGLFCF

SEQ ID NO: 17739 - protein, 7 aa, Artificial Sequence
  Synthetic construct
YFGLFCY

SEQ ID NO: 17740 - protein, 7 aa, Artificial Sequence
  Synthetic construct
YFGLFLF

SEQ ID NO: 17741 - protein, 7 aa, Artificial Sequence
  Synthetic construct
YFGLFLY

SEQ ID NO: 17742 - protein, 7 aa, Artificial Sequence
  Synthetic construct
YFGLFAF

SEQ ID NO: 17743 - protein, 7 aa, Artificial Sequence
  Synthetic construct
YFGLFAY

SEQ ID NO: 17744 - protein, 7 aa, Artificial Sequence
  Synthetic construct
YFGLFQF

SEQ ID NO: 17745 - protein, 7 aa, Artificial Sequence
  Synthetic construct
YFGLFQY

SEQ ID NO: 17746 - protein, 7 aa, Artificial Sequence
  Synthetic construct
YFGLFDF

SEQ ID NO: 17747 - protein, 7 aa, Artificial Sequence
  Synthetic construct
YFGLFDY

SEQ ID NO: 17748 - protein, 7 aa, Artificial Sequence
  Synthetic construct
YFGLFVF

SEQ ID NO: 17749 - protein, 7 aa, Artificial Sequence
  Synthetic construct
YFGLFVY

SEQ ID NO: 17750 - protein, 7 aa, Artificial Sequence
  Synthetic construct
YFGLVFF

SEQ ID NO: 17751 - protein, 7 aa, Artificial Sequence
  Synthetic construct
YFGLVFY

SEQ ID NO: 17752 - protein, 7 aa, Artificial Sequence
  Synthetic construct
YFGLVRF

SEQ ID NO: 17753 - protein, 7 aa, Artificial Sequence
  Synthetic construct
YFGLVRY

SEQ ID NO: 17754 - protein, 7 aa, Artificial Sequence
  Synthetic construct
YFGLVCF

SEQ ID NO: 17755 - protein, 7 aa, Artificial Sequence
  Synthetic construct
YFGLVCY

SEQ ID NO: 17756 - protein, 7 aa, Artificial Sequence
  Synthetic construct
YFGLVLF

SEQ ID NO: 17757 - protein, 7 aa, Artificial Sequence
  Synthetic construct
YFGLVLY

SEQ ID NO: 17758 - protein, 7 aa, Artificial Sequence
  Synthetic construct
YFGLVAF

SEQ ID NO: 17759 - protein, 7 aa, Artificial Sequence
  Synthetic construct
YFGLVAY

SEQ ID NO: 17760 - protein, 7 aa, Artificial Sequence
  Synthetic construct
YFGLVQF

SEQ ID NO: 17761 - protein, 7 aa, Artificial Sequence
  Synthetic construct
YFGLVQY

SEQ ID NO: 17762 - protein, 7 aa, Artificial Sequence
  Synthetic construct
YFGLVDF

SEQ ID NO: 17763 - protein, 7 aa, Artificial Sequence
  Synthetic construct
YFGLVDY

SEQ ID NO: 17764 - protein, 7 aa, Artificial Sequence
  Synthetic construct
YFGLVVF

SEQ ID NO: 17765 - protein, 7 aa, Artificial Sequence
  Synthetic construct
YFGLVVY

SEQ ID NO: 17766 - protein, 7 aa, Artificial Sequence
  Synthetic construct
YFGLTFF

SEQ ID NO: 17767 - protein, 7 aa, Artificial Sequence
  Synthetic construct
YFGLTFY

SEQ ID NO: 17768 - protein, 7 aa, Artificial Sequence
  Synthetic construct
YFGLTRF

SEQ ID NO: 17769 - protein, 7 aa, Artificial Sequence
  Synthetic construct
YFGLTRY

SEQ ID NO: 17770 - protein, 7 aa, Artificial Sequence
  Synthetic construct
YFGLTCF

SEQ ID NO: 17771 - protein, 7 aa, Artificial Sequence
  Synthetic construct
YFGLTCY

SEQ ID NO: 17772 - protein, 7 aa, Artificial Sequence
  Synthetic construct
YFGLTLF

SEQ ID NO: 17773 - protein, 7 aa, Artificial Sequence
  Synthetic construct
YFGLTLY

SEQ ID NO: 17774 - protein, 7 aa, Artificial Sequence
  Synthetic construct
YFGLTAF

SEQ ID NO: 17775 - protein, 7 aa, Artificial Sequence
  Synthetic construct
YFGLTAY

SEQ ID NO: 17776 - protein, 7 aa, Artificial Sequence
  Synthetic construct
YFGLTQF

SEQ ID NO: 17777 - protein, 7 aa, Artificial Sequence
  Synthetic construct
YFGLTQY

SEQ ID NO: 17778 - protein, 7 aa, Artificial Sequence
  Synthetic construct
YFGLTDF

SEQ ID NO: 17779 - protein, 7 aa, Artificial Sequence
  Synthetic construct
YFGLTDY

SEQ ID NO: 17780 - protein, 7 aa, Artificial Sequence
  Synthetic construct
YFGLTVF

SEQ ID NO: 17781 - protein, 7 aa, Artificial Sequence
  Synthetic construct
YFGLTVY

SEQ ID NO: 17782 - protein, 7 aa, Artificial Sequence
  Synthetic construct
YFGLGFF

SEQ ID NO: 17783 - protein, 7 aa, Artificial Sequence
  Synthetic construct
YFGLGFY

SEQ ID NO: 17784 - protein, 7 aa, Artificial Sequence
  Synthetic construct
YFGLGRF

SEQ ID NO: 17785 - protein, 7 aa, Artificial Sequence
  Synthetic construct
YFGLGRY

SEQ ID NO: 17786 - protein, 7 aa, Artificial Sequence
  Synthetic construct
YFGLGCF

SEQ ID NO: 17787 - protein, 7 aa, Artificial Sequence
  Synthetic construct
YFGLGCY

SEQ ID NO: 17788 - protein, 7 aa, Artificial Sequence
  Synthetic construct
YFGLGLF

SEQ ID NO: 17789 - protein, 7 aa, Artificial Sequence
  Synthetic construct
YFGLGLY

SEQ ID NO: 17790 - protein, 7 aa, Artificial Sequence
  Synthetic construct
YFGLGAF

SEQ ID NO: 17791 - protein, 7 aa, Artificial Sequence
  Synthetic construct
YFGLGAY

SEQ ID NO: 17792 - protein, 7 aa, Artificial Sequence
  Synthetic construct
YFGLGQF

SEQ ID NO: 17793 - protein, 7 aa, Artificial Sequence
  Synthetic construct
YFGLGQY

SEQ ID NO: 17794 - protein, 7 aa, Artificial Sequence
  Synthetic construct
YFGLGDF

SEQ ID NO: 17795 - protein, 7 aa, Artificial Sequence
  Synthetic construct
YFGLGDY

SEQ ID NO: 17796 - protein, 7 aa, Artificial Sequence
  Synthetic construct
YFGLGVF

SEQ ID NO: 17797 - protein, 7 aa, Artificial Sequence
  Synthetic construct
YFGLGVY

SEQ ID NO: 17798 - protein, 7 aa, Artificial Sequence
  Synthetic construct
YFGLAFF

SEQ ID NO: 17799 - protein, 7 aa, Artificial Sequence
  Synthetic construct
YFGLAFY

SEQ ID NO: 17800 - protein, 7 aa, Artificial Sequence
  Synthetic construct
YFGLARF

SEQ ID NO: 17801 - protein, 7 aa, Artificial Sequence
  Synthetic construct
YFGLARY

SEQ ID NO: 17802 - protein, 7 aa, Artificial Sequence
  Synthetic construct
YFGLACF

SEQ ID NO: 17803 - protein, 7 aa, Artificial Sequence
  Synthetic construct
YFGLACY

SEQ ID NO: 17804 - protein, 7 aa, Artificial Sequence
  Synthetic construct
YFGLALF

SEQ ID NO: 17805 - protein, 7 aa, Artificial Sequence
  Synthetic construct
YFGLALY

SEQ ID NO: 17806 - protein, 7 aa, Artificial Sequence
  Synthetic construct
YFGLAAF

SEQ ID NO: 17807 - protein, 7 aa, Artificial Sequence
  Synthetic construct
YFGLAAY

SEQ ID NO: 17808 - protein, 7 aa, Artificial Sequence
  Synthetic construct
YFGLAQF

SEQ ID NO: 17809 - protein, 7 aa, Artificial Sequence
  Synthetic construct
YFGLAQY

SEQ ID NO: 17810 - protein, 7 aa, Artificial Sequence
  Synthetic construct
YFGLADF

SEQ ID NO: 17811 - protein, 7 aa, Artificial Sequence
  Synthetic construct
YFGLADY

SEQ ID NO: 17812 - protein, 7 aa, Artificial Sequence
  Synthetic construct
YFGLAVF

SEQ ID NO: 17813 - protein, 7 aa, Artificial Sequence
  Synthetic construct
YFGLAVY

SEQ ID NO: 17814 - protein, 7 aa, Artificial Sequence
  Synthetic construct
YFGLQFF

SEQ ID NO: 17815 - protein, 7 aa, Artificial Sequence
  Synthetic construct
YFGLQFY

SEQ ID NO: 17816 - protein, 7 aa, Artificial Sequence
  Synthetic construct
YFGLQRF

SEQ ID NO: 17817 - protein, 7 aa, Artificial Sequence
  Synthetic construct
YFGLQRY

SEQ ID NO: 17818 - protein, 7 aa, Artificial Sequence
  Synthetic construct
YFGLQCF

SEQ ID NO: 17819 - protein, 7 aa, Artificial Sequence
  Synthetic construct
YFGLQCY

SEQ ID NO: 17820 - protein, 7 aa, Artificial Sequence
  Synthetic construct
YFGLQLF

SEQ ID NO: 17821 - protein, 7 aa, Artificial Sequence
  Synthetic construct
YFGLQLY

SEQ ID NO: 17822 - protein, 7 aa, Artificial Sequence
  Synthetic construct
YFGLQAF

SEQ ID NO: 17823 - protein, 7 aa, Artificial Sequence
  Synthetic construct
YFGLQAY

SEQ ID NO: 17824 - protein, 7 aa, Artificial Sequence
  Synthetic construct
YFGLQQF

SEQ ID NO: 17825 - protein, 7 aa, Artificial Sequence
  Synthetic construct
YFGLQQY

SEQ ID NO: 17826 - protein, 7 aa, Artificial Sequence
  Synthetic construct
YFGLQDF

SEQ ID NO: 17827 - protein, 7 aa, Artificial Sequence
  Synthetic construct
YFGLQDY

SEQ ID NO: 17828 - protein, 7 aa, Artificial Sequence
  Synthetic construct
YFGLQVF

SEQ ID NO: 17829 - protein, 7 aa, Artificial Sequence
  Synthetic construct
YFGLQVY

SEQ ID NO: 17830 - protein, 7 aa, Artificial Sequence
  Synthetic construct
YFGFIFF

SEQ ID NO: 17831 - protein, 7 aa, Artificial Sequence
  Synthetic construct
YFGFIFY

SEQ ID NO: 17832 - protein, 7 aa, Artificial Sequence
  Synthetic construct
YFGFIRF

SEQ ID NO: 17833 - protein, 7 aa, Artificial Sequence
  Synthetic construct
YFGFIRY

SEQ ID NO: 17834 - protein, 7 aa, Artificial Sequence
  Synthetic construct
YFGFICF

SEQ ID NO: 17835 - protein, 7 aa, Artificial Sequence
  Synthetic construct
YFGFICY

SEQ ID NO: 17836 - protein, 7 aa, Artificial Sequence
  Synthetic construct
YFGFILF

SEQ ID NO: 17837 - protein, 7 aa, Artificial Sequence
  Synthetic construct
YFGFILY

SEQ ID NO: 17838 - protein, 7 aa, Artificial Sequence
  Synthetic construct
YFGFIAF

SEQ ID NO: 17839 - protein, 7 aa, Artificial Sequence
  Synthetic construct
YFGFIAY

SEQ ID NO: 17840 - protein, 7 aa, Artificial Sequence
  Synthetic construct
YFGFIQF

SEQ ID NO: 17841 - protein, 7 aa, Artificial Sequence
  Synthetic construct
YFGFIQY

SEQ ID NO: 17842 - protein, 7 aa, Artificial Sequence
  Synthetic construct
YFGFIDF

SEQ ID NO: 17843 - protein, 7 aa, Artificial Sequence
  Synthetic construct
YFGFIDY

SEQ ID NO: 17844 - protein, 7 aa, Artificial Sequence
  Synthetic construct
YFGFIVF

SEQ ID NO: 17845 - protein, 7 aa, Artificial Sequence
  Synthetic construct
YFGFIVY

SEQ ID NO: 17846 - protein, 7 aa, Artificial Sequence
  Synthetic construct
YFGFDFF

SEQ ID NO: 17847 - protein, 7 aa, Artificial Sequence
  Synthetic construct
YFGFDFY

SEQ ID NO: 17848 - protein, 7 aa, Artificial Sequence
  Synthetic construct
YFGFDRF

SEQ ID NO: 17849 - protein, 7 aa, Artificial Sequence
  Synthetic construct
YFGFDRY

SEQ ID NO: 17850 - protein, 7 aa, Artificial Sequence
  Synthetic construct
YFGFDCF

SEQ ID NO: 17851 - protein, 7 aa, Artificial Sequence
  Synthetic construct
YFGFDCY

SEQ ID NO: 17852 - protein, 7 aa, Artificial Sequence
  Synthetic construct
YFGFDLF

SEQ ID NO: 17853 - protein, 7 aa, Artificial Sequence
  Synthetic construct
YFGFDLY

SEQ ID NO: 17854 - protein, 7 aa, Artificial Sequence
  Synthetic construct
YFGFDAF

SEQ ID NO: 17855 - protein, 7 aa, Artificial Sequence
  Synthetic construct
YFGFDAY

SEQ ID NO: 17856 - protein, 7 aa, Artificial Sequence
  Synthetic construct
YFGFDQF

SEQ ID NO: 17857 - protein, 7 aa, Artificial Sequence
  Synthetic construct
YFGFDQY

SEQ ID NO: 17858 - protein, 7 aa, Artificial Sequence
  Synthetic construct
YFGFDDF

SEQ ID NO: 17859 - protein, 7 aa, Artificial Sequence
  Synthetic construct
YFGFDDY

SEQ ID NO: 17860 - protein, 7 aa, Artificial Sequence
  Synthetic construct
YFGFDVF

SEQ ID NO: 17861 - protein, 7 aa, Artificial Sequence
  Synthetic construct
YFGFDVY

SEQ ID NO: 17862 - protein, 7 aa, Artificial Sequence
  Synthetic construct
YFGFYFF

SEQ ID NO: 17863 - protein, 7 aa, Artificial Sequence
  Synthetic construct
YFGFYFY

SEQ ID NO: 17864 - protein, 7 aa, Artificial Sequence
  Synthetic construct
YFGFYRF

SEQ ID NO: 17865 - protein, 7 aa, Artificial Sequence
  Synthetic construct
YFGFYRY

SEQ ID NO: 17866 - protein, 7 aa, Artificial Sequence
  Synthetic construct
YFGFYCF

SEQ ID NO: 17867 - protein, 7 aa, Artificial Sequence
  Synthetic construct
YFGFYCY

SEQ ID NO: 17868 - protein, 7 aa, Artificial Sequence
  Synthetic construct
YFGFYLF

SEQ ID NO: 17869 - protein, 7 aa, Artificial Sequence
  Synthetic construct
YFGFYLY

SEQ ID NO: 17870 - protein, 7 aa, Artificial Sequence
  Synthetic construct
YFGFYAF

SEQ ID NO: 17871 - protein, 7 aa, Artificial Sequence
  Synthetic construct
YFGFYAY

SEQ ID NO: 17872 - protein, 7 aa, Artificial Sequence
  Synthetic construct
YFGFYQF

SEQ ID NO: 17873 - protein, 7 aa, Artificial Sequence
  Synthetic construct
YFGFYQY

SEQ ID NO: 17874 - protein, 7 aa, Artificial Sequence
  Synthetic construct
YFGFYDF

SEQ ID NO: 17875 - protein, 7 aa, Artificial Sequence
  Synthetic construct
YFGFYDY

SEQ ID NO: 17876 - protein, 7 aa, Artificial Sequence
  Synthetic construct
YFGFYVF

SEQ ID NO: 17877 - protein, 7 aa, Artificial Sequence
  Synthetic construct
YFGFYVY

SEQ ID NO: 17878 - protein, 7 aa, Artificial Sequence
  Synthetic construct
YFGFFFF

SEQ ID NO: 17879 - protein, 7 aa, Artificial Sequence
  Synthetic construct
YFGFFFY

SEQ ID NO: 17880 - protein, 7 aa, Artificial Sequence
  Synthetic construct
YFGFFRF

SEQ ID NO: 17881 - protein, 7 aa, Artificial Sequence
  Synthetic construct
YFGFFRY

SEQ ID NO: 17882 - protein, 7 aa, Artificial Sequence
  Synthetic construct
YFGFFCF

SEQ ID NO: 17883 - protein, 7 aa, Artificial Sequence
  Synthetic construct
YFGFFCY

SEQ ID NO: 17884 - protein, 7 aa, Artificial Sequence
  Synthetic construct
YFGFFLF

SEQ ID NO: 17885 - protein, 7 aa, Artificial Sequence
  Synthetic construct
YFGFFLY

SEQ ID NO: 17886 - protein, 7 aa, Artificial Sequence
  Synthetic construct
YFGFFAF

SEQ ID NO: 17887 - protein, 7 aa, Artificial Sequence
  Synthetic construct
YFGFFAY

SEQ ID NO: 17888 - protein, 7 aa, Artificial Sequence
  Synthetic construct
YFGFFQF

SEQ ID NO: 17889 - protein, 7 aa, Artificial Sequence
  Synthetic construct
YFGFFQY

SEQ ID NO: 17890 - protein, 7 aa, Artificial Sequence
  Synthetic construct
YFGFFDF

SEQ ID NO: 17891 - protein, 7 aa, Artificial Sequence
  Synthetic construct
YFGFFDY

SEQ ID NO: 17892 - protein, 7 aa, Artificial Sequence
  Synthetic construct
YFGFFVF

SEQ ID NO: 17893 - protein, 7 aa, Artificial Sequence
  Synthetic construct
YFGFFVY

SEQ ID NO: 17894 - protein, 7 aa, Artificial Sequence
  Synthetic construct
YFGFVFF

SEQ ID NO: 17895 - protein, 7 aa, Artificial Sequence
  Synthetic construct
YFGFVFY

SEQ ID NO: 17896 - protein, 7 aa, Artificial Sequence
  Synthetic construct
YFGFVRF

SEQ ID NO: 17897 - protein, 7 aa, Artificial Sequence
  Synthetic construct
YFGFVRY

SEQ ID NO: 17898 - protein, 7 aa, Artificial Sequence
  Synthetic construct
YFGFVCF

SEQ ID NO: 17899 - protein, 7 aa, Artificial Sequence
  Synthetic construct
YFGFVCY

SEQ ID NO: 17900 - protein, 7 aa, Artificial Sequence
  Synthetic construct
YFGFVLF

SEQ ID NO: 17901 - protein, 7 aa, Artificial Sequence
  Synthetic construct
YFGFVLY

SEQ ID NO: 17902 - protein, 7 aa, Artificial Sequence
  Synthetic construct
YFGFVAF

SEQ ID NO: 17903 - protein, 7 aa, Artificial Sequence
  Synthetic construct
YFGFVAY

SEQ ID NO: 17904 - protein, 7 aa, Artificial Sequence
  Synthetic construct
YFGFVQF

SEQ ID NO: 17905 - protein, 7 aa, Artificial Sequence
  Synthetic construct
YFGFVQY

SEQ ID NO: 17906 - protein, 7 aa, Artificial Sequence
  Synthetic construct
YFGFVDF

SEQ ID NO: 17907 - protein, 7 aa, Artificial Sequence
  Synthetic construct
YFGFVDY

SEQ ID NO: 17908 - protein, 7 aa, Artificial Sequence
  Synthetic construct
YFGFVVF

SEQ ID NO: 17909 - protein, 7 aa, Artificial Sequence
  Synthetic construct
YFGFVVY

SEQ ID NO: 17910 - protein, 7 aa, Artificial Sequence
  Synthetic construct
YFGFTFF

SEQ ID NO: 17911 - protein, 7 aa, Artificial Sequence
  Synthetic construct
YFGFTFY

SEQ ID NO: 17912 - protein, 7 aa, Artificial Sequence
  Synthetic construct
YFGFTRF

SEQ ID NO: 17913 - protein, 7 aa, Artificial Sequence
  Synthetic construct
YFGFTRY

SEQ ID NO: 17914 - protein, 7 aa, Artificial Sequence
  Synthetic construct
YFGFTCF

SEQ ID NO: 17915 - protein, 7 aa, Artificial Sequence
  Synthetic construct
YFGFTCY

SEQ ID NO: 17916 - protein, 7 aa, Artificial Sequence
  Synthetic construct
YFGFTLF

SEQ ID NO: 17917 - protein, 7 aa, Artificial Sequence
  Synthetic construct
YFGFTLY

SEQ ID NO: 17918 - protein, 7 aa, Artificial Sequence
  Synthetic construct
YFGFTAF

SEQ ID NO: 17919 - protein, 7 aa, Artificial Sequence
  Synthetic construct
YFGFTAY

SEQ ID NO: 17920 - protein, 7 aa, Artificial Sequence
  Synthetic construct
YFGFTQF

SEQ ID NO: 17921 - protein, 7 aa, Artificial Sequence
  Synthetic construct
YFGFTQY

SEQ ID NO: 17922 - protein, 7 aa, Artificial Sequence
  Synthetic construct
YFGFTDF

SEQ ID NO: 17923 - protein, 7 aa, Artificial Sequence
  Synthetic construct
YFGFTDY

SEQ ID NO: 17924 - protein, 7 aa, Artificial Sequence
  Synthetic construct
YFGFTVF

SEQ ID NO: 17925 - protein, 7 aa, Artificial Sequence
  Synthetic construct
YFGFTVY

SEQ ID NO: 17926 - protein, 7 aa, Artificial Sequence
  Synthetic construct
YFGFGFF

SEQ ID NO: 17927 - protein, 7 aa, Artificial Sequence
  Synthetic construct
YFGFGFY

SEQ ID NO: 17928 - protein, 7 aa, Artificial Sequence
  Synthetic construct
YFGFGRF

SEQ ID NO: 17929 - protein, 7 aa, Artificial Sequence
  Synthetic construct
YFGFGRY

SEQ ID NO: 17930 - protein, 7 aa, Artificial Sequence
  Synthetic construct
YFGFGCF

SEQ ID NO: 17931 - protein, 7 aa, Artificial Sequence
  Synthetic construct
YFGFGCY

SEQ ID NO: 17932 - protein, 7 aa, Artificial Sequence
  Synthetic construct
YFGFGLF

SEQ ID NO: 17933 - protein, 7 aa, Artificial Sequence
  Synthetic construct
YFGFGLY

SEQ ID NO: 17934 - protein, 7 aa, Artificial Sequence
  Synthetic construct
YFGFGAF

SEQ ID NO: 17935 - protein, 7 aa, Artificial Sequence
  Synthetic construct
YFGFGAY

SEQ ID NO: 17936 - protein, 7 aa, Artificial Sequence
  Synthetic construct
YFGFGQF

SEQ ID NO: 17937 - protein, 7 aa, Artificial Sequence
  Synthetic construct
YFGFGQY

SEQ ID NO: 17938 - protein, 7 aa, Artificial Sequence
  Synthetic construct
YFGFGDF

SEQ ID NO: 17939 - protein, 7 aa, Artificial Sequence
  Synthetic construct
YFGFGDY

SEQ ID NO: 17940 - protein, 7 aa, Artificial Sequence
  Synthetic construct
YFGFGVF

SEQ ID NO: 17941 - protein, 7 aa, Artificial Sequence
  Synthetic construct
YFGFGVY

SEQ ID NO: 17942 - protein, 7 aa, Artificial Sequence
  Synthetic construct
YFGFAFF

SEQ ID NO: 17943 - protein, 7 aa, Artificial Sequence
  Synthetic construct
YFGFAFY

SEQ ID NO: 17944 - protein, 7 aa, Artificial Sequence
  Synthetic construct
YFGFARF

SEQ ID NO: 17945 - protein, 7 aa, Artificial Sequence
  Synthetic construct
YFGFARY

SEQ ID NO: 17946 - protein, 7 aa, Artificial Sequence
  Synthetic construct
YFGFACF

SEQ ID NO: 17947 - protein, 7 aa, Artificial Sequence
  Synthetic construct
YFGFACY

SEQ ID NO: 17948 - protein, 7 aa, Artificial Sequence
  Synthetic construct
YFGFALF

SEQ ID NO: 17949 - protein, 7 aa, Artificial Sequence
  Synthetic construct
YFGFALY

SEQ ID NO: 17950 - protein, 7 aa, Artificial Sequence
  Synthetic construct
YFGFAAF

SEQ ID NO: 17951 - protein, 7 aa, Artificial Sequence
  Synthetic construct
YFGFAAY

SEQ ID NO: 17952 - protein, 7 aa, Artificial Sequence
  Synthetic construct
YFGFAQF

SEQ ID NO: 17953 - protein, 7 aa, Artificial Sequence
  Synthetic construct
YFGFAQY

SEQ ID NO: 17954 - protein, 7 aa, Artificial Sequence
  Synthetic construct
YFGFADF

SEQ ID NO: 17955 - protein, 7 aa, Artificial Sequence
  Synthetic construct
YFGFADY

SEQ ID NO: 17956 - protein, 7 aa, Artificial Sequence
  Synthetic construct
YFGFAVF

SEQ ID NO: 17957 - protein, 7 aa, Artificial Sequence
  Synthetic construct
YFGFAVY

SEQ ID NO: 17958 - protein, 7 aa, Artificial Sequence
  Synthetic construct
YFGFQFF

SEQ ID NO: 17959 - protein, 7 aa, Artificial Sequence
  Synthetic construct
YFGFQFY

SEQ ID NO: 17960 - protein, 7 aa, Artificial Sequence
  Synthetic construct
YFGFQRF

SEQ ID NO: 17961 - protein, 7 aa, Artificial Sequence
  Synthetic construct
YFGFQRY

SEQ ID NO: 17962 - protein, 7 aa, Artificial Sequence
  Synthetic construct
YFGFQCF

SEQ ID NO: 17963 - protein, 7 aa, Artificial Sequence
  Synthetic construct
YFGFQCY

SEQ ID NO: 17964 - protein, 7 aa, Artificial Sequence
  Synthetic construct
YFGFQLF

SEQ ID NO: 17965 - protein, 7 aa, Artificial Sequence
  Synthetic construct
YFGFQLY

SEQ ID NO: 17966 - protein, 7 aa, Artificial Sequence
  Synthetic construct
YFGFQAF

SEQ ID NO: 17967 - protein, 7 aa, Artificial Sequence
  Synthetic construct
YFGFQAY

SEQ ID NO: 17968 - protein, 7 aa, Artificial Sequence
  Synthetic construct
YFGFQQF

SEQ ID NO: 17969 - protein, 7 aa, Artificial Sequence
  Synthetic construct
YFGFQQY

SEQ ID NO: 17970 - protein, 7 aa, Artificial Sequence
  Synthetic construct
YFGFQDF

SEQ ID NO: 17971 - protein, 7 aa, Artificial Sequence
  Synthetic construct
YFGFQDY

SEQ ID NO: 17972 - protein, 7 aa, Artificial Sequence
  Synthetic construct
YFGFQVF

SEQ ID NO: 17973 - protein, 7 aa, Artificial Sequence
  Synthetic construct
YFGFQVY

SEQ ID NO: 17974 - protein, 7 aa, Artificial Sequence
  Synthetic construct
YRIYIFF

SEQ ID NO: 17975 - protein, 7 aa, Artificial Sequence
  Synthetic construct
YRIYIFY

SEQ ID NO: 17976 - protein, 7 aa, Artificial Sequence
  Synthetic construct
YRIYIRF

SEQ ID NO: 17977 - protein, 7 aa, Artificial Sequence
  Synthetic construct
YRIYIRY

SEQ ID NO: 17978 - protein, 7 aa, Artificial Sequence
  Synthetic construct
YRIYICF

SEQ ID NO: 17979 - protein, 7 aa, Artificial Sequence
  Synthetic construct
YRIYICY

SEQ ID NO: 17980 - protein, 7 aa, Artificial Sequence
  Synthetic construct
YRIYILF

SEQ ID NO: 17981 - protein, 7 aa, Artificial Sequence
  Synthetic construct
YRIYILY

SEQ ID NO: 17982 - protein, 7 aa, Artificial Sequence
  Synthetic construct
YRIYIAF

SEQ ID NO: 17983 - protein, 7 aa, Artificial Sequence
  Synthetic construct
YRIYIAY

SEQ ID NO: 17984 - protein, 7 aa, Artificial Sequence
  Synthetic construct
YRIYIQF

SEQ ID NO: 17985 - protein, 7 aa, Artificial Sequence
  Synthetic construct
YRIYIQY

SEQ ID NO: 17986 - protein, 7 aa, Artificial Sequence
  Synthetic construct
YRIYIDF

SEQ ID NO: 17987 - protein, 7 aa, Artificial Sequence
  Synthetic construct
YRIYIDY

SEQ ID NO: 17988 - protein, 7 aa, Artificial Sequence
  Synthetic construct
YRIYIVF

SEQ ID NO: 17989 - protein, 7 aa, Artificial Sequence
  Synthetic construct
YRIYIVY

SEQ ID NO: 17990 - protein, 7 aa, Artificial Sequence
  Synthetic construct
YRIYDFF

SEQ ID NO: 17991 - protein, 7 aa, Artificial Sequence
  Synthetic construct
YRIYDFY

SEQ ID NO: 17992 - protein, 7 aa, Artificial Sequence
  Synthetic construct
YRIYDRF

SEQ ID NO: 17993 - protein, 7 aa, Artificial Sequence
  Synthetic construct
YRIYDRY

SEQ ID NO: 17994 - protein, 7 aa, Artificial Sequence
  Synthetic construct
YRIYDCF

SEQ ID NO: 17995 - protein, 7 aa, Artificial Sequence
  Synthetic construct
YRIYDCY

SEQ ID NO: 17996 - protein, 7 aa, Artificial Sequence
  Synthetic construct
YRIYDLF

SEQ ID NO: 17997 - protein, 7 aa, Artificial Sequence
  Synthetic construct
YRIYDLY

SEQ ID NO: 17998 - protein, 7 aa, Artificial Sequence
  Synthetic construct
YRIYDAF

SEQ ID NO: 17999 - protein, 7 aa, Artificial Sequence
  Synthetic construct
YRIYDAY

SEQ ID NO: 18000 - protein, 7 aa, Artificial Sequence
  Synthetic construct
YRIYDQF

SEQ ID NO: 18001 - protein, 7 aa, Artificial Sequence
  Synthetic construct
YRIYDQY

SEQ ID NO: 18002 - protein, 7 aa, Artificial Sequence
  Synthetic construct
YRIYDDF

SEQ ID NO: 18003 - protein, 7 aa, Artificial Sequence
  Synthetic construct
YRIYDDY

SEQ ID NO: 18004 - protein, 7 aa, Artificial Sequence
  Synthetic construct
YRIYDVF

SEQ ID NO: 18005 - protein, 7 aa, Artificial Sequence
  Synthetic construct
YRIYDVY

SEQ ID NO: 18006 - protein, 7 aa, Artificial Sequence
  Synthetic construct
YRIYYFF

SEQ ID NO: 18007 - protein, 7 aa, Artificial Sequence
  Synthetic construct
YRIYYFY

SEQ ID NO: 18008 - protein, 7 aa, Artificial Sequence
  Synthetic construct
YRIYYRF

SEQ ID NO: 18009 - protein, 7 aa, Artificial Sequence
  Synthetic construct
YRIYYRY

SEQ ID NO: 18010 - protein, 7 aa, Artificial Sequence
  Synthetic construct
YRIYYCF

SEQ ID NO: 18011 - protein, 7 aa, Artificial Sequence
  Synthetic construct
YRIYYCY

SEQ ID NO: 18012 - protein, 7 aa, Artificial Sequence
  Synthetic construct
YRIYYLF

SEQ ID NO: 18013 - protein, 7 aa, Artificial Sequence
  Synthetic construct
YRIYYLY

SEQ ID NO: 18014 - protein, 7 aa, Artificial Sequence
  Synthetic construct
YRIYYAF

SEQ ID NO: 18015 - protein, 7 aa, Artificial Sequence
  Synthetic construct
YRIYYAY

SEQ ID NO: 18016 - protein, 7 aa, Artificial Sequence
  Synthetic construct
YRIYYQF

SEQ ID NO: 18017 - protein, 7 aa, Artificial Sequence
  Synthetic construct
YRIYYQY

SEQ ID NO: 18018 - protein, 7 aa, Artificial Sequence
  Synthetic construct
YRIYYDF

SEQ ID NO: 18019 - protein, 7 aa, Artificial Sequence
  Synthetic construct
YRIYYDY

SEQ ID NO: 18020 - protein, 7 aa, Artificial Sequence
  Synthetic construct
YRIYYVF

SEQ ID NO: 18021 - protein, 7 aa, Artificial Sequence
  Synthetic construct
YRIYYVY

SEQ ID NO: 18022 - protein, 7 aa, Artificial Sequence
  Synthetic construct
YRIYFFF

SEQ ID NO: 18023 - protein, 7 aa, Artificial Sequence
  Synthetic construct
YRIYFFY

SEQ ID NO: 18024 - protein, 7 aa, Artificial Sequence
  Synthetic construct
YRIYFRF

SEQ ID NO: 18025 - protein, 7 aa, Artificial Sequence
  Synthetic construct
YRIYFRY

SEQ ID NO: 18026 - protein, 7 aa, Artificial Sequence
  Synthetic construct
YRIYFCF

SEQ ID NO: 18027 - protein, 7 aa, Artificial Sequence
  Synthetic construct
YRIYFCY

SEQ ID NO: 18028 - protein, 7 aa, Artificial Sequence
  Synthetic construct
YRIYFLF

SEQ ID NO: 18029 - protein, 7 aa, Artificial Sequence
  Synthetic construct
YRIYFLY

SEQ ID NO: 18030 - protein, 7 aa, Artificial Sequence
  Synthetic construct
YRIYFAF

SEQ ID NO: 18031 - protein, 7 aa, Artificial Sequence
  Synthetic construct
YRIYFAY

SEQ ID NO: 18032 - protein, 7 aa, Artificial Sequence
  Synthetic construct
YRIYFQF

SEQ ID NO: 18033 - protein, 7 aa, Artificial Sequence
  Synthetic construct
YRIYFQY

SEQ ID NO: 18034 - protein, 7 aa, Artificial Sequence
  Synthetic construct
YRIYFDF

SEQ ID NO: 18035 - protein, 7 aa, Artificial Sequence
  Synthetic construct
YRIYFDY

SEQ ID NO: 18036 - protein, 7 aa, Artificial Sequence
  Synthetic construct
YRIYFVF

SEQ ID NO: 18037 - protein, 7 aa, Artificial Sequence
  Synthetic construct
YRIYFVY

SEQ ID NO: 18038 - protein, 7 aa, Artificial Sequence
  Synthetic construct
YRIYVFF

SEQ ID NO: 18039 - protein, 7 aa, Artificial Sequence
  Synthetic construct
YRIYVFY

SEQ ID NO: 18040 - protein, 7 aa, Artificial Sequence
  Synthetic construct
YRIYVRF

SEQ ID NO: 18041 - protein, 7 aa, Artificial Sequence
  Synthetic construct
YRIYVRY

SEQ ID NO: 18042 - protein, 7 aa, Artificial Sequence
  Synthetic construct
YRIYVCF

SEQ ID NO: 18043 - protein, 7 aa, Artificial Sequence
  Synthetic construct
YRIYVCY

SEQ ID NO: 18044 - protein, 7 aa, Artificial Sequence
  Synthetic construct
YRIYVLF

SEQ ID NO: 18045 - protein, 7 aa, Artificial Sequence
  Synthetic construct
YRIYVLY

SEQ ID NO: 18046 - protein, 7 aa, Artificial Sequence
  Synthetic construct
YRIYVAF

SEQ ID NO: 18047 - protein, 7 aa, Artificial Sequence
  Synthetic construct
YRIYVAY

SEQ ID NO: 18048 - protein, 7 aa, Artificial Sequence
  Synthetic construct
YRIYVQF

SEQ ID NO: 18049 - protein, 7 aa, Artificial Sequence
  Synthetic construct
YRIYVQY

SEQ ID NO: 18050 - protein, 7 aa, Artificial Sequence
  Synthetic construct
YRIYVDF

SEQ ID NO: 18051 - protein, 7 aa, Artificial Sequence
  Synthetic construct
YRIYVDY

SEQ ID NO: 18052 - protein, 7 aa, Artificial Sequence
  Synthetic construct
YRIYVVF

SEQ ID NO: 18053 - protein, 7 aa, Artificial Sequence
  Synthetic construct
YRIYVVY

SEQ ID NO: 18054 - protein, 7 aa, Artificial Sequence
  Synthetic construct
YRIYTFF

SEQ ID NO: 18055 - protein, 7 aa, Artificial Sequence
  Synthetic construct
YRIYTFY

SEQ ID NO: 18056 - protein, 7 aa, Artificial Sequence
  Synthetic construct
YRIYTRF

SEQ ID NO: 18057 - protein, 7 aa, Artificial Sequence
  Synthetic construct
YRIYTRY

SEQ ID NO: 18058 - protein, 7 aa, Artificial Sequence
  Synthetic construct
YRIYTCF

SEQ ID NO: 18059 - protein, 7 aa, Artificial Sequence
  Synthetic construct
YRIYTCY

SEQ ID NO: 18060 - protein, 7 aa, Artificial Sequence
  Synthetic construct
YRIYTLF

SEQ ID NO: 18061 - protein, 7 aa, Artificial Sequence
  Synthetic construct
YRIYTLY

SEQ ID NO: 18062 - protein, 7 aa, Artificial Sequence
  Synthetic construct
YRIYTAF

SEQ ID NO: 18063 - protein, 7 aa, Artificial Sequence
  Synthetic construct
YRIYTAY

SEQ ID NO: 18064 - protein, 7 aa, Artificial Sequence
  Synthetic construct
YRIYTQF

SEQ ID NO: 18065 - protein, 7 aa, Artificial Sequence
  Synthetic construct
YRIYTQY

SEQ ID NO: 18066 - protein, 7 aa, Artificial Sequence
  Synthetic construct
YRIYTDF

SEQ ID NO: 18067 - protein, 7 aa, Artificial Sequence
  Synthetic construct
YRIYTDY

SEQ ID NO: 18068 - protein, 7 aa, Artificial Sequence
  Synthetic construct
YRIYTVF

SEQ ID NO: 18069 - protein, 7 aa, Artificial Sequence
  Synthetic construct
YRIYTVY

SEQ ID NO: 18070 - protein, 7 aa, Artificial Sequence
  Synthetic construct
YRIYGFF

SEQ ID NO: 18071 - protein, 7 aa, Artificial Sequence
  Synthetic construct
YRIYGFY

SEQ ID NO: 18072 - protein, 7 aa, Artificial Sequence
  Synthetic construct
YRIYGRF

SEQ ID NO: 18073 - protein, 7 aa, Artificial Sequence
  Synthetic construct
YRIYGRY

SEQ ID NO: 18074 - protein, 7 aa, Artificial Sequence
  Synthetic construct
YRIYGCF

SEQ ID NO: 18075 - protein, 7 aa, Artificial Sequence
  Synthetic construct
YRIYGCY

SEQ ID NO: 18076 - protein, 7 aa, Artificial Sequence
  Synthetic construct
YRIYGLF

SEQ ID NO: 18077 - protein, 7 aa, Artificial Sequence
  Synthetic construct
YRIYGLY

SEQ ID NO: 18078 - protein, 7 aa, Artificial Sequence
  Synthetic construct
YRIYGAF

SEQ ID NO: 18079 - protein, 7 aa, Artificial Sequence
  Synthetic construct
YRIYGAY

SEQ ID NO: 18080 - protein, 7 aa, Artificial Sequence
  Synthetic construct
YRIYGQF

SEQ ID NO: 18081 - protein, 7 aa, Artificial Sequence
  Synthetic construct
YRIYGQY

SEQ ID NO: 18082 - protein, 7 aa, Artificial Sequence
  Synthetic construct
YRIYGDF

SEQ ID NO: 18083 - protein, 7 aa, Artificial Sequence
  Synthetic construct
YRIYGDY

SEQ ID NO: 18084 - protein, 7 aa, Artificial Sequence
  Synthetic construct
YRIYGVF

SEQ ID NO: 18085 - protein, 7 aa, Artificial Sequence
  Synthetic construct
YRIYGVY

SEQ ID NO: 18086 - protein, 7 aa, Artificial Sequence
  Synthetic construct
YRIYAFF

SEQ ID NO: 18087 - protein, 7 aa, Artificial Sequence
  Synthetic construct
YRIYAFY

SEQ ID NO: 18088 - protein, 7 aa, Artificial Sequence
  Synthetic construct
YRIYARF

SEQ ID NO: 18089 - protein, 7 aa, Artificial Sequence
  Synthetic construct
YRIYARY

SEQ ID NO: 18090 - protein, 7 aa, Artificial Sequence
  Synthetic construct
YRIYACF

SEQ ID NO: 18091 - protein, 7 aa, Artificial Sequence
  Synthetic construct
YRIYACY

SEQ ID NO: 18092 - protein, 7 aa, Artificial Sequence
  Synthetic construct
YRIYALF

SEQ ID NO: 18093 - protein, 7 aa, Artificial Sequence
  Synthetic construct
YRIYALY

SEQ ID NO: 18094 - protein, 7 aa, Artificial Sequence
  Synthetic construct
YRIYAAF

SEQ ID NO: 18095 - protein, 7 aa, Artificial Sequence
  Synthetic construct
YRIYAAY

SEQ ID NO: 18096 - protein, 7 aa, Artificial Sequence
  Synthetic construct
YRIYAQF

SEQ ID NO: 18097 - protein, 7 aa, Artificial Sequence
  Synthetic construct
YRIYAQY

SEQ ID NO: 18098 - protein, 7 aa, Artificial Sequence
  Synthetic construct
YRIYADF

SEQ ID NO: 18099 - protein, 7 aa, Artificial Sequence
  Synthetic construct
YRIYADY

SEQ ID NO: 18100 - protein, 7 aa, Artificial Sequence
  Synthetic construct
YRIYAVF

SEQ ID NO: 18101 - protein, 7 aa, Artificial Sequence
  Synthetic construct
YRIYAVY

SEQ ID NO: 18102 - protein, 7 aa, Artificial Sequence
  Synthetic construct
YRIYQFF

SEQ ID NO: 18103 - protein, 7 aa, Artificial Sequence
  Synthetic construct
YRIYQFY

SEQ ID NO: 18104 - protein, 7 aa, Artificial Sequence
  Synthetic construct
YRIYQRF

SEQ ID NO: 18105 - protein, 7 aa, Artificial Sequence
  Synthetic construct
YRIYQRY

SEQ ID NO: 18106 - protein, 7 aa, Artificial Sequence
  Synthetic construct
YRIYQCF

SEQ ID NO: 18107 - protein, 7 aa, Artificial Sequence
  Synthetic construct
YRIYQCY

SEQ ID NO: 18108 - protein, 7 aa, Artificial Sequence
  Synthetic construct
YRIYQLF

SEQ ID NO: 18109 - protein, 7 aa, Artificial Sequence
  Synthetic construct
YRIYQLY

SEQ ID NO: 18110 - protein, 7 aa, Artificial Sequence
  Synthetic construct
YRIYQAF

SEQ ID NO: 18111 - protein, 7 aa, Artificial Sequence
  Synthetic construct
YRIYQAY

SEQ ID NO: 18112 - protein, 7 aa, Artificial Sequence
  Synthetic construct
YRIYQQF

SEQ ID NO: 18113 - protein, 7 aa, Artificial Sequence
  Synthetic construct
YRIYQQY

SEQ ID NO: 18114 - protein, 7 aa, Artificial Sequence
  Synthetic construct
YRIYQDF

SEQ ID NO: 18115 - protein, 7 aa, Artificial Sequence
  Synthetic construct
YRIYQDY

SEQ ID NO: 18116 - protein, 7 aa, Artificial Sequence
  Synthetic construct
YRIYQVF

SEQ ID NO: 18117 - protein, 7 aa, Artificial Sequence
  Synthetic construct
YRIYQVY

SEQ ID NO: 18118 - protein, 7 aa, Artificial Sequence
  Synthetic construct
YRIPIFF

SEQ ID NO: 18119 - protein, 7 aa, Artificial Sequence
  Synthetic construct
YRIPIFY

SEQ ID NO: 18120 - protein, 7 aa, Artificial Sequence
  Synthetic construct
YRIPIRF

SEQ ID NO: 18121 - protein, 7 aa, Artificial Sequence
  Synthetic construct
YRIPIRY

SEQ ID NO: 18122 - protein, 7 aa, Artificial Sequence
  Synthetic construct
YRIPICF

SEQ ID NO: 18123 - protein, 7 aa, Artificial Sequence
  Synthetic construct
YRIPICY

SEQ ID NO: 18124 - protein, 7 aa, Artificial Sequence
  Synthetic construct
YRIPILF

SEQ ID NO: 18125 - protein, 7 aa, Artificial Sequence
  Synthetic construct
YRIPILY

SEQ ID NO: 18126 - protein, 7 aa, Artificial Sequence
  Synthetic construct
YRIPIAF

SEQ ID NO: 18127 - protein, 7 aa, Artificial Sequence
  Synthetic construct
YRIPIAY

SEQ ID NO: 18128 - protein, 7 aa, Artificial Sequence
  Synthetic construct
YRIPIQF

SEQ ID NO: 18129 - protein, 7 aa, Artificial Sequence
  Synthetic construct
YRIPIQY

SEQ ID NO: 18130 - protein, 7 aa, Artificial Sequence
  Synthetic construct
YRIPIDF

SEQ ID NO: 18131 - protein, 7 aa, Artificial Sequence
  Synthetic construct
YRIPIDY

SEQ ID NO: 18132 - protein, 7 aa, Artificial Sequence
  Synthetic construct
YRIPIVF

SEQ ID NO: 18133 - protein, 7 aa, Artificial Sequence
  Synthetic construct
YRIPIVY

SEQ ID NO: 18134 - protein, 7 aa, Artificial Sequence
  Synthetic construct
YRIPDFF

SEQ ID NO: 18135 - protein, 7 aa, Artificial Sequence
  Synthetic construct
YRIPDFY

SEQ ID NO: 18136 - protein, 7 aa, Artificial Sequence
  Synthetic construct
YRIPDRF

SEQ ID NO: 18137 - protein, 7 aa, Artificial Sequence
  Synthetic construct
YRIPDRY

SEQ ID NO: 18138 - protein, 7 aa, Artificial Sequence
  Synthetic construct
YRIPDCF

SEQ ID NO: 18139 - protein, 7 aa, Artificial Sequence
  Synthetic construct
YRIPDCY

SEQ ID NO: 18140 - protein, 7 aa, Artificial Sequence
  Synthetic construct
YRIPDLF

SEQ ID NO: 18141 - protein, 7 aa, Artificial Sequence
  Synthetic construct
YRIPDLY

SEQ ID NO: 18142 - protein, 7 aa, Artificial Sequence
  Synthetic construct
YRIPDAF

SEQ ID NO: 18143 - protein, 7 aa, Artificial Sequence
  Synthetic construct
YRIPDAY

SEQ ID NO: 18144 - protein, 7 aa, Artificial Sequence
  Synthetic construct
YRIPDQF

SEQ ID NO: 18145 - protein, 7 aa, Artificial Sequence
  Synthetic construct
YRIPDQY

SEQ ID NO: 18146 - protein, 7 aa, Artificial Sequence
  Synthetic construct
YRIPDDF

SEQ ID NO: 18147 - protein, 7 aa, Artificial Sequence
  Synthetic construct
YRIPDDY

SEQ ID NO: 18148 - protein, 7 aa, Artificial Sequence
  Synthetic construct
YRIPDVF

SEQ ID NO: 18149 - protein, 7 aa, Artificial Sequence
  Synthetic construct
YRIPDVY

SEQ ID NO: 18150 - protein, 7 aa, Artificial Sequence
  Synthetic construct
YRIPYFF

SEQ ID NO: 18151 - protein, 7 aa, Artificial Sequence
  Synthetic construct
YRIPYFY

SEQ ID NO: 18152 - protein, 7 aa, Artificial Sequence
  Synthetic construct
YRIPYRF

SEQ ID NO: 18153 - protein, 7 aa, Artificial Sequence
  Synthetic construct
YRIPYRY

SEQ ID NO: 18154 - protein, 7 aa, Artificial Sequence
  Synthetic construct
YRIPYCF

SEQ ID NO: 18155 - protein, 7 aa, Artificial Sequence
  Synthetic construct
YRIPYCY

SEQ ID NO: 18156 - protein, 7 aa, Artificial Sequence
  Synthetic construct
YRIPYLF

SEQ ID NO: 18157 - protein, 7 aa, Artificial Sequence
  Synthetic construct
YRIPYLY

SEQ ID NO: 18158 - protein, 7 aa, Artificial Sequence
  Synthetic construct
YRIPYAF

SEQ ID NO: 18159 - protein, 7 aa, Artificial Sequence
  Synthetic construct
YRIPYAY

SEQ ID NO: 18160 - protein, 7 aa, Artificial Sequence
  Synthetic construct
YRIPYQF

SEQ ID NO: 18161 - protein, 7 aa, Artificial Sequence
  Synthetic construct
YRIPYQY

SEQ ID NO: 18162 - protein, 7 aa, Artificial Sequence
  Synthetic construct
YRIPYDF

SEQ ID NO: 18163 - protein, 7 aa, Artificial Sequence
  Synthetic construct
YRIPYDY

SEQ ID NO: 18164 - protein, 7 aa, Artificial Sequence
  Synthetic construct
YRIPYVF

SEQ ID NO: 18165 - protein, 7 aa, Artificial Sequence
  Synthetic construct
YRIPYVY

SEQ ID NO: 18166 - protein, 7 aa, Artificial Sequence
  Synthetic construct
YRIPFFF

SEQ ID NO: 18167 - protein, 7 aa, Artificial Sequence
  Synthetic construct
YRIPFFY

SEQ ID NO: 18168 - protein, 7 aa, Artificial Sequence
  Synthetic construct
YRIPFRF

SEQ ID NO: 18169 - protein, 7 aa, Artificial Sequence
  Synthetic construct
YRIPFRY

SEQ ID NO: 18170 - protein, 7 aa, Artificial Sequence
  Synthetic construct
YRIPFCF

SEQ ID NO: 18171 - protein, 7 aa, Artificial Sequence
  Synthetic construct
YRIPFCY

SEQ ID NO: 18172 - protein, 7 aa, Artificial Sequence
  Synthetic construct
YRIPFLF

SEQ ID NO: 18173 - protein, 7 aa, Artificial Sequence
  Synthetic construct
YRIPFLY

SEQ ID NO: 18174 - protein, 7 aa, Artificial Sequence
  Synthetic construct
YRIPFAF

SEQ ID NO: 18175 - protein, 7 aa, Artificial Sequence
  Synthetic construct
YRIPFAY

SEQ ID NO: 18176 - protein, 7 aa, Artificial Sequence
  Synthetic construct
YRIPFQF

SEQ ID NO: 18177 - protein, 7 aa, Artificial Sequence
  Synthetic construct
YRIPFQY

SEQ ID NO: 18178 - protein, 7 aa, Artificial Sequence
  Synthetic construct
YRIPFDF

SEQ ID NO: 18179 - protein, 7 aa, Artificial Sequence
  Synthetic construct
YRIPFDY

SEQ ID NO: 18180 - protein, 7 aa, Artificial Sequence
  Synthetic construct
YRIPFVF

SEQ ID NO: 18181 - protein, 7 aa, Artificial Sequence
  Synthetic construct
YRIPFVY

SEQ ID NO: 18182 - protein, 7 aa, Artificial Sequence
  Synthetic construct
YRIPVFF

SEQ ID NO: 18183 - protein, 7 aa, Artificial Sequence
  Synthetic construct
YRIPVFY

SEQ ID NO: 18184 - protein, 7 aa, Artificial Sequence
  Synthetic construct
YRIPVRF

SEQ ID NO: 18185 - protein, 7 aa, Artificial Sequence
  Synthetic construct
YRIPVRY

SEQ ID NO: 18186 - protein, 7 aa, Artificial Sequence
  Synthetic construct
YRIPVCF

SEQ ID NO: 18187 - protein, 7 aa, Artificial Sequence
  Synthetic construct
YRIPVCY

SEQ ID NO: 18188 - protein, 7 aa, Artificial Sequence
  Synthetic construct
YRIPVLF

SEQ ID NO: 18189 - protein, 7 aa, Artificial Sequence
  Synthetic construct
YRIPVLY

SEQ ID NO: 18190 - protein, 7 aa, Artificial Sequence
  Synthetic construct
YRIPVAF

SEQ ID NO: 18191 - protein, 7 aa, Artificial Sequence
  Synthetic construct
YRIPVAY

SEQ ID NO: 18192 - protein, 7 aa, Artificial Sequence
  Synthetic construct
YRIPVQF

SEQ ID NO: 18193 - protein, 7 aa, Artificial Sequence
  Synthetic construct
YRIPVQY

SEQ ID NO: 18194 - protein, 7 aa, Artificial Sequence
  Synthetic construct
YRIPVDF

SEQ ID NO: 18195 - protein, 7 aa, Artificial Sequence
  Synthetic construct
YRIPVDY

SEQ ID NO: 18196 - protein, 7 aa, Artificial Sequence
  Synthetic construct
YRIPVVF

SEQ ID NO: 18197 - protein, 7 aa, Artificial Sequence
  Synthetic construct
YRIPVVY

SEQ ID NO: 18198 - protein, 7 aa, Artificial Sequence
  Synthetic construct
YRIPTFF

SEQ ID NO: 18199 - protein, 7 aa, Artificial Sequence
  Synthetic construct
YRIPTFY

SEQ ID NO: 18200 - protein, 7 aa, Artificial Sequence
  Synthetic construct
YRIPTRF

SEQ ID NO: 18201 - protein, 7 aa, Artificial Sequence
  Synthetic construct
YRIPTRY

SEQ ID NO: 18202 - protein, 7 aa, Artificial Sequence
  Synthetic construct
YRIPTCF

SEQ ID NO: 18203 - protein, 7 aa, Artificial Sequence
  Synthetic construct
YRIPTCY

SEQ ID NO: 18204 - protein, 7 aa, Artificial Sequence
  Synthetic construct
YRIPTLF

SEQ ID NO: 18205 - protein, 7 aa, Artificial Sequence
  Synthetic construct
YRIPTLY

SEQ ID NO: 18206 - protein, 7 aa, Artificial Sequence
  Synthetic construct
YRIPTAF

SEQ ID NO: 18207 - protein, 7 aa, Artificial Sequence
  Synthetic construct
YRIPTAY

SEQ ID NO: 18208 - protein, 7 aa, Artificial Sequence
  Synthetic construct
YRIPTQF

SEQ ID NO: 18209 - protein, 7 aa, Artificial Sequence
  Synthetic construct
YRIPTQY

SEQ ID NO: 18210 - protein, 7 aa, Artificial Sequence
  Synthetic construct
YRIPTDF

SEQ ID NO: 18211 - protein, 7 aa, Artificial Sequence
  Synthetic construct
YRIPTDY

SEQ ID NO: 18212 - protein, 7 aa, Artificial Sequence
  Synthetic construct
YRIPTVF

SEQ ID NO: 18213 - protein, 7 aa, Artificial Sequence
  Synthetic construct
YRIPTVY

SEQ ID NO: 18214 - protein, 7 aa, Artificial Sequence
  Synthetic construct
YRIPGFF

SEQ ID NO: 18215 - protein, 7 aa, Artificial Sequence
  Synthetic construct
YRIPGFY

SEQ ID NO: 18216 - protein, 7 aa, Artificial Sequence
  Synthetic construct
YRIPGRF

SEQ ID NO: 18217 - protein, 7 aa, Artificial Sequence
  Synthetic construct
YRIPGRY

SEQ ID NO: 18218 - protein, 7 aa, Artificial Sequence
  Synthetic construct
YRIPGCF

SEQ ID NO: 18219 - protein, 7 aa, Artificial Sequence
  Synthetic construct
YRIPGCY

SEQ ID NO: 18220 - protein, 7 aa, Artificial Sequence
  Synthetic construct
YRIPGLF

SEQ ID NO: 18221 - protein, 7 aa, Artificial Sequence
  Synthetic construct
YRIPGLY

SEQ ID NO: 18222 - protein, 7 aa, Artificial Sequence
  Synthetic construct
YRIPGAF

SEQ ID NO: 18223 - protein, 7 aa, Artificial Sequence
  Synthetic construct
YRIPGAY

SEQ ID NO: 18224 - protein, 7 aa, Artificial Sequence
  Synthetic construct
YRIPGQF

SEQ ID NO: 18225 - protein, 7 aa, Artificial Sequence
  Synthetic construct
YRIPGQY

SEQ ID NO: 18226 - protein, 7 aa, Artificial Sequence
  Synthetic construct
YRIPGDF

SEQ ID NO: 18227 - protein, 7 aa, Artificial Sequence
  Synthetic construct
YRIPGDY

SEQ ID NO: 18228 - protein, 7 aa, Artificial Sequence
  Synthetic construct
YRIPGVF

SEQ ID NO: 18229 - protein, 7 aa, Artificial Sequence
  Synthetic construct
YRIPGVY

SEQ ID NO: 18230 - protein, 7 aa, Artificial Sequence
  Synthetic construct
YRIPAFF

SEQ ID NO: 18231 - protein, 7 aa, Artificial Sequence
  Synthetic construct
YRIPAFY

SEQ ID NO: 18232 - protein, 7 aa, Artificial Sequence
  Synthetic construct
YRIPARF

SEQ ID NO: 18233 - protein, 7 aa, Artificial Sequence
  Synthetic construct
YRIPARY

SEQ ID NO: 18234 - protein, 7 aa, Artificial Sequence
  Synthetic construct
YRIPACF

SEQ ID NO: 18235 - protein, 7 aa, Artificial Sequence
  Synthetic construct
YRIPACY

SEQ ID NO: 18236 - protein, 7 aa, Artificial Sequence
  Synthetic construct
YRIPALF

SEQ ID NO: 18237 - protein, 7 aa, Artificial Sequence
  Synthetic construct
YRIPALY

SEQ ID NO: 18238 - protein, 7 aa, Artificial Sequence
  Synthetic construct
YRIPAAF

SEQ ID NO: 18239 - protein, 7 aa, Artificial Sequence
  Synthetic construct
YRIPAAY

SEQ ID NO: 18240 - protein, 7 aa, Artificial Sequence
  Synthetic construct
YRIPAQF

SEQ ID NO: 18241 - protein, 7 aa, Artificial Sequence
  Synthetic construct
YRIPAQY

SEQ ID NO: 18242 - protein, 7 aa, Artificial Sequence
  Synthetic construct
YRIPADF

SEQ ID NO: 18243 - protein, 7 aa, Artificial Sequence
  Synthetic construct
YRIPADY

SEQ ID NO: 18244 - protein, 7 aa, Artificial Sequence
  Synthetic construct
YRIPAVF

SEQ ID NO: 18245 - protein, 7 aa, Artificial Sequence
  Synthetic construct
YRIPAVY

SEQ ID NO: 18246 - protein, 7 aa, Artificial Sequence
  Synthetic construct
YRIPQFF

SEQ ID NO: 18247 - protein, 7 aa, Artificial Sequence
  Synthetic construct
YRIPQFY

SEQ ID NO: 18248 - protein, 7 aa, Artificial Sequence
  Synthetic construct
YRIPQRF

SEQ ID NO: 18249 - protein, 7 aa, Artificial Sequence
  Synthetic construct
YRIPQRY

SEQ ID NO: 18250 - protein, 7 aa, Artificial Sequence
  Synthetic construct
YRIPQCF

SEQ ID NO: 18251 - protein, 7 aa, Artificial Sequence
  Synthetic construct
YRIPQCY

SEQ ID NO: 18252 - protein, 7 aa, Artificial Sequence
  Synthetic construct
YRIPQLF

SEQ ID NO: 18253 - protein, 7 aa, Artificial Sequence
  Synthetic construct
YRIPQLY

SEQ ID NO: 18254 - protein, 7 aa, Artificial Sequence
  Synthetic construct
YRIPQAF

SEQ ID NO: 18255 - protein, 7 aa, Artificial Sequence
  Synthetic construct
YRIPQAY

SEQ ID NO: 18256 - protein, 7 aa, Artificial Sequence
  Synthetic construct
YRIPQQF

SEQ ID NO: 18257 - protein, 7 aa, Artificial Sequence
  Synthetic construct
YRIPQQY

SEQ ID NO: 18258 - protein, 7 aa, Artificial Sequence
  Synthetic construct
YRIPQDF

SEQ ID NO: 18259 - protein, 7 aa, Artificial Sequence
  Synthetic construct
YRIPQDY

SEQ ID NO: 18260 - protein, 7 aa, Artificial Sequence
  Synthetic construct
YRIPQVF

SEQ ID NO: 18261 - protein, 7 aa, Artificial Sequence
  Synthetic construct
YRIPQVY

SEQ ID NO: 18262 - protein, 7 aa, Artificial Sequence
  Synthetic construct
YRIHIFF

SEQ ID NO: 18263 - protein, 7 aa, Artificial Sequence
  Synthetic construct
YRIHIFY

SEQ ID NO: 18264 - protein, 7 aa, Artificial Sequence
  Synthetic construct
YRIHIRF

SEQ ID NO: 18265 - protein, 7 aa, Artificial Sequence
  Synthetic construct
YRIHIRY

SEQ ID NO: 18266 - protein, 7 aa, Artificial Sequence
  Synthetic construct
YRIHICF

SEQ ID NO: 18267 - protein, 7 aa, Artificial Sequence
  Synthetic construct
YRIHICY

SEQ ID NO: 18268 - protein, 7 aa, Artificial Sequence
  Synthetic construct
YRIHILF

SEQ ID NO: 18269 - protein, 7 aa, Artificial Sequence
  Synthetic construct
YRIHILY

SEQ ID NO: 18270 - protein, 7 aa, Artificial Sequence
  Synthetic construct
YRIHIAF

SEQ ID NO: 18271 - protein, 7 aa, Artificial Sequence
  Synthetic construct
YRIHIAY

SEQ ID NO: 18272 - protein, 7 aa, Artificial Sequence
  Synthetic construct
YRIHIQF

SEQ ID NO: 18273 - protein, 7 aa, Artificial Sequence
  Synthetic construct
YRIHIQY

SEQ ID NO: 18274 - protein, 7 aa, Artificial Sequence
  Synthetic construct
YRIHIDF

SEQ ID NO: 18275 - protein, 7 aa, Artificial Sequence
  Synthetic construct
YRIHIDY

SEQ ID NO: 18276 - protein, 7 aa, Artificial Sequence
  Synthetic construct
YRIHIVF

SEQ ID NO: 18277 - protein, 7 aa, Artificial Sequence
  Synthetic construct
YRIHIVY

SEQ ID NO: 18278 - protein, 7 aa, Artificial Sequence
  Synthetic construct
YRIHDFF

SEQ ID NO: 18279 - protein, 7 aa, Artificial Sequence
  Synthetic construct
YRIHDFY

SEQ ID NO: 18280 - protein, 7 aa, Artificial Sequence
  Synthetic construct
YRIHDRF

SEQ ID NO: 18281 - protein, 7 aa, Artificial Sequence
  Synthetic construct
YRIHDRY

SEQ ID NO: 18282 - protein, 7 aa, Artificial Sequence
  Synthetic construct
YRIHDCF

SEQ ID NO: 18283 - protein, 7 aa, Artificial Sequence
  Synthetic construct
YRIHDCY

SEQ ID NO: 18284 - protein, 7 aa, Artificial Sequence
  Synthetic construct
YRIHDLF

SEQ ID NO: 18285 - protein, 7 aa, Artificial Sequence
  Synthetic construct
YRIHDLY

SEQ ID NO: 18286 - protein, 7 aa, Artificial Sequence
  Synthetic construct
YRIHDAF

SEQ ID NO: 18287 - protein, 7 aa, Artificial Sequence
  Synthetic construct
YRIHDAY

SEQ ID NO: 18288 - protein, 7 aa, Artificial Sequence
  Synthetic construct
YRIHDQF

SEQ ID NO: 18289 - protein, 7 aa, Artificial Sequence
  Synthetic construct
YRIHDQY

SEQ ID NO: 18290 - protein, 7 aa, Artificial Sequence
  Synthetic construct
YRIHDDF

SEQ ID NO: 18291 - protein, 7 aa, Artificial Sequence
  Synthetic construct
YRIHDDY

SEQ ID NO: 18292 - protein, 7 aa, Artificial Sequence
  Synthetic construct
YRIHDVF

SEQ ID NO: 18293 - protein, 7 aa, Artificial Sequence
  Synthetic construct
YRIHDVY

SEQ ID NO: 18294 - protein, 7 aa, Artificial Sequence
  Synthetic construct
YRIHYFF

SEQ ID NO: 18295 - protein, 7 aa, Artificial Sequence
  Synthetic construct
YRIHYFY

SEQ ID NO: 18296 - protein, 7 aa, Artificial Sequence
  Synthetic construct
YRIHYRF

SEQ ID NO: 18297 - protein, 7 aa, Artificial Sequence
  Synthetic construct
YRIHYRY

SEQ ID NO: 18298 - protein, 7 aa, Artificial Sequence
  Synthetic construct
YRIHYCF

SEQ ID NO: 18299 - protein, 7 aa, Artificial Sequence
  Synthetic construct
YRIHYCY

SEQ ID NO: 18300 - protein, 7 aa, Artificial Sequence
  Synthetic construct
YRIHYLF

SEQ ID NO: 18301 - protein, 7 aa, Artificial Sequence
  Synthetic construct
YRIHYLY

SEQ ID NO: 18302 - protein, 7 aa, Artificial Sequence
  Synthetic construct
YRIHYAF

SEQ ID NO: 18303 - protein, 7 aa, Artificial Sequence
  Synthetic construct
YRIHYAY

SEQ ID NO: 18304 - protein, 7 aa, Artificial Sequence
  Synthetic construct
YRIHYQF

SEQ ID NO: 18305 - protein, 7 aa, Artificial Sequence
  Synthetic construct
YRIHYQY

SEQ ID NO: 18306 - protein, 7 aa, Artificial Sequence
  Synthetic construct
YRIHYDF

SEQ ID NO: 18307 - protein, 7 aa, Artificial Sequence
  Synthetic construct
YRIHYDY

SEQ ID NO: 18308 - protein, 7 aa, Artificial Sequence
  Synthetic construct
YRIHYVF

SEQ ID NO: 18309 - protein, 7 aa, Artificial Sequence
  Synthetic construct
YRIHYVY

SEQ ID NO: 18310 - protein, 7 aa, Artificial Sequence
  Synthetic construct
YRIHFFF

SEQ ID NO: 18311 - protein, 7 aa, Artificial Sequence
  Synthetic construct
YRIHFFY

SEQ ID NO: 18312 - protein, 7 aa, Artificial Sequence
  Synthetic construct
YRIHFRF

SEQ ID NO: 18313 - protein, 7 aa, Artificial Sequence
  Synthetic construct
YRIHFRY

SEQ ID NO: 18314 - protein, 7 aa, Artificial Sequence
  Synthetic construct
YRIHFCF

SEQ ID NO: 18315 - protein, 7 aa, Artificial Sequence
  Synthetic construct
YRIHFCY

SEQ ID NO: 18316 - protein, 7 aa, Artificial Sequence
  Synthetic construct
YRIHFLF

SEQ ID NO: 18317 - protein, 7 aa, Artificial Sequence
  Synthetic construct
YRIHFLY

SEQ ID NO: 18318 - protein, 7 aa, Artificial Sequence
  Synthetic construct
YRIHFAF

SEQ ID NO: 18319 - protein, 7 aa, Artificial Sequence
  Synthetic construct
YRIHFAY

SEQ ID NO: 18320 - protein, 7 aa, Artificial Sequence
  Synthetic construct
YRIHFQF

SEQ ID NO: 18321 - protein, 7 aa, Artificial Sequence
  Synthetic construct
YRIHFQY

SEQ ID NO: 18322 - protein, 7 aa, Artificial Sequence
  Synthetic construct
YRIHFDF

SEQ ID NO: 18323 - protein, 7 aa, Artificial Sequence
  Synthetic construct
YRIHFDY

SEQ ID NO: 18324 - protein, 7 aa, Artificial Sequence
  Synthetic construct
YRIHFVF

SEQ ID NO: 18325 - protein, 7 aa, Artificial Sequence
  Synthetic construct
YRIHFVY

SEQ ID NO: 18326 - protein, 7 aa, Artificial Sequence
  Synthetic construct
YRIHVFF

SEQ ID NO: 18327 - protein, 7 aa, Artificial Sequence
  Synthetic construct
YRIHVFY

SEQ ID NO: 18328 - protein, 7 aa, Artificial Sequence
  Synthetic construct
YRIHVRF

SEQ ID NO: 18329 - protein, 7 aa, Artificial Sequence
  Synthetic construct
YRIHVRY

SEQ ID NO: 18330 - protein, 7 aa, Artificial Sequence
  Synthetic construct
YRIHVCF

SEQ ID NO: 18331 - protein, 7 aa, Artificial Sequence
  Synthetic construct
YRIHVCY

SEQ ID NO: 18332 - protein, 7 aa, Artificial Sequence
  Synthetic construct
YRIHVLF

SEQ ID NO: 18333 - protein, 7 aa, Artificial Sequence
  Synthetic construct
YRIHVLY

SEQ ID NO: 18334 - protein, 7 aa, Artificial Sequence
  Synthetic construct
YRIHVAF

SEQ ID NO: 18335 - protein, 7 aa, Artificial Sequence
  Synthetic construct
YRIHVAY

SEQ ID NO: 18336 - protein, 7 aa, Artificial Sequence
  Synthetic construct
YRIHVQF

SEQ ID NO: 18337 - protein, 7 aa, Artificial Sequence
  Synthetic construct
YRIHVQY

SEQ ID NO: 18338 - protein, 7 aa, Artificial Sequence
  Synthetic construct
YRIHVDF

SEQ ID NO: 18339 - protein, 7 aa, Artificial Sequence
  Synthetic construct
YRIHVDY

SEQ ID NO: 18340 - protein, 7 aa, Artificial Sequence
  Synthetic construct
YRIHVVF

SEQ ID NO: 18341 - protein, 7 aa, Artificial Sequence
  Synthetic construct
YRIHVVY

SEQ ID NO: 18342 - protein, 7 aa, Artificial Sequence
  Synthetic construct
YRIHTFF

SEQ ID NO: 18343 - protein, 7 aa, Artificial Sequence
  Synthetic construct
YRIHTFY

SEQ ID NO: 18344 - protein, 7 aa, Artificial Sequence
  Synthetic construct
YRIHTRF

SEQ ID NO: 18345 - protein, 7 aa, Artificial Sequence
  Synthetic construct
YRIHTRY

SEQ ID NO: 18346 - protein, 7 aa, Artificial Sequence
  Synthetic construct
YRIHTCF

SEQ ID NO: 18347 - protein, 7 aa, Artificial Sequence
  Synthetic construct
YRIHTCY

SEQ ID NO: 18348 - protein, 7 aa, Artificial Sequence
  Synthetic construct
YRIHTLF

SEQ ID NO: 18349 - protein, 7 aa, Artificial Sequence
  Synthetic construct
YRIHTLY

SEQ ID NO: 18350 - protein, 7 aa, Artificial Sequence
  Synthetic construct
YRIHTAF

SEQ ID NO: 18351 - protein, 7 aa, Artificial Sequence
  Synthetic construct
YRIHTAY

SEQ ID NO: 18352 - protein, 7 aa, Artificial Sequence
  Synthetic construct
YRIHTQF

SEQ ID NO: 18353 - protein, 7 aa, Artificial Sequence
  Synthetic construct
YRIHTQY

SEQ ID NO: 18354 - protein, 7 aa, Artificial Sequence
  Synthetic construct
YRIHTDF

SEQ ID NO: 18355 - protein, 7 aa, Artificial Sequence
  Synthetic construct
YRIHTDY

SEQ ID NO: 18356 - protein, 7 aa, Artificial Sequence
  Synthetic construct
YRIHTVF

SEQ ID NO: 18357 - protein, 7 aa, Artificial Sequence
  Synthetic construct
YRIHTVY

SEQ ID NO: 18358 - protein, 7 aa, Artificial Sequence
  Synthetic construct
YRIHGFF

SEQ ID NO: 18359 - protein, 7 aa, Artificial Sequence
  Synthetic construct
YRIHGFY

SEQ ID NO: 18360 - protein, 7 aa, Artificial Sequence
  Synthetic construct
YRIHGRF

SEQ ID NO: 18361 - protein, 7 aa, Artificial Sequence
  Synthetic construct
YRIHGRY

SEQ ID NO: 18362 - protein, 7 aa, Artificial Sequence
  Synthetic construct
YRIHGCF

SEQ ID NO: 18363 - protein, 7 aa, Artificial Sequence
  Synthetic construct
YRIHGCY

SEQ ID NO: 18364 - protein, 7 aa, Artificial Sequence
  Synthetic construct
YRIHGLF

SEQ ID NO: 18365 - protein, 7 aa, Artificial Sequence
  Synthetic construct
YRIHGLY

SEQ ID NO: 18366 - protein, 7 aa, Artificial Sequence
  Synthetic construct
YRIHGAF

SEQ ID NO: 18367 - protein, 7 aa, Artificial Sequence
  Synthetic construct
YRIHGAY

SEQ ID NO: 18368 - protein, 7 aa, Artificial Sequence
  Synthetic construct
YRIHGQF

SEQ ID NO: 18369 - protein, 7 aa, Artificial Sequence
  Synthetic construct
YRIHGQY

SEQ ID NO: 18370 - protein, 7 aa, Artificial Sequence
  Synthetic construct
YRIHGDF

SEQ ID NO: 18371 - protein, 7 aa, Artificial Sequence
  Synthetic construct
YRIHGDY

SEQ ID NO: 18372 - protein, 7 aa, Artificial Sequence
  Synthetic construct
YRIHGVF

SEQ ID NO: 18373 - protein, 7 aa, Artificial Sequence
  Synthetic construct
YRIHGVY

SEQ ID NO: 18374 - protein, 7 aa, Artificial Sequence
  Synthetic construct
YRIHAFF

SEQ ID NO: 18375 - protein, 7 aa, Artificial Sequence
  Synthetic construct
YRIHAFY

SEQ ID NO: 18376 - protein, 7 aa, Artificial Sequence
  Synthetic construct
YRIHARF

SEQ ID NO: 18377 - protein, 7 aa, Artificial Sequence
  Synthetic construct
YRIHARY

SEQ ID NO: 18378 - protein, 7 aa, Artificial Sequence
  Synthetic construct
YRIHACF

SEQ ID NO: 18379 - protein, 7 aa, Artificial Sequence
  Synthetic construct
YRIHACY

SEQ ID NO: 18380 - protein, 7 aa, Artificial Sequence
  Synthetic construct
YRIHALF

SEQ ID NO: 18381 - protein, 7 aa, Artificial Sequence
  Synthetic construct
YRIHALY

SEQ ID NO: 18382 - protein, 7 aa, Artificial Sequence
  Synthetic construct
YRIHAAF

SEQ ID NO: 18383 - protein, 7 aa, Artificial Sequence
  Synthetic construct
YRIHAAY

SEQ ID NO: 18384 - protein, 7 aa, Artificial Sequence
  Synthetic construct
YRIHAQF

SEQ ID NO: 18385 - protein, 7 aa, Artificial Sequence
  Synthetic construct
YRIHAQY

SEQ ID NO: 18386 - protein, 7 aa, Artificial Sequence
  Synthetic construct
YRIHADF

SEQ ID NO: 18387 - protein, 7 aa, Artificial Sequence
  Synthetic construct
YRIHADY

SEQ ID NO: 18388 - protein, 7 aa, Artificial Sequence
  Synthetic construct
YRIHAVF

SEQ ID NO: 18389 - protein, 7 aa, Artificial Sequence
  Synthetic construct
YRIHAVY

SEQ ID NO: 18390 - protein, 7 aa, Artificial Sequence
  Synthetic construct
YRIHQFF

SEQ ID NO: 18391 - protein, 7 aa, Artificial Sequence
  Synthetic construct
YRIHQFY

SEQ ID NO: 18392 - protein, 7 aa, Artificial Sequence
  Synthetic construct
YRIHQRF

SEQ ID NO: 18393 - protein, 7 aa, Artificial Sequence
  Synthetic construct
YRIHQRY

SEQ ID NO: 18394 - protein, 7 aa, Artificial Sequence
  Synthetic construct
YRIHQCF

SEQ ID NO: 18395 - protein, 7 aa, Artificial Sequence
  Synthetic construct
YRIHQCY

SEQ ID NO: 18396 - protein, 7 aa, Artificial Sequence
  Synthetic construct
YRIHQLF

SEQ ID NO: 18397 - protein, 7 aa, Artificial Sequence
  Synthetic construct
YRIHQLY

SEQ ID NO: 18398 - protein, 7 aa, Artificial Sequence
  Synthetic construct
YRIHQAF

SEQ ID NO: 18399 - protein, 7 aa, Artificial Sequence
  Synthetic construct
YRIHQAY

SEQ ID NO: 18400 - protein, 7 aa, Artificial Sequence
  Synthetic construct
YRIHQQF

SEQ ID NO: 18401 - protein, 7 aa, Artificial Sequence
  Synthetic construct
YRIHQQY

SEQ ID NO: 18402 - protein, 7 aa, Artificial Sequence
  Synthetic construct
YRIHQDF

SEQ ID NO: 18403 - protein, 7 aa, Artificial Sequence
  Synthetic construct
YRIHQDY

SEQ ID NO: 18404 - protein, 7 aa, Artificial Sequence
  Synthetic construct
YRIHQVF

SEQ ID NO: 18405 - protein, 7 aa, Artificial Sequence
  Synthetic construct
YRIHQVY

SEQ ID NO: 18406 - protein, 7 aa, Artificial Sequence
  Synthetic construct
YRILIFF

SEQ ID NO: 18407 - protein, 7 aa, Artificial Sequence
  Synthetic construct
YRILIFY

SEQ ID NO: 18408 - protein, 7 aa, Artificial Sequence
  Synthetic construct
YRILIRF

SEQ ID NO: 18409 - protein, 7 aa, Artificial Sequence
  Synthetic construct
YRILIRY

SEQ ID NO: 18410 - protein, 7 aa, Artificial Sequence
  Synthetic construct
YRILICF

SEQ ID NO: 18411 - protein, 7 aa, Artificial Sequence
  Synthetic construct
YRILICY

SEQ ID NO: 18412 - protein, 7 aa, Artificial Sequence
  Synthetic construct
YRILILF

SEQ ID NO: 18413 - protein, 7 aa, Artificial Sequence
  Synthetic construct
YRILILY

SEQ ID NO: 18414 - protein, 7 aa, Artificial Sequence
  Synthetic construct
YRILIAF

SEQ ID NO: 18415 - protein, 7 aa, Artificial Sequence
  Synthetic construct
YRILIAY

SEQ ID NO: 18416 - protein, 7 aa, Artificial Sequence
  Synthetic construct
YRILIQF

SEQ ID NO: 18417 - protein, 7 aa, Artificial Sequence
  Synthetic construct
YRILIQY

SEQ ID NO: 18418 - protein, 7 aa, Artificial Sequence
  Synthetic construct
YRILIDF

SEQ ID NO: 18419 - protein, 7 aa, Artificial Sequence
  Synthetic construct
YRILIDY

SEQ ID NO: 18420 - protein, 7 aa, Artificial Sequence
  Synthetic construct
YRILIVF

SEQ ID NO: 18421 - protein, 7 aa, Artificial Sequence
  Synthetic construct
YRILIVY

SEQ ID NO: 18422 - protein, 7 aa, Artificial Sequence
  Synthetic construct
YRILDFF

SEQ ID NO: 18423 - protein, 7 aa, Artificial Sequence
  Synthetic construct
YRILDFY

SEQ ID NO: 18424 - protein, 7 aa, Artificial Sequence
  Synthetic construct
YRILDRF

SEQ ID NO: 18425 - protein, 7 aa, Artificial Sequence
  Synthetic construct
YRILDRY

SEQ ID NO: 18426 - protein, 7 aa, Artificial Sequence
  Synthetic construct
YRILDCF

SEQ ID NO: 18427 - protein, 7 aa, Artificial Sequence
  Synthetic construct
YRILDCY

SEQ ID NO: 18428 - protein, 7 aa, Artificial Sequence
  Synthetic construct
YRILDLF

SEQ ID NO: 18429 - protein, 7 aa, Artificial Sequence
  Synthetic construct
YRILDLY

SEQ ID NO: 18430 - protein, 7 aa, Artificial Sequence
  Synthetic construct
YRILDAF

SEQ ID NO: 18431 - protein, 7 aa, Artificial Sequence
  Synthetic construct
YRILDAY

SEQ ID NO: 18432 - protein, 7 aa, Artificial Sequence
  Synthetic construct
YRILDQF

SEQ ID NO: 18433 - protein, 7 aa, Artificial Sequence
  Synthetic construct
YRILDQY

SEQ ID NO: 18434 - protein, 7 aa, Artificial Sequence
  Synthetic construct
YRILDDF

SEQ ID NO: 18435 - protein, 7 aa, Artificial Sequence
  Synthetic construct
YRILDDY

SEQ ID NO: 18436 - protein, 7 aa, Artificial Sequence
  Synthetic construct
YRILDVF

SEQ ID NO: 18437 - protein, 7 aa, Artificial Sequence
  Synthetic construct
YRILDVY

SEQ ID NO: 18438 - protein, 7 aa, Artificial Sequence
  Synthetic construct
YRILYFF

SEQ ID NO: 18439 - protein, 7 aa, Artificial Sequence
  Synthetic construct
YRILYFY

SEQ ID NO: 18440 - protein, 7 aa, Artificial Sequence
  Synthetic construct
YRILYRF

SEQ ID NO: 18441 - protein, 7 aa, Artificial Sequence
  Synthetic construct
YRILYRY

SEQ ID NO: 18442 - protein, 7 aa, Artificial Sequence
  Synthetic construct
YRILYCF

SEQ ID NO: 18443 - protein, 7 aa, Artificial Sequence
  Synthetic construct
YRILYCY

SEQ ID NO: 18444 - protein, 7 aa, Artificial Sequence
  Synthetic construct
YRILYLF

SEQ ID NO: 18445 - protein, 7 aa, Artificial Sequence
  Synthetic construct
YRILYLY

SEQ ID NO: 18446 - protein, 7 aa, Artificial Sequence
  Synthetic construct
YRILYAF

SEQ ID NO: 18447 - protein, 7 aa, Artificial Sequence
  Synthetic construct
YRILYAY

SEQ ID NO: 18448 - protein, 7 aa, Artificial Sequence
  Synthetic construct
YRILYQF

SEQ ID NO: 18449 - protein, 7 aa, Artificial Sequence
  Synthetic construct
YRILYQY

SEQ ID NO: 18450 - protein, 7 aa, Artificial Sequence
  Synthetic construct
YRILYDF

SEQ ID NO: 18451 - protein, 7 aa, Artificial Sequence
  Synthetic construct
YRILYDY

SEQ ID NO: 18452 - protein, 7 aa, Artificial Sequence
  Synthetic construct
YRILYVF

SEQ ID NO: 18453 - protein, 7 aa, Artificial Sequence
  Synthetic construct
YRILYVY

SEQ ID NO: 18454 - protein, 7 aa, Artificial Sequence
  Synthetic construct
YRILFFF

SEQ ID NO: 18455 - protein, 7 aa, Artificial Sequence
  Synthetic construct
YRILFFY

SEQ ID NO: 18456 - protein, 7 aa, Artificial Sequence
  Synthetic construct
YRILFRF

SEQ ID NO: 18457 - protein, 7 aa, Artificial Sequence
  Synthetic construct
YRILFRY

SEQ ID NO: 18458 - protein, 7 aa, Artificial Sequence
  Synthetic construct
YRILFCF

SEQ ID NO: 18459 - protein, 7 aa, Artificial Sequence
  Synthetic construct
YRILFCY

SEQ ID NO: 18460 - protein, 7 aa, Artificial Sequence
  Synthetic construct
YRILFLF

SEQ ID NO: 18461 - protein, 7 aa, Artificial Sequence
  Synthetic construct
YRILFLY

SEQ ID NO: 18462 - protein, 7 aa, Artificial Sequence
  Synthetic construct
YRILFAF

SEQ ID NO: 18463 - protein, 7 aa, Artificial Sequence
  Synthetic construct
YRILFAY

SEQ ID NO: 18464 - protein, 7 aa, Artificial Sequence
  Synthetic construct
YRILFQF

SEQ ID NO: 18465 - protein, 7 aa, Artificial Sequence
  Synthetic construct
YRILFQY

SEQ ID NO: 18466 - protein, 7 aa, Artificial Sequence
  Synthetic construct
YRILFDF

SEQ ID NO: 18467 - protein, 7 aa, Artificial Sequence
  Synthetic construct
YRILFDY

SEQ ID NO: 18468 - protein, 7 aa, Artificial Sequence
  Synthetic construct
YRILFVF

SEQ ID NO: 18469 - protein, 7 aa, Artificial Sequence
  Synthetic construct
YRILFVY

SEQ ID NO: 18470 - protein, 7 aa, Artificial Sequence
  Synthetic construct
YRILVFF

SEQ ID NO: 18471 - protein, 7 aa, Artificial Sequence
  Synthetic construct
YRILVFY

SEQ ID NO: 18472 - protein, 7 aa, Artificial Sequence
  Synthetic construct
YRILVRF

SEQ ID NO: 18473 - protein, 7 aa, Artificial Sequence
  Synthetic construct
YRILVRY

SEQ ID NO: 18474 - protein, 7 aa, Artificial Sequence
  Synthetic construct
YRILVCF

SEQ ID NO: 18475 - protein, 7 aa, Artificial Sequence
  Synthetic construct
YRILVCY

SEQ ID NO: 18476 - protein, 7 aa, Artificial Sequence
  Synthetic construct
YRILVLF

SEQ ID NO: 18477 - protein, 7 aa, Artificial Sequence
  Synthetic construct
YRILVLY

SEQ ID NO: 18478 - protein, 7 aa, Artificial Sequence
  Synthetic construct
YRILVAF

SEQ ID NO: 18479 - protein, 7 aa, Artificial Sequence
  Synthetic construct
YRILVAY

SEQ ID NO: 18480 - protein, 7 aa, Artificial Sequence
  Synthetic construct
YRILVQF

SEQ ID NO: 18481 - protein, 7 aa, Artificial Sequence
  Synthetic construct
YRILVQY

SEQ ID NO: 18482 - protein, 7 aa, Artificial Sequence
  Synthetic construct
YRILVDF

SEQ ID NO: 18483 - protein, 7 aa, Artificial Sequence
  Synthetic construct
YRILVDY

SEQ ID NO: 18484 - protein, 7 aa, Artificial Sequence
  Synthetic construct
YRILVVF

SEQ ID NO: 18485 - protein, 7 aa, Artificial Sequence
  Synthetic construct
YRILVVY

SEQ ID NO: 18486 - protein, 7 aa, Artificial Sequence
  Synthetic construct
YRILTFF

SEQ ID NO: 18487 - protein, 7 aa, Artificial Sequence
  Synthetic construct
YRILTFY

SEQ ID NO: 18488 - protein, 7 aa, Artificial Sequence
  Synthetic construct
YRILTRF

SEQ ID NO: 18489 - protein, 7 aa, Artificial Sequence
  Synthetic construct
YRILTRY

SEQ ID NO: 18490 - protein, 7 aa, Artificial Sequence
  Synthetic construct
YRILTCF

SEQ ID NO: 18491 - protein, 7 aa, Artificial Sequence
  Synthetic construct
YRILTCY

SEQ ID NO: 18492 - protein, 7 aa, Artificial Sequence
  Synthetic construct
YRILTLF

SEQ ID NO: 18493 - protein, 7 aa, Artificial Sequence
  Synthetic construct
YRILTLY

SEQ ID NO: 18494 - protein, 7 aa, Artificial Sequence
  Synthetic construct
YRILTAF

SEQ ID NO: 18495 - protein, 7 aa, Artificial Sequence
  Synthetic construct
YRILTAY

SEQ ID NO: 18496 - protein, 7 aa, Artificial Sequence
  Synthetic construct
YRILTQF

SEQ ID NO: 18497 - protein, 7 aa, Artificial Sequence
  Synthetic construct
YRILTQY

SEQ ID NO: 18498 - protein, 7 aa, Artificial Sequence
  Synthetic construct
YRILTDF

SEQ ID NO: 18499 - protein, 7 aa, Artificial Sequence
  Synthetic construct
YRILTDY

SEQ ID NO: 18500 - protein, 7 aa, Artificial Sequence
  Synthetic construct
YRILTVF

SEQ ID NO: 18501 - protein, 7 aa, Artificial Sequence
  Synthetic construct
YRILTVY

SEQ ID NO: 18502 - protein, 7 aa, Artificial Sequence
  Synthetic construct
YRILGFF

SEQ ID NO: 18503 - protein, 7 aa, Artificial Sequence
  Synthetic construct
YRILGFY

SEQ ID NO: 18504 - protein, 7 aa, Artificial Sequence
  Synthetic construct
YRILGRF

SEQ ID NO: 18505 - protein, 7 aa, Artificial Sequence
  Synthetic construct
YRILGRY

SEQ ID NO: 18506 - protein, 7 aa, Artificial Sequence
  Synthetic construct
YRILGCF

SEQ ID NO: 18507 - protein, 7 aa, Artificial Sequence
  Synthetic construct
YRILGCY

SEQ ID NO: 18508 - protein, 7 aa, Artificial Sequence
  Synthetic construct
YRILGLF

SEQ ID NO: 18509 - protein, 7 aa, Artificial Sequence
  Synthetic construct
YRILGLY

SEQ ID NO: 18510 - protein, 7 aa, Artificial Sequence
  Synthetic construct
YRILGAF

SEQ ID NO: 18511 - protein, 7 aa, Artificial Sequence
  Synthetic construct
YRILGAY

SEQ ID NO: 18512 - protein, 7 aa, Artificial Sequence
  Synthetic construct
YRILGQF

SEQ ID NO: 18513 - protein, 7 aa, Artificial Sequence
  Synthetic construct
YRILGQY

SEQ ID NO: 18514 - protein, 7 aa, Artificial Sequence
  Synthetic construct
YRILGDF

SEQ ID NO: 18515 - protein, 7 aa, Artificial Sequence
  Synthetic construct
YRILGDY

SEQ ID NO: 18516 - protein, 7 aa, Artificial Sequence
  Synthetic construct
YRILGVF

SEQ ID NO: 18517 - protein, 7 aa, Artificial Sequence
  Synthetic construct
YRILGVY

SEQ ID NO: 18518 - protein, 7 aa, Artificial Sequence
  Synthetic construct
YRILAFF

SEQ ID NO: 18519 - protein, 7 aa, Artificial Sequence
  Synthetic construct
YRILAFY

SEQ ID NO: 18520 - protein, 7 aa, Artificial Sequence
  Synthetic construct
YRILARF

SEQ ID NO: 18521 - protein, 7 aa, Artificial Sequence
  Synthetic construct
YRILARY

SEQ ID NO: 18522 - protein, 7 aa, Artificial Sequence
  Synthetic construct
YRILACF

SEQ ID NO: 18523 - protein, 7 aa, Artificial Sequence
  Synthetic construct
YRILACY

SEQ ID NO: 18524 - protein, 7 aa, Artificial Sequence
  Synthetic construct
YRILALF

SEQ ID NO: 18525 - protein, 7 aa, Artificial Sequence
  Synthetic construct
YRILALY

SEQ ID NO: 18526 - protein, 7 aa, Artificial Sequence
  Synthetic construct
YRILAAF

SEQ ID NO: 18527 - protein, 7 aa, Artificial Sequence
  Synthetic construct
YRILAAY

SEQ ID NO: 18528 - protein, 7 aa, Artificial Sequence
  Synthetic construct
YRILAQF

SEQ ID NO: 18529 - protein, 7 aa, Artificial Sequence
  Synthetic construct
YRILAQY

SEQ ID NO: 18530 - protein, 7 aa, Artificial Sequence
  Synthetic construct
YRILADF

SEQ ID NO: 18531 - protein, 7 aa, Artificial Sequence
  Synthetic construct
YRILADY

SEQ ID NO: 18532 - protein, 7 aa, Artificial Sequence
  Synthetic construct
YRILAVF

SEQ ID NO: 18533 - protein, 7 aa, Artificial Sequence
  Synthetic construct
YRILAVY

SEQ ID NO: 18534 - protein, 7 aa, Artificial Sequence
  Synthetic construct
YRILQFF

SEQ ID NO: 18535 - protein, 7 aa, Artificial Sequence
  Synthetic construct
YRILQFY

SEQ ID NO: 18536 - protein, 7 aa, Artificial Sequence
  Synthetic construct
YRILQRF

SEQ ID NO: 18537 - protein, 7 aa, Artificial Sequence
  Synthetic construct
YRILQRY

SEQ ID NO: 18538 - protein, 7 aa, Artificial Sequence
  Synthetic construct
YRILQCF

SEQ ID NO: 18539 - protein, 7 aa, Artificial Sequence
  Synthetic construct
YRILQCY

SEQ ID NO: 18540 - protein, 7 aa, Artificial Sequence
  Synthetic construct
YRILQLF

SEQ ID NO: 18541 - protein, 7 aa, Artificial Sequence
  Synthetic construct
YRILQLY

SEQ ID NO: 18542 - protein, 7 aa, Artificial Sequence
  Synthetic construct
YRILQAF

SEQ ID NO: 18543 - protein, 7 aa, Artificial Sequence
  Synthetic construct
YRILQAY

SEQ ID NO: 18544 - protein, 7 aa, Artificial Sequence
  Synthetic construct
YRILQQF

SEQ ID NO: 18545 - protein, 7 aa, Artificial Sequence
  Synthetic construct
YRILQQY

SEQ ID NO: 18546 - protein, 7 aa, Artificial Sequence
  Synthetic construct
YRILQDF

SEQ ID NO: 18547 - protein, 7 aa, Artificial Sequence
  Synthetic construct
YRILQDY

SEQ ID NO: 18548 - protein, 7 aa, Artificial Sequence
  Synthetic construct
YRILQVF

SEQ ID NO: 18549 - protein, 7 aa, Artificial Sequence
  Synthetic construct
YRILQVY

SEQ ID NO: 18550 - protein, 7 aa, Artificial Sequence
  Synthetic construct
YRIFIFF

SEQ ID NO: 18551 - protein, 7 aa, Artificial Sequence
  Synthetic construct
YRIFIFY

SEQ ID NO: 18552 - protein, 7 aa, Artificial Sequence
  Synthetic construct
YRIFIRF

SEQ ID NO: 18553 - protein, 7 aa, Artificial Sequence
  Synthetic construct
YRIFIRY

SEQ ID NO: 18554 - protein, 7 aa, Artificial Sequence
  Synthetic construct
YRIFICF

SEQ ID NO: 18555 - protein, 7 aa, Artificial Sequence
  Synthetic construct
YRIFICY

SEQ ID NO: 18556 - protein, 7 aa, Artificial Sequence
  Synthetic construct
YRIFILF

SEQ ID NO: 18557 - protein, 7 aa, Artificial Sequence
  Synthetic construct
YRIFILY

SEQ ID NO: 18558 - protein, 7 aa, Artificial Sequence
  Synthetic construct
YRIFIAF

SEQ ID NO: 18559 - protein, 7 aa, Artificial Sequence
  Synthetic construct
YRIFIAY

SEQ ID NO: 18560 - protein, 7 aa, Artificial Sequence
  Synthetic construct
YRIFIQF

SEQ ID NO: 18561 - protein, 7 aa, Artificial Sequence
  Synthetic construct
YRIFIQY

SEQ ID NO: 18562 - protein, 7 aa, Artificial Sequence
  Synthetic construct
YRIFIDF

SEQ ID NO: 18563 - protein, 7 aa, Artificial Sequence
  Synthetic construct
YRIFIDY

SEQ ID NO: 18564 - protein, 7 aa, Artificial Sequence
  Synthetic construct
YRIFIVF

SEQ ID NO: 18565 - protein, 7 aa, Artificial Sequence
  Synthetic construct
YRIFIVY

SEQ ID NO: 18566 - protein, 7 aa, Artificial Sequence
  Synthetic construct
YRIFDFF

SEQ ID NO: 18567 - protein, 7 aa, Artificial Sequence
  Synthetic construct
YRIFDFY

SEQ ID NO: 18568 - protein, 7 aa, Artificial Sequence
  Synthetic construct
YRIFDRF

SEQ ID NO: 18569 - protein, 7 aa, Artificial Sequence
  Synthetic construct
YRIFDRY

SEQ ID NO: 18570 - protein, 7 aa, Artificial Sequence
  Synthetic construct
YRIFDCF

SEQ ID NO: 18571 - protein, 7 aa, Artificial Sequence
  Synthetic construct
YRIFDCY

SEQ ID NO: 18572 - protein, 7 aa, Artificial Sequence
  Synthetic construct
YRIFDLF

SEQ ID NO: 18573 - protein, 7 aa, Artificial Sequence
  Synthetic construct
YRIFDLY

SEQ ID NO: 18574 - protein, 7 aa, Artificial Sequence
  Synthetic construct
YRIFDAF

SEQ ID NO: 18575 - protein, 7 aa, Artificial Sequence
  Synthetic construct
YRIFDAY

SEQ ID NO: 18576 - protein, 7 aa, Artificial Sequence
  Synthetic construct
YRIFDQF

SEQ ID NO: 18577 - protein, 7 aa, Artificial Sequence
  Synthetic construct
YRIFDQY

SEQ ID NO: 18578 - protein, 7 aa, Artificial Sequence
  Synthetic construct
YRIFDDF

SEQ ID NO: 18579 - protein, 7 aa, Artificial Sequence
  Synthetic construct
YRIFDDY

SEQ ID NO: 18580 - protein, 7 aa, Artificial Sequence
  Synthetic construct
YRIFDVF

SEQ ID NO: 18581 - protein, 7 aa, Artificial Sequence
  Synthetic construct
YRIFDVY

SEQ ID NO: 18582 - protein, 7 aa, Artificial Sequence
  Synthetic construct
YRIFYFF

SEQ ID NO: 18583 - protein, 7 aa, Artificial Sequence
  Synthetic construct
YRIFYFY

SEQ ID NO: 18584 - protein, 7 aa, Artificial Sequence
  Synthetic construct
YRIFYRF

SEQ ID NO: 18585 - protein, 7 aa, Artificial Sequence
  Synthetic construct
YRIFYRY

SEQ ID NO: 18586 - protein, 7 aa, Artificial Sequence
  Synthetic construct
YRIFYCF

SEQ ID NO: 18587 - protein, 7 aa, Artificial Sequence
  Synthetic construct
YRIFYCY

SEQ ID NO: 18588 - protein, 7 aa, Artificial Sequence
  Synthetic construct
YRIFYLF

SEQ ID NO: 18589 - protein, 7 aa, Artificial Sequence
  Synthetic construct
YRIFYLY

SEQ ID NO: 18590 - protein, 7 aa, Artificial Sequence
  Synthetic construct
YRIFYAF

SEQ ID NO: 18591 - protein, 7 aa, Artificial Sequence
  Synthetic construct
YRIFYAY

SEQ ID NO: 18592 - protein, 7 aa, Artificial Sequence
  Synthetic construct
YRIFYQF

SEQ ID NO: 18593 - protein, 7 aa, Artificial Sequence
  Synthetic construct
YRIFYQY

SEQ ID NO: 18594 - protein, 7 aa, Artificial Sequence
  Synthetic construct
YRIFYDF

SEQ ID NO: 18595 - protein, 7 aa, Artificial Sequence
  Synthetic construct
YRIFYDY

SEQ ID NO: 18596 - protein, 7 aa, Artificial Sequence
  Synthetic construct
YRIFYVF

SEQ ID NO: 18597 - protein, 7 aa, Artificial Sequence
  Synthetic construct
YRIFYVY

SEQ ID NO: 18598 - protein, 7 aa, Artificial Sequence
  Synthetic construct
YRIFFFF

SEQ ID NO: 18599 - protein, 7 aa, Artificial Sequence
  Synthetic construct
YRIFFFY

SEQ ID NO: 18600 - protein, 7 aa, Artificial Sequence
  Synthetic construct
YRIFFRF

SEQ ID NO: 18601 - protein, 7 aa, Artificial Sequence
  Synthetic construct
YRIFFRY

SEQ ID NO: 18602 - protein, 7 aa, Artificial Sequence
  Synthetic construct
YRIFFCF

SEQ ID NO: 18603 - protein, 7 aa, Artificial Sequence
  Synthetic construct
YRIFFCY

SEQ ID NO: 18604 - protein, 7 aa, Artificial Sequence
  Synthetic construct
YRIFFLF

SEQ ID NO: 18605 - protein, 7 aa, Artificial Sequence
  Synthetic construct
YRIFFLY

SEQ ID NO: 18606 - protein, 7 aa, Artificial Sequence
  Synthetic construct
YRIFFAF

SEQ ID NO: 18607 - protein, 7 aa, Artificial Sequence
  Synthetic construct
YRIFFAY

SEQ ID NO: 18608 - protein, 7 aa, Artificial Sequence
  Synthetic construct
YRIFFQF

SEQ ID NO: 18609 - protein, 7 aa, Artificial Sequence
  Synthetic construct
YRIFFQY

SEQ ID NO: 18610 - protein, 7 aa, Artificial Sequence
  Synthetic construct
YRIFFDF

SEQ ID NO: 18611 - protein, 7 aa, Artificial Sequence
  Synthetic construct
YRIFFDY

SEQ ID NO: 18612 - protein, 7 aa, Artificial Sequence
  Synthetic construct
YRIFFVF

SEQ ID NO: 18613 - protein, 7 aa, Artificial Sequence
  Synthetic construct
YRIFFVY

SEQ ID NO: 18614 - protein, 7 aa, Artificial Sequence
  Synthetic construct
YRIFVFF

SEQ ID NO: 18615 - protein, 7 aa, Artificial Sequence
  Synthetic construct
YRIFVFY

SEQ ID NO: 18616 - protein, 7 aa, Artificial Sequence
  Synthetic construct
YRIFVRF

SEQ ID NO: 18617 - protein, 7 aa, Artificial Sequence
  Synthetic construct
YRIFVRY

SEQ ID NO: 18618 - protein, 7 aa, Artificial Sequence
  Synthetic construct
YRIFVCF

SEQ ID NO: 18619 - protein, 7 aa, Artificial Sequence
  Synthetic construct
YRIFVCY

SEQ ID NO: 18620 - protein, 7 aa, Artificial Sequence
  Synthetic construct
YRIFVLF

SEQ ID NO: 18621 - protein, 7 aa, Artificial Sequence
  Synthetic construct
YRIFVLY

SEQ ID NO: 18622 - protein, 7 aa, Artificial Sequence
  Synthetic construct
YRIFVAF

SEQ ID NO: 18623 - protein, 7 aa, Artificial Sequence
  Synthetic construct
YRIFVAY

SEQ ID NO: 18624 - protein, 7 aa, Artificial Sequence
  Synthetic construct
YRIFVQF

SEQ ID NO: 18625 - protein, 7 aa, Artificial Sequence
  Synthetic construct
YRIFVQY

SEQ ID NO: 18626 - protein, 7 aa, Artificial Sequence
  Synthetic construct
YRIFVDF

SEQ ID NO: 18627 - protein, 7 aa, Artificial Sequence
  Synthetic construct
YRIFVDY

SEQ ID NO: 18628 - protein, 7 aa, Artificial Sequence
  Synthetic construct
YRIFVVF

SEQ ID NO: 18629 - protein, 7 aa, Artificial Sequence
  Synthetic construct
YRIFVVY

SEQ ID NO: 18630 - protein, 7 aa, Artificial Sequence
  Synthetic construct
YRIFTFF

SEQ ID NO: 18631 - protein, 7 aa, Artificial Sequence
  Synthetic construct
YRIFTFY

SEQ ID NO: 18632 - protein, 7 aa, Artificial Sequence
  Synthetic construct
YRIFTRF

SEQ ID NO: 18633 - protein, 7 aa, Artificial Sequence
  Synthetic construct
YRIFTRY

SEQ ID NO: 18634 - protein, 7 aa, Artificial Sequence
  Synthetic construct
YRIFTCF

SEQ ID NO: 18635 - protein, 7 aa, Artificial Sequence
  Synthetic construct
YRIFTCY

SEQ ID NO: 18636 - protein, 7 aa, Artificial Sequence
  Synthetic construct
YRIFTLF

SEQ ID NO: 18637 - protein, 7 aa, Artificial Sequence
  Synthetic construct
YRIFTLY

SEQ ID NO: 18638 - protein, 7 aa, Artificial Sequence
  Synthetic construct
YRIFTAF

SEQ ID NO: 18639 - protein, 7 aa, Artificial Sequence
  Synthetic construct
YRIFTAY

SEQ ID NO: 18640 - protein, 7 aa, Artificial Sequence
  Synthetic construct
YRIFTQF

SEQ ID NO: 18641 - protein, 7 aa, Artificial Sequence
  Synthetic construct
YRIFTQY

SEQ ID NO: 18642 - protein, 7 aa, Artificial Sequence
  Synthetic construct
YRIFTDF

SEQ ID NO: 18643 - protein, 7 aa, Artificial Sequence
  Synthetic construct
YRIFTDY

SEQ ID NO: 18644 - protein, 7 aa, Artificial Sequence
  Synthetic construct
YRIFTVF

SEQ ID NO: 18645 - protein, 7 aa, Artificial Sequence
  Synthetic construct
YRIFTVY

SEQ ID NO: 18646 - protein, 7 aa, Artificial Sequence
  Synthetic construct
YRIFGFF

SEQ ID NO: 18647 - protein, 7 aa, Artificial Sequence
  Synthetic construct
YRIFGFY

SEQ ID NO: 18648 - protein, 7 aa, Artificial Sequence
  Synthetic construct
YRIFGRF

SEQ ID NO: 18649 - protein, 7 aa, Artificial Sequence
  Synthetic construct
YRIFGRY

SEQ ID NO: 18650 - protein, 7 aa, Artificial Sequence
  Synthetic construct
YRIFGCF

SEQ ID NO: 18651 - protein, 7 aa, Artificial Sequence
  Synthetic construct
YRIFGCY

SEQ ID NO: 18652 - protein, 7 aa, Artificial Sequence
  Synthetic construct
YRIFGLF

SEQ ID NO: 18653 - protein, 7 aa, Artificial Sequence
  Synthetic construct
YRIFGLY

SEQ ID NO: 18654 - protein, 7 aa, Artificial Sequence
  Synthetic construct
YRIFGAF

SEQ ID NO: 18655 - protein, 7 aa, Artificial Sequence
  Synthetic construct
YRIFGAY

SEQ ID NO: 18656 - protein, 7 aa, Artificial Sequence
  Synthetic construct
YRIFGQF

SEQ ID NO: 18657 - protein, 7 aa, Artificial Sequence
  Synthetic construct
YRIFGQY

SEQ ID NO: 18658 - protein, 7 aa, Artificial Sequence
  Synthetic construct
YRIFGDF

SEQ ID NO: 18659 - protein, 7 aa, Artificial Sequence
  Synthetic construct
YRIFGDY

SEQ ID NO: 18660 - protein, 7 aa, Artificial Sequence
  Synthetic construct
YRIFGVF

SEQ ID NO: 18661 - protein, 7 aa, Artificial Sequence
  Synthetic construct
YRIFGVY

SEQ ID NO: 18662 - protein, 7 aa, Artificial Sequence
  Synthetic construct
YRIFAFF

SEQ ID NO: 18663 - protein, 7 aa, Artificial Sequence
  Synthetic construct
YRIFAFY

SEQ ID NO: 18664 - protein, 7 aa, Artificial Sequence
  Synthetic construct
YRIFARF

SEQ ID NO: 18665 - protein, 7 aa, Artificial Sequence
  Synthetic construct
YRIFARY

SEQ ID NO: 18666 - protein, 7 aa, Artificial Sequence
  Synthetic construct
YRIFACF

SEQ ID NO: 18667 - protein, 7 aa, Artificial Sequence
  Synthetic construct
YRIFACY

SEQ ID NO: 18668 - protein, 7 aa, Artificial Sequence
  Synthetic construct
YRIFALF

SEQ ID NO: 18669 - protein, 7 aa, Artificial Sequence
  Synthetic construct
YRIFALY

SEQ ID NO: 18670 - protein, 7 aa, Artificial Sequence
  Synthetic construct
YRIFAAF

SEQ ID NO: 18671 - protein, 7 aa, Artificial Sequence
  Synthetic construct
YRIFAAY

SEQ ID NO: 18672 - protein, 7 aa, Artificial Sequence
  Synthetic construct
YRIFAQF

SEQ ID NO: 18673 - protein, 7 aa, Artificial Sequence
  Synthetic construct
YRIFAQY

SEQ ID NO: 18674 - protein, 7 aa, Artificial Sequence
  Synthetic construct
YRIFADF

SEQ ID NO: 18675 - protein, 7 aa, Artificial Sequence
  Synthetic construct
YRIFADY

SEQ ID NO: 18676 - protein, 7 aa, Artificial Sequence
  Synthetic construct
YRIFAVF

SEQ ID NO: 18677 - protein, 7 aa, Artificial Sequence
  Synthetic construct
YRIFAVY

SEQ ID NO: 18678 - protein, 7 aa, Artificial Sequence
  Synthetic construct
YRIFQFF

SEQ ID NO: 18679 - protein, 7 aa, Artificial Sequence
  Synthetic construct
YRIFQFY

SEQ ID NO: 18680 - protein, 7 aa, Artificial Sequence
  Synthetic construct
YRIFQRF

SEQ ID NO: 18681 - protein, 7 aa, Artificial Sequence
  Synthetic construct
YRIFQRY

SEQ ID NO: 18682 - protein, 7 aa, Artificial Sequence
  Synthetic construct
YRIFQCF

SEQ ID NO: 18683 - protein, 7 aa, Artificial Sequence
  Synthetic construct
YRIFQCY

SEQ ID NO: 18684 - protein, 7 aa, Artificial Sequence
  Synthetic construct
YRIFQLF

SEQ ID NO: 18685 - protein, 7 aa, Artificial Sequence
  Synthetic construct
YRIFQLY

SEQ ID NO: 18686 - protein, 7 aa, Artificial Sequence
  Synthetic construct
YRIFQAF

SEQ ID NO: 18687 - protein, 7 aa, Artificial Sequence
  Synthetic construct
YRIFQAY

SEQ ID NO: 18688 - protein, 7 aa, Artificial Sequence
  Synthetic construct
YRIFQQF

SEQ ID NO: 18689 - protein, 7 aa, Artificial Sequence
  Synthetic construct
YRIFQQY

SEQ ID NO: 18690 - protein, 7 aa, Artificial Sequence
  Synthetic construct
YRIFQDF

SEQ ID NO: 18691 - protein, 7 aa, Artificial Sequence
  Synthetic construct
YRIFQDY

SEQ ID NO: 18692 - protein, 7 aa, Artificial Sequence
  Synthetic construct
YRIFQVF

SEQ ID NO: 18693 - protein, 7 aa, Artificial Sequence
  Synthetic construct
YRIFQVY

SEQ ID NO: 18694 - protein, 7 aa, Artificial Sequence
  Synthetic construct
YRGYIFF

SEQ ID NO: 18695 - protein, 7 aa, Artificial Sequence
  Synthetic construct
YRGYIFY

SEQ ID NO: 18696 - protein, 7 aa, Artificial Sequence
  Synthetic construct
YRGYIRF

SEQ ID NO: 18697 - protein, 7 aa, Artificial Sequence
  Synthetic construct
YRGYIRY

SEQ ID NO: 18698 - protein, 7 aa, Artificial Sequence
  Synthetic construct
YRGYICF

SEQ ID NO: 18699 - protein, 7 aa, Artificial Sequence
  Synthetic construct
YRGYICY

SEQ ID NO: 18700 - protein, 7 aa, Artificial Sequence
  Synthetic construct
YRGYILF

SEQ ID NO: 18701 - protein, 7 aa, Artificial Sequence
  Synthetic construct
YRGYILY

SEQ ID NO: 18702 - protein, 7 aa, Artificial Sequence
  Synthetic construct
YRGYIAF

SEQ ID NO: 18703 - protein, 7 aa, Artificial Sequence
  Synthetic construct
YRGYIAY

SEQ ID NO: 18704 - protein, 7 aa, Artificial Sequence
  Synthetic construct
YRGYIQF

SEQ ID NO: 18705 - protein, 7 aa, Artificial Sequence
  Synthetic construct
YRGYIQY

SEQ ID NO: 18706 - protein, 7 aa, Artificial Sequence
  Synthetic construct
YRGYIDF

SEQ ID NO: 18707 - protein, 7 aa, Artificial Sequence
  Synthetic construct
YRGYIDY

SEQ ID NO: 18708 - protein, 7 aa, Artificial Sequence
  Synthetic construct
YRGYIVF

SEQ ID NO: 18709 - protein, 7 aa, Artificial Sequence
  Synthetic construct
YRGYIVY

SEQ ID NO: 18710 - protein, 7 aa, Artificial Sequence
  Synthetic construct
YRGYDFF

SEQ ID NO: 18711 - protein, 7 aa, Artificial Sequence
  Synthetic construct
YRGYDFY

SEQ ID NO: 18712 - protein, 7 aa, Artificial Sequence
  Synthetic construct
YRGYDRF

SEQ ID NO: 18713 - protein, 7 aa, Artificial Sequence
  Synthetic construct
YRGYDRY

SEQ ID NO: 18714 - protein, 7 aa, Artificial Sequence
  Synthetic construct
YRGYDCF

SEQ ID NO: 18715 - protein, 7 aa, Artificial Sequence
  Synthetic construct
YRGYDCY

SEQ ID NO: 18716 - protein, 7 aa, Artificial Sequence
  Synthetic construct
YRGYDLF

SEQ ID NO: 18717 - protein, 7 aa, Artificial Sequence
  Synthetic construct
YRGYDLY

SEQ ID NO: 18718 - protein, 7 aa, Artificial Sequence
  Synthetic construct
YRGYDAF

SEQ ID NO: 18719 - protein, 7 aa, Artificial Sequence
  Synthetic construct
YRGYDAY

SEQ ID NO: 18720 - protein, 7 aa, Artificial Sequence
  Synthetic construct
YRGYDQF

SEQ ID NO: 18721 - protein, 7 aa, Artificial Sequence
  Synthetic construct
YRGYDQY

SEQ ID NO: 18722 - protein, 7 aa, Artificial Sequence
  Synthetic construct
YRGYDDF

SEQ ID NO: 18723 - protein, 7 aa, Artificial Sequence
  Synthetic construct
YRGYDDY

SEQ ID NO: 18724 - protein, 7 aa, Artificial Sequence
  Synthetic construct
YRGYDVF

SEQ ID NO: 18725 - protein, 7 aa, Artificial Sequence
  Synthetic construct
YRGYDVY

SEQ ID NO: 18726 - protein, 7 aa, Artificial Sequence
  Synthetic construct
YRGYYFF

SEQ ID NO: 18727 - protein, 7 aa, Artificial Sequence
  Synthetic construct
YRGYYFY

SEQ ID NO: 18728 - protein, 7 aa, Artificial Sequence
  Synthetic construct
YRGYYRF

SEQ ID NO: 18729 - protein, 7 aa, Artificial Sequence
  Synthetic construct
YRGYYRY

SEQ ID NO: 18730 - protein, 7 aa, Artificial Sequence
  Synthetic construct
YRGYYCF

SEQ ID NO: 18731 - protein, 7 aa, Artificial Sequence
  Synthetic construct
YRGYYCY

SEQ ID NO: 18732 - protein, 7 aa, Artificial Sequence
  Synthetic construct
YRGYYLF

SEQ ID NO: 18733 - protein, 7 aa, Artificial Sequence
  Synthetic construct
YRGYYLY

SEQ ID NO: 18734 - protein, 7 aa, Artificial Sequence
  Synthetic construct
YRGYYAF

SEQ ID NO: 18735 - protein, 7 aa, Artificial Sequence
  Synthetic construct
YRGYYAY

SEQ ID NO: 18736 - protein, 7 aa, Artificial Sequence
  Synthetic construct
YRGYYQF

SEQ ID NO: 18737 - protein, 7 aa, Artificial Sequence
  Synthetic construct
YRGYYQY

SEQ ID NO: 18738 - protein, 7 aa, Artificial Sequence
  Synthetic construct
YRGYYDF

SEQ ID NO: 18739 - protein, 7 aa, Artificial Sequence
  Synthetic construct
YRGYYDY

SEQ ID NO: 18740 - protein, 7 aa, Artificial Sequence
  Synthetic construct
YRGYYVF

SEQ ID NO: 18741 - protein, 7 aa, Artificial Sequence
  Synthetic construct
YRGYYVY

SEQ ID NO: 18742 - protein, 7 aa, Artificial Sequence
  Synthetic construct
YRGYFFF

SEQ ID NO: 18743 - protein, 7 aa, Artificial Sequence
  Synthetic construct
YRGYFFY

SEQ ID NO: 18744 - protein, 7 aa, Artificial Sequence
  Synthetic construct
YRGYFRF

SEQ ID NO: 18745 - protein, 7 aa, Artificial Sequence
  Synthetic construct
YRGYFRY

SEQ ID NO: 18746 - protein, 7 aa, Artificial Sequence
  Synthetic construct
YRGYFCF

SEQ ID NO: 18747 - protein, 7 aa, Artificial Sequence
  Synthetic construct
YRGYFCY

SEQ ID NO: 18748 - protein, 7 aa, Artificial Sequence
  Synthetic construct
YRGYFLF

SEQ ID NO: 18749 - protein, 7 aa, Artificial Sequence
  Synthetic construct
YRGYFLY

SEQ ID NO: 18750 - protein, 7 aa, Artificial Sequence
  Synthetic construct
YRGYFAF

SEQ ID NO: 18751 - protein, 7 aa, Artificial Sequence
  Synthetic construct
YRGYFAY

SEQ ID NO: 18752 - protein, 7 aa, Artificial Sequence
  Synthetic construct
YRGYFQF

SEQ ID NO: 18753 - protein, 7 aa, Artificial Sequence
  Synthetic construct
YRGYFQY

SEQ ID NO: 18754 - protein, 7 aa, Artificial Sequence
  Synthetic construct
YRGYFDF

SEQ ID NO: 18755 - protein, 7 aa, Artificial Sequence
  Synthetic construct
YRGYFDY

SEQ ID NO: 18756 - protein, 7 aa, Artificial Sequence
  Synthetic construct
YRGYFVF

SEQ ID NO: 18757 - protein, 7 aa, Artificial Sequence
  Synthetic construct
YRGYFVY

SEQ ID NO: 18758 - protein, 7 aa, Artificial Sequence
  Synthetic construct
YRGYVFF

SEQ ID NO: 18759 - protein, 7 aa, Artificial Sequence
  Synthetic construct
YRGYVFY

SEQ ID NO: 18760 - protein, 7 aa, Artificial Sequence
  Synthetic construct
YRGYVRF

SEQ ID NO: 18761 - protein, 7 aa, Artificial Sequence
  Synthetic construct
YRGYVRY

SEQ ID NO: 18762 - protein, 7 aa, Artificial Sequence
  Synthetic construct
YRGYVCF

SEQ ID NO: 18763 - protein, 7 aa, Artificial Sequence
  Synthetic construct
YRGYVCY

SEQ ID NO: 18764 - protein, 7 aa, Artificial Sequence
  Synthetic construct
YRGYVLF

SEQ ID NO: 18765 - protein, 7 aa, Artificial Sequence
  Synthetic construct
YRGYVLY

SEQ ID NO: 18766 - protein, 7 aa, Artificial Sequence
  Synthetic construct
YRGYVAF

SEQ ID NO: 18767 - protein, 7 aa, Artificial Sequence
  Synthetic construct
YRGYVAY

SEQ ID NO: 18768 - protein, 7 aa, Artificial Sequence
  Synthetic construct
YRGYVQF

SEQ ID NO: 18769 - protein, 7 aa, Artificial Sequence
  Synthetic construct
YRGYVQY

SEQ ID NO: 18770 - protein, 7 aa, Artificial Sequence
  Synthetic construct
YRGYVDF

SEQ ID NO: 18771 - protein, 7 aa, Artificial Sequence
  Synthetic construct
YRGYVDY

SEQ ID NO: 18772 - protein, 7 aa, Artificial Sequence
  Synthetic construct
YRGYVVF

SEQ ID NO: 18773 - protein, 7 aa, Artificial Sequence
  Synthetic construct
YRGYVVY

SEQ ID NO: 18774 - protein, 7 aa, Artificial Sequence
  Synthetic construct
YRGYTFF

SEQ ID NO: 18775 - protein, 7 aa, Artificial Sequence
  Synthetic construct
YRGYTFY

SEQ ID NO: 18776 - protein, 7 aa, Artificial Sequence
  Synthetic construct
YRGYTRF

SEQ ID NO: 18777 - protein, 7 aa, Artificial Sequence
  Synthetic construct
YRGYTRY

SEQ ID NO: 18778 - protein, 7 aa, Artificial Sequence
  Synthetic construct
YRGYTCF

SEQ ID NO: 18779 - protein, 7 aa, Artificial Sequence
  Synthetic construct
YRGYTCY

SEQ ID NO: 18780 - protein, 7 aa, Artificial Sequence
  Synthetic construct
YRGYTLF

SEQ ID NO: 18781 - protein, 7 aa, Artificial Sequence
  Synthetic construct
YRGYTLY

SEQ ID NO: 18782 - protein, 7 aa, Artificial Sequence
  Synthetic construct
YRGYTAF

SEQ ID NO: 18783 - protein, 7 aa, Artificial Sequence
  Synthetic construct
YRGYTAY

SEQ ID NO: 18784 - protein, 7 aa, Artificial Sequence
  Synthetic construct
YRGYTQF

SEQ ID NO: 18785 - protein, 7 aa, Artificial Sequence
  Synthetic construct
YRGYTQY

SEQ ID NO: 18786 - protein, 7 aa, Artificial Sequence
  Synthetic construct
YRGYTDF

SEQ ID NO: 18787 - protein, 7 aa, Artificial Sequence
  Synthetic construct
YRGYTDY

SEQ ID NO: 18788 - protein, 7 aa, Artificial Sequence
  Synthetic construct
YRGYTVF

SEQ ID NO: 18789 - protein, 7 aa, Artificial Sequence
  Synthetic construct
YRGYTVY

SEQ ID NO: 18790 - protein, 7 aa, Artificial Sequence
  Synthetic construct
YRGYGFF

SEQ ID NO: 18791 - protein, 7 aa, Artificial Sequence
  Synthetic construct
YRGYGFY

SEQ ID NO: 18792 - protein, 7 aa, Artificial Sequence
  Synthetic construct
YRGYGRF

SEQ ID NO: 18793 - protein, 7 aa, Artificial Sequence
  Synthetic construct
YRGYGRY

SEQ ID NO: 18794 - protein, 7 aa, Artificial Sequence
  Synthetic construct
YRGYGCF

SEQ ID NO: 18795 - protein, 7 aa, Artificial Sequence
  Synthetic construct
YRGYGCY

SEQ ID NO: 18796 - protein, 7 aa, Artificial Sequence
  Synthetic construct
YRGYGLF

SEQ ID NO: 18797 - protein, 7 aa, Artificial Sequence
  Synthetic construct
YRGYGLY

SEQ ID NO: 18798 - protein, 7 aa, Artificial Sequence
  Synthetic construct
YRGYGAF

SEQ ID NO: 18799 - protein, 7 aa, Artificial Sequence
  Synthetic construct
YRGYGAY

SEQ ID NO: 18800 - protein, 7 aa, Artificial Sequence
  Synthetic construct
YRGYGQF

SEQ ID NO: 18801 - protein, 7 aa, Artificial Sequence
  Synthetic construct
YRGYGQY

SEQ ID NO: 18802 - protein, 7 aa, Artificial Sequence
  Synthetic construct
YRGYGDF

SEQ ID NO: 18803 - protein, 7 aa, Artificial Sequence
  Synthetic construct
YRGYGDY

SEQ ID NO: 18804 - protein, 7 aa, Artificial Sequence
  Synthetic construct
YRGYGVF

SEQ ID NO: 18805 - protein, 7 aa, Artificial Sequence
  Synthetic construct
YRGYGVY

SEQ ID NO: 18806 - protein, 7 aa, Artificial Sequence
  Synthetic construct
YRGYAFF

SEQ ID NO: 18807 - protein, 7 aa, Artificial Sequence
  Synthetic construct
YRGYAFY

SEQ ID NO: 18808 - protein, 7 aa, Artificial Sequence
  Synthetic construct
YRGYARF

SEQ ID NO: 18809 - protein, 7 aa, Artificial Sequence
  Synthetic construct
YRGYARY

SEQ ID NO: 18810 - protein, 7 aa, Artificial Sequence
  Synthetic construct
YRGYACF

SEQ ID NO: 18811 - protein, 7 aa, Artificial Sequence
  Synthetic construct
YRGYACY

SEQ ID NO: 18812 - protein, 7 aa, Artificial Sequence
  Synthetic construct
YRGYALF

SEQ ID NO: 18813 - protein, 7 aa, Artificial Sequence
  Synthetic construct
YRGYALY

SEQ ID NO: 18814 - protein, 7 aa, Artificial Sequence
  Synthetic construct
YRGYAAF

SEQ ID NO: 18815 - protein, 7 aa, Artificial Sequence
  Synthetic construct
YRGYAAY

SEQ ID NO: 18816 - protein, 7 aa, Artificial Sequence
  Synthetic construct
YRGYAQF

SEQ ID NO: 18817 - protein, 7 aa, Artificial Sequence
  Synthetic construct
YRGYAQY

SEQ ID NO: 18818 - protein, 7 aa, Artificial Sequence
  Synthetic construct
YRGYADF

SEQ ID NO: 18819 - protein, 7 aa, Artificial Sequence
  Synthetic construct
YRGYADY

SEQ ID NO: 18820 - protein, 7 aa, Artificial Sequence
  Synthetic construct
YRGYAVF

SEQ ID NO: 18821 - protein, 7 aa, Artificial Sequence
  Synthetic construct
YRGYAVY

SEQ ID NO: 18822 - protein, 7 aa, Artificial Sequence
  Synthetic construct
YRGYQFF

SEQ ID NO: 18823 - protein, 7 aa, Artificial Sequence
  Synthetic construct
YRGYQFY

SEQ ID NO: 18824 - protein, 7 aa, Artificial Sequence
  Synthetic construct
YRGYQRF

SEQ ID NO: 18825 - protein, 7 aa, Artificial Sequence
  Synthetic construct
YRGYQRY

SEQ ID NO: 18826 - protein, 7 aa, Artificial Sequence
  Synthetic construct
YRGYQCF

SEQ ID NO: 18827 - protein, 7 aa, Artificial Sequence
  Synthetic construct
YRGYQCY

SEQ ID NO: 18828 - protein, 7 aa, Artificial Sequence
  Synthetic construct
YRGYQLF

SEQ ID NO: 18829 - protein, 7 aa, Artificial Sequence
  Synthetic construct
YRGYQLY

SEQ ID NO: 18830 - protein, 7 aa, Artificial Sequence
  Synthetic construct
YRGYQAF

SEQ ID NO: 18831 - protein, 7 aa, Artificial Sequence
  Synthetic construct
YRGYQAY

SEQ ID NO: 18832 - protein, 7 aa, Artificial Sequence
  Synthetic construct
YRGYQQF

SEQ ID NO: 18833 - protein, 7 aa, Artificial Sequence
  Synthetic construct
YRGYQQY

SEQ ID NO: 18834 - protein, 7 aa, Artificial Sequence
  Synthetic construct
YRGYQDF

SEQ ID NO: 18835 - protein, 7 aa, Artificial Sequence
  Synthetic construct
YRGYQDY

SEQ ID NO: 18836 - protein, 7 aa, Artificial Sequence
  Synthetic construct
YRGYQVF

SEQ ID NO: 18837 - protein, 7 aa, Artificial Sequence
  Synthetic construct
YRGYQVY

SEQ ID NO: 18838 - protein, 7 aa, Artificial Sequence
  Synthetic construct
YRGPIFF

SEQ ID NO: 18839 - protein, 7 aa, Artificial Sequence
  Synthetic construct
YRGPIFY

SEQ ID NO: 18840 - protein, 7 aa, Artificial Sequence
  Synthetic construct
YRGPIRF

SEQ ID NO: 18841 - protein, 7 aa, Artificial Sequence
  Synthetic construct
YRGPIRY

SEQ ID NO: 18842 - protein, 7 aa, Artificial Sequence
  Synthetic construct
YRGPICF

SEQ ID NO: 18843 - protein, 7 aa, Artificial Sequence
  Synthetic construct
YRGPICY

SEQ ID NO: 18844 - protein, 7 aa, Artificial Sequence
  Synthetic construct
YRGPILF

SEQ ID NO: 18845 - protein, 7 aa, Artificial Sequence
  Synthetic construct
YRGPILY

SEQ ID NO: 18846 - protein, 7 aa, Artificial Sequence
  Synthetic construct
YRGPIAF

SEQ ID NO: 18847 - protein, 7 aa, Artificial Sequence
  Synthetic construct
YRGPIAY

SEQ ID NO: 18848 - protein, 7 aa, Artificial Sequence
  Synthetic construct
YRGPIQF

SEQ ID NO: 18849 - protein, 7 aa, Artificial Sequence
  Synthetic construct
YRGPIQY

SEQ ID NO: 18850 - protein, 7 aa, Artificial Sequence
  Synthetic construct
YRGPIDF

SEQ ID NO: 18851 - protein, 7 aa, Artificial Sequence
  Synthetic construct
YRGPIDY

SEQ ID NO: 18852 - protein, 7 aa, Artificial Sequence
  Synthetic construct
YRGPIVF

SEQ ID NO: 18853 - protein, 7 aa, Artificial Sequence
  Synthetic construct
YRGPIVY

SEQ ID NO: 18854 - protein, 7 aa, Artificial Sequence
  Synthetic construct
YRGPDFF

SEQ ID NO: 18855 - protein, 7 aa, Artificial Sequence
  Synthetic construct
YRGPDFY

SEQ ID NO: 18856 - protein, 7 aa, Artificial Sequence
  Synthetic construct
YRGPDRF

SEQ ID NO: 18857 - protein, 7 aa, Artificial Sequence
  Synthetic construct
YRGPDRY

SEQ ID NO: 18858 - protein, 7 aa, Artificial Sequence
  Synthetic construct
YRGPDCF

SEQ ID NO: 18859 - protein, 7 aa, Artificial Sequence
  Synthetic construct
YRGPDCY

SEQ ID NO: 18860 - protein, 7 aa, Artificial Sequence
  Synthetic construct
YRGPDLF

SEQ ID NO: 18861 - protein, 7 aa, Artificial Sequence
  Synthetic construct
YRGPDLY

SEQ ID NO: 18862 - protein, 7 aa, Artificial Sequence
  Synthetic construct
YRGPDAF

SEQ ID NO: 18863 - protein, 7 aa, Artificial Sequence
  Synthetic construct
YRGPDAY

SEQ ID NO: 18864 - protein, 7 aa, Artificial Sequence
  Synthetic construct
YRGPDQF

SEQ ID NO: 18865 - protein, 7 aa, Artificial Sequence
  Synthetic construct
YRGPDQY

SEQ ID NO: 18866 - protein, 7 aa, Artificial Sequence
  Synthetic construct
YRGPDDF

SEQ ID NO: 18867 - protein, 7 aa, Artificial Sequence
  Synthetic construct
YRGPDDY

SEQ ID NO: 18868 - protein, 7 aa, Artificial Sequence
  Synthetic construct
YRGPDVF

SEQ ID NO: 18869 - protein, 7 aa, Artificial Sequence
  Synthetic construct
YRGPDVY

SEQ ID NO: 18870 - protein, 7 aa, Artificial Sequence
  Synthetic construct
YRGPYFF

SEQ ID NO: 18871 - protein, 7 aa, Artificial Sequence
  Synthetic construct
YRGPYFY

SEQ ID NO: 18872 - protein, 7 aa, Artificial Sequence
  Synthetic construct
YRGPYRF

SEQ ID NO: 18873 - protein, 7 aa, Artificial Sequence
  Synthetic construct
YRGPYRY

SEQ ID NO: 18874 - protein, 7 aa, Artificial Sequence
  Synthetic construct
YRGPYCF

SEQ ID NO: 18875 - protein, 7 aa, Artificial Sequence
  Synthetic construct
YRGPYCY

SEQ ID NO: 18876 - protein, 7 aa, Artificial Sequence
  Synthetic construct
YRGPYLF

SEQ ID NO: 18877 - protein, 7 aa, Artificial Sequence
  Synthetic construct
YRGPYLY

SEQ ID NO: 18878 - protein, 7 aa, Artificial Sequence
  Synthetic construct
YRGPYAF

SEQ ID NO: 18879 - protein, 7 aa, Artificial Sequence
  Synthetic construct
YRGPYAY

SEQ ID NO: 18880 - protein, 7 aa, Artificial Sequence
  Synthetic construct
YRGPYQF

SEQ ID NO: 18881 - protein, 7 aa, Artificial Sequence
  Synthetic construct
YRGPYQY

SEQ ID NO: 18882 - protein, 7 aa, Artificial Sequence
  Synthetic construct
YRGPYDF

SEQ ID NO: 18883 - protein, 7 aa, Artificial Sequence
  Synthetic construct
YRGPYDY

SEQ ID NO: 18884 - protein, 7 aa, Artificial Sequence
  Synthetic construct
YRGPYVF

SEQ ID NO: 18885 - protein, 7 aa, Artificial Sequence
  Synthetic construct
YRGPYVY

SEQ ID NO: 18886 - protein, 7 aa, Artificial Sequence
  Synthetic construct
YRGPFFF

SEQ ID NO: 18887 - protein, 7 aa, Artificial Sequence
  Synthetic construct
YRGPFFY

SEQ ID NO: 18888 - protein, 7 aa, Artificial Sequence
  Synthetic construct
YRGPFRF

SEQ ID NO: 18889 - protein, 7 aa, Artificial Sequence
  Synthetic construct
YRGPFRY

SEQ ID NO: 18890 - protein, 7 aa, Artificial Sequence
  Synthetic construct
YRGPFCF

SEQ ID NO: 18891 - protein, 7 aa, Artificial Sequence
  Synthetic construct
YRGPFCY

SEQ ID NO: 18892 - protein, 7 aa, Artificial Sequence
  Synthetic construct
YRGPFLF

SEQ ID NO: 18893 - protein, 7 aa, Artificial Sequence
  Synthetic construct
YRGPFLY

SEQ ID NO: 18894 - protein, 7 aa, Artificial Sequence
  Synthetic construct
YRGPFAF

SEQ ID NO: 18895 - protein, 7 aa, Artificial Sequence
  Synthetic construct
YRGPFAY

SEQ ID NO: 18896 - protein, 7 aa, Artificial Sequence
  Synthetic construct
YRGPFQF

SEQ ID NO: 18897 - protein, 7 aa, Artificial Sequence
  Synthetic construct
YRGPFQY

SEQ ID NO: 18898 - protein, 7 aa, Artificial Sequence
  Synthetic construct
YRGPFDF

SEQ ID NO: 18899 - protein, 7 aa, Artificial Sequence
  Synthetic construct
YRGPFDY

SEQ ID NO: 18900 - protein, 7 aa, Artificial Sequence
  Synthetic construct
YRGPFVF

SEQ ID NO: 18901 - protein, 7 aa, Artificial Sequence
  Synthetic construct
YRGPFVY

SEQ ID NO: 18902 - protein, 7 aa, Artificial Sequence
  Synthetic construct
YRGPVFF

SEQ ID NO: 18903 - protein, 7 aa, Artificial Sequence
  Synthetic construct
YRGPVFY

SEQ ID NO: 18904 - protein, 7 aa, Artificial Sequence
  Synthetic construct
YRGPVRF

SEQ ID NO: 18905 - protein, 7 aa, Artificial Sequence
  Synthetic construct
YRGPVRY

SEQ ID NO: 18906 - protein, 7 aa, Artificial Sequence
  Synthetic construct
YRGPVCF

SEQ ID NO: 18907 - protein, 7 aa, Artificial Sequence
  Synthetic construct
YRGPVCY

SEQ ID NO: 18908 - protein, 7 aa, Artificial Sequence
  Synthetic construct
YRGPVLF

SEQ ID NO: 18909 - protein, 7 aa, Artificial Sequence
  Synthetic construct
YRGPVLY

SEQ ID NO: 18910 - protein, 7 aa, Artificial Sequence
  Synthetic construct
YRGPVAF

SEQ ID NO: 18911 - protein, 7 aa, Artificial Sequence
  Synthetic construct
YRGPVAY

SEQ ID NO: 18912 - protein, 7 aa, Artificial Sequence
  Synthetic construct
YRGPVQF

SEQ ID NO: 18913 - protein, 7 aa, Artificial Sequence
  Synthetic construct
YRGPVQY

SEQ ID NO: 18914 - protein, 7 aa, Artificial Sequence
  Synthetic construct
YRGPVDF

SEQ ID NO: 18915 - protein, 7 aa, Artificial Sequence
  Synthetic construct
YRGPVDY

SEQ ID NO: 18916 - protein, 7 aa, Artificial Sequence
  Synthetic construct
YRGPVVF

SEQ ID NO: 18917 - protein, 7 aa, Artificial Sequence
  Synthetic construct
YRGPVVY

SEQ ID NO: 18918 - protein, 7 aa, Artificial Sequence
  Synthetic construct
YRGPTFF

SEQ ID NO: 18919 - protein, 7 aa, Artificial Sequence
  Synthetic construct
YRGPTFY

SEQ ID NO: 18920 - protein, 7 aa, Artificial Sequence
  Synthetic construct
YRGPTRF

SEQ ID NO: 18921 - protein, 7 aa, Artificial Sequence
  Synthetic construct
YRGPTRY

SEQ ID NO: 18922 - protein, 7 aa, Artificial Sequence
  Synthetic construct
YRGPTCF

SEQ ID NO: 18923 - protein, 7 aa, Artificial Sequence
  Synthetic construct
YRGPTCY

SEQ ID NO: 18924 - protein, 7 aa, Artificial Sequence
  Synthetic construct
YRGPTLF

SEQ ID NO: 18925 - protein, 7 aa, Artificial Sequence
  Synthetic construct
YRGPTLY

SEQ ID NO: 18926 - protein, 7 aa, Artificial Sequence
  Synthetic construct
YRGPTAF

SEQ ID NO: 18927 - protein, 7 aa, Artificial Sequence
  Synthetic construct
YRGPTAY

SEQ ID NO: 18928 - protein, 7 aa, Artificial Sequence
  Synthetic construct
YRGPTQF

SEQ ID NO: 18929 - protein, 7 aa, Artificial Sequence
  Synthetic construct
YRGPTQY

SEQ ID NO: 18930 - protein, 7 aa, Artificial Sequence
  Synthetic construct
YRGPTDF

SEQ ID NO: 18931 - protein, 7 aa, Artificial Sequence
  Synthetic construct
YRGPTDY

SEQ ID NO: 18932 - protein, 7 aa, Artificial Sequence
  Synthetic construct
YRGPTVF

SEQ ID NO: 18933 - protein, 7 aa, Artificial Sequence
  Synthetic construct
YRGPTVY

SEQ ID NO: 18934 - protein, 7 aa, Artificial Sequence
  Synthetic construct
YRGPGFF

SEQ ID NO: 18935 - protein, 7 aa, Artificial Sequence
  Synthetic construct
YRGPGFY

SEQ ID NO: 18936 - protein, 7 aa, Artificial Sequence
  Synthetic construct
YRGPGRF

SEQ ID NO: 18937 - protein, 7 aa, Artificial Sequence
  Synthetic construct
YRGPGRY

SEQ ID NO: 18938 - protein, 7 aa, Artificial Sequence
  Synthetic construct
YRGPGCF

SEQ ID NO: 18939 - protein, 7 aa, Artificial Sequence
  Synthetic construct
YRGPGCY

SEQ ID NO: 18940 - protein, 7 aa, Artificial Sequence
  Synthetic construct
YRGPGLF

SEQ ID NO: 18941 - protein, 7 aa, Artificial Sequence
  Synthetic construct
YRGPGLY

SEQ ID NO: 18942 - protein, 7 aa, Artificial Sequence
  Synthetic construct
YRGPGAF

SEQ ID NO: 18943 - protein, 7 aa, Artificial Sequence
  Synthetic construct
YRGPGAY

SEQ ID NO: 18944 - protein, 7 aa, Artificial Sequence
  Synthetic construct
YRGPGQF

SEQ ID NO: 18945 - protein, 7 aa, Artificial Sequence
  Synthetic construct
YRGPGQY

SEQ ID NO: 18946 - protein, 7 aa, Artificial Sequence
  Synthetic construct
YRGPGDF

SEQ ID NO: 18947 - protein, 7 aa, Artificial Sequence
  Synthetic construct
YRGPGDY

SEQ ID NO: 18948 - protein, 7 aa, Artificial Sequence
  Synthetic construct
YRGPGVF

SEQ ID NO: 18949 - protein, 7 aa, Artificial Sequence
  Synthetic construct
YRGPGVY

SEQ ID NO: 18950 - protein, 7 aa, Artificial Sequence
  Synthetic construct
YRGPAFF

SEQ ID NO: 18951 - protein, 7 aa, Artificial Sequence
  Synthetic construct
YRGPAFY

SEQ ID NO: 18952 - protein, 7 aa, Artificial Sequence
  Synthetic construct
YRGPARF

SEQ ID NO: 18953 - protein, 7 aa, Artificial Sequence
  Synthetic construct
YRGPARY

SEQ ID NO: 18954 - protein, 7 aa, Artificial Sequence
  Synthetic construct
YRGPACF

SEQ ID NO: 18955 - protein, 7 aa, Artificial Sequence
  Synthetic construct
YRGPACY

SEQ ID NO: 18956 - protein, 7 aa, Artificial Sequence
  Synthetic construct
YRGPALF

SEQ ID NO: 18957 - protein, 7 aa, Artificial Sequence
  Synthetic construct
YRGPALY

SEQ ID NO: 18958 - protein, 7 aa, Artificial Sequence
  Synthetic construct
YRGPAAF

SEQ ID NO: 18959 - protein, 7 aa, Artificial Sequence
  Synthetic construct
YRGPAAY

SEQ ID NO: 18960 - protein, 7 aa, Artificial Sequence
  Synthetic construct
YRGPAQF

SEQ ID NO: 18961 - protein, 7 aa, Artificial Sequence
  Synthetic construct
YRGPAQY

SEQ ID NO: 18962 - protein, 7 aa, Artificial Sequence
  Synthetic construct
YRGPADF

SEQ ID NO: 18963 - protein, 7 aa, Artificial Sequence
  Synthetic construct
YRGPADY

SEQ ID NO: 18964 - protein, 7 aa, Artificial Sequence
  Synthetic construct
YRGPAVF

SEQ ID NO: 18965 - protein, 7 aa, Artificial Sequence
  Synthetic construct
YRGPAVY

SEQ ID NO: 18966 - protein, 7 aa, Artificial Sequence
  Synthetic construct
YRGPQFF

SEQ ID NO: 18967 - protein, 7 aa, Artificial Sequence
  Synthetic construct
YRGPQFY

SEQ ID NO: 18968 - protein, 7 aa, Artificial Sequence
  Synthetic construct
YRGPQRF

SEQ ID NO: 18969 - protein, 7 aa, Artificial Sequence
  Synthetic construct
YRGPQRY

SEQ ID NO: 18970 - protein, 7 aa, Artificial Sequence
  Synthetic construct
YRGPQCF

SEQ ID NO: 18971 - protein, 7 aa, Artificial Sequence
  Synthetic construct
YRGPQCY

SEQ ID NO: 18972 - protein, 7 aa, Artificial Sequence
  Synthetic construct
YRGPQLF

SEQ ID NO: 18973 - protein, 7 aa, Artificial Sequence
  Synthetic construct
YRGPQLY

SEQ ID NO: 18974 - protein, 7 aa, Artificial Sequence
  Synthetic construct
YRGPQAF

SEQ ID NO: 18975 - protein, 7 aa, Artificial Sequence
  Synthetic construct
YRGPQAY

SEQ ID NO: 18976 - protein, 7 aa, Artificial Sequence
  Synthetic construct
YRGPQQF

SEQ ID NO: 18977 - protein, 7 aa, Artificial Sequence
  Synthetic construct
YRGPQQY

SEQ ID NO: 18978 - protein, 7 aa, Artificial Sequence
  Synthetic construct
YRGPQDF

SEQ ID NO: 18979 - protein, 7 aa, Artificial Sequence
  Synthetic construct
YRGPQDY

SEQ ID NO: 18980 - protein, 7 aa, Artificial Sequence
  Synthetic construct
YRGPQVF

SEQ ID NO: 18981 - protein, 7 aa, Artificial Sequence
  Synthetic construct
YRGPQVY

SEQ ID NO: 18982 - protein, 7 aa, Artificial Sequence
  Synthetic construct
YRGHIFF

SEQ ID NO: 18983 - protein, 7 aa, Artificial Sequence
  Synthetic construct
YRGHIFY

SEQ ID NO: 18984 - protein, 7 aa, Artificial Sequence
  Synthetic construct
YRGHIRF

SEQ ID NO: 18985 - protein, 7 aa, Artificial Sequence
  Synthetic construct
YRGHIRY

SEQ ID NO: 18986 - protein, 7 aa, Artificial Sequence
  Synthetic construct
YRGHICF

SEQ ID NO: 18987 - protein, 7 aa, Artificial Sequence
  Synthetic construct
YRGHICY

SEQ ID NO: 18988 - protein, 7 aa, Artificial Sequence
  Synthetic construct
YRGHILF

SEQ ID NO: 18989 - protein, 7 aa, Artificial Sequence
  Synthetic construct
YRGHILY

SEQ ID NO: 18990 - protein, 7 aa, Artificial Sequence
  Synthetic construct
YRGHIAF

SEQ ID NO: 18991 - protein, 7 aa, Artificial Sequence
  Synthetic construct
YRGHIAY

SEQ ID NO: 18992 - protein, 7 aa, Artificial Sequence
  Synthetic construct
YRGHIQF

SEQ ID NO: 18993 - protein, 7 aa, Artificial Sequence
  Synthetic construct
YRGHIQY

SEQ ID NO: 18994 - protein, 7 aa, Artificial Sequence
  Synthetic construct
YRGHIDF

SEQ ID NO: 18995 - protein, 7 aa, Artificial Sequence
  Synthetic construct
YRGHIDY

SEQ ID NO: 18996 - protein, 7 aa, Artificial Sequence
  Synthetic construct
YRGHIVF

SEQ ID NO: 18997 - protein, 7 aa, Artificial Sequence
  Synthetic construct
YRGHIVY

SEQ ID NO: 18998 - protein, 7 aa, Artificial Sequence
  Synthetic construct
YRGHDFF

SEQ ID NO: 18999 - protein, 7 aa, Artificial Sequence
  Synthetic construct
YRGHDFY

SEQ ID NO: 19000 - protein, 7 aa, Artificial Sequence
  Synthetic construct
YRGHDRF

SEQ ID NO: 19001 - protein, 7 aa, Artificial Sequence
  Synthetic construct
YRGHDRY

SEQ ID NO: 19002 - protein, 7 aa, Artificial Sequence
  Synthetic construct
YRGHDCF

SEQ ID NO: 19003 - protein, 7 aa, Artificial Sequence
  Synthetic construct
YRGHDCY

SEQ ID NO: 19004 - protein, 7 aa, Artificial Sequence
  Synthetic construct
YRGHDLF

SEQ ID NO: 19005 - protein, 7 aa, Artificial Sequence
  Synthetic construct
YRGHDLY

SEQ ID NO: 19006 - protein, 7 aa, Artificial Sequence
  Synthetic construct
YRGHDAF

SEQ ID NO: 19007 - protein, 7 aa, Artificial Sequence
  Synthetic construct
YRGHDAY

SEQ ID NO: 19008 - protein, 7 aa, Artificial Sequence
  Synthetic construct
YRGHDQF

SEQ ID NO: 19009 - protein, 7 aa, Artificial Sequence
  Synthetic construct
YRGHDQY

SEQ ID NO: 19010 - protein, 7 aa, Artificial Sequence
  Synthetic construct
YRGHDDF

SEQ ID NO: 19011 - protein, 7 aa, Artificial Sequence
  Synthetic construct
YRGHDDY

SEQ ID NO: 19012 - protein, 7 aa, Artificial Sequence
  Synthetic construct
YRGHDVF

SEQ ID NO: 19013 - protein, 7 aa, Artificial Sequence
  Synthetic construct
YRGHDVY

SEQ ID NO: 19014 - protein, 7 aa, Artificial Sequence
  Synthetic construct
YRGHYFF

SEQ ID NO: 19015 - protein, 7 aa, Artificial Sequence
  Synthetic construct
YRGHYFY

SEQ ID NO: 19016 - protein, 7 aa, Artificial Sequence
  Synthetic construct
YRGHYRF

SEQ ID NO: 19017 - protein, 7 aa, Artificial Sequence
  Synthetic construct
YRGHYRY

SEQ ID NO: 19018 - protein, 7 aa, Artificial Sequence
  Synthetic construct
YRGHYCF

SEQ ID NO: 19019 - protein, 7 aa, Artificial Sequence
  Synthetic construct
YRGHYCY

SEQ ID NO: 19020 - protein, 7 aa, Artificial Sequence
  Synthetic construct
YRGHYLF

SEQ ID NO: 19021 - protein, 7 aa, Artificial Sequence
  Synthetic construct
YRGHYLY

SEQ ID NO: 19022 - protein, 7 aa, Artificial Sequence
  Synthetic construct
YRGHYAF

SEQ ID NO: 19023 - protein, 7 aa, Artificial Sequence
  Synthetic construct
YRGHYAY

SEQ ID NO: 19024 - protein, 7 aa, Artificial Sequence
  Synthetic construct
YRGHYQF

SEQ ID NO: 19025 - protein, 7 aa, Artificial Sequence
  Synthetic construct
YRGHYQY

SEQ ID NO: 19026 - protein, 7 aa, Artificial Sequence
  Synthetic construct
YRGHYDF

SEQ ID NO: 19027 - protein, 7 aa, Artificial Sequence
  Synthetic construct
YRGHYDY

SEQ ID NO: 19028 - protein, 7 aa, Artificial Sequence
  Synthetic construct
YRGHYVF

SEQ ID NO: 19029 - protein, 7 aa, Artificial Sequence
  Synthetic construct
YRGHYVY

SEQ ID NO: 19030 - protein, 7 aa, Artificial Sequence
  Synthetic construct
YRGHFFF

SEQ ID NO: 19031 - protein, 7 aa, Artificial Sequence
  Synthetic construct
YRGHFFY

SEQ ID NO: 19032 - protein, 7 aa, Artificial Sequence
  Synthetic construct
YRGHFRF

SEQ ID NO: 19033 - protein, 7 aa, Artificial Sequence
  Synthetic construct
YRGHFRY

SEQ ID NO: 19034 - protein, 7 aa, Artificial Sequence
  Synthetic construct
YRGHFCF

SEQ ID NO: 19035 - protein, 7 aa, Artificial Sequence
  Synthetic construct
YRGHFCY

SEQ ID NO: 19036 - protein, 7 aa, Artificial Sequence
  Synthetic construct
YRGHFLF

SEQ ID NO: 19037 - protein, 7 aa, Artificial Sequence
  Synthetic construct
YRGHFLY

SEQ ID NO: 19038 - protein, 7 aa, Artificial Sequence
  Synthetic construct
YRGHFAF

SEQ ID NO: 19039 - protein, 7 aa, Artificial Sequence
  Synthetic construct
YRGHFAY

SEQ ID NO: 19040 - protein, 7 aa, Artificial Sequence
  Synthetic construct
YRGHFQF

SEQ ID NO: 19041 - protein, 7 aa, Artificial Sequence
  Synthetic construct
YRGHFQY

SEQ ID NO: 19042 - protein, 7 aa, Artificial Sequence
  Synthetic construct
YRGHFDF

SEQ ID NO: 19043 - protein, 7 aa, Artificial Sequence
  Synthetic construct
YRGHFDY

SEQ ID NO: 19044 - protein, 7 aa, Artificial Sequence
  Synthetic construct
YRGHFVF

SEQ ID NO: 19045 - protein, 7 aa, Artificial Sequence
  Synthetic construct
YRGHFVY

SEQ ID NO: 19046 - protein, 7 aa, Artificial Sequence
  Synthetic construct
YRGHVFF

SEQ ID NO: 19047 - protein, 7 aa, Artificial Sequence
  Synthetic construct
YRGHVFY

SEQ ID NO: 19048 - protein, 7 aa, Artificial Sequence
  Synthetic construct
YRGHVRF

SEQ ID NO: 19049 - protein, 7 aa, Artificial Sequence
  Synthetic construct
YRGHVRY

SEQ ID NO: 19050 - protein, 7 aa, Artificial Sequence
  Synthetic construct
YRGHVCF

SEQ ID NO: 19051 - protein, 7 aa, Artificial Sequence
  Synthetic construct
YRGHVCY

SEQ ID NO: 19052 - protein, 7 aa, Artificial Sequence
  Synthetic construct
YRGHVLF

SEQ ID NO: 19053 - protein, 7 aa, Artificial Sequence
  Synthetic construct
YRGHVLY

SEQ ID NO: 19054 - protein, 7 aa, Artificial Sequence
  Synthetic construct
YRGHVAF

SEQ ID NO: 19055 - protein, 7 aa, Artificial Sequence
  Synthetic construct
YRGHVAY

SEQ ID NO: 19056 - protein, 7 aa, Artificial Sequence
  Synthetic construct
YRGHVQF

SEQ ID NO: 19057 - protein, 7 aa, Artificial Sequence
  Synthetic construct
YRGHVQY

SEQ ID NO: 19058 - protein, 7 aa, Artificial Sequence
  Synthetic construct
YRGHVDF

SEQ ID NO: 19059 - protein, 7 aa, Artificial Sequence
  Synthetic construct
YRGHVDY

SEQ ID NO: 19060 - protein, 7 aa, Artificial Sequence
  Synthetic construct
YRGHVVF

SEQ ID NO: 19061 - protein, 7 aa, Artificial Sequence
  Synthetic construct
YRGHVVY

SEQ ID NO: 19062 - protein, 7 aa, Artificial Sequence
  Synthetic construct
YRGHTFF

SEQ ID NO: 19063 - protein, 7 aa, Artificial Sequence
  Synthetic construct
YRGHTFY

SEQ ID NO: 19064 - protein, 7 aa, Artificial Sequence
  Synthetic construct
YRGHTRF

SEQ ID NO: 19065 - protein, 7 aa, Artificial Sequence
  Synthetic construct
YRGHTRY

SEQ ID NO: 19066 - protein, 7 aa, Artificial Sequence
  Synthetic construct
YRGHTCF

SEQ ID NO: 19067 - protein, 7 aa, Artificial Sequence
  Synthetic construct
YRGHTCY

SEQ ID NO: 19068 - protein, 7 aa, Artificial Sequence
  Synthetic construct
YRGHTLF

SEQ ID NO: 19069 - protein, 7 aa, Artificial Sequence
  Synthetic construct
YRGHTLY

SEQ ID NO: 19070 - protein, 7 aa, Artificial Sequence
  Synthetic construct
YRGHTAF

SEQ ID NO: 19071 - protein, 7 aa, Artificial Sequence
  Synthetic construct
YRGHTAY

SEQ ID NO: 19072 - protein, 7 aa, Artificial Sequence
  Synthetic construct
YRGHTQF

SEQ ID NO: 19073 - protein, 7 aa, Artificial Sequence
  Synthetic construct
YRGHTQY

SEQ ID NO: 19074 - protein, 7 aa, Artificial Sequence
  Synthetic construct
YRGHTDF

SEQ ID NO: 19075 - protein, 7 aa, Artificial Sequence
  Synthetic construct
YRGHTDY

SEQ ID NO: 19076 - protein, 7 aa, Artificial Sequence
  Synthetic construct
YRGHTVF

SEQ ID NO: 19077 - protein, 7 aa, Artificial Sequence
  Synthetic construct
YRGHTVY

SEQ ID NO: 19078 - protein, 7 aa, Artificial Sequence
  Synthetic construct
YRGHGFF

SEQ ID NO: 19079 - protein, 7 aa, Artificial Sequence
  Synthetic construct
YRGHGFY

SEQ ID NO: 19080 - protein, 7 aa, Artificial Sequence
  Synthetic construct
YRGHGRF

SEQ ID NO: 19081 - protein, 7 aa, Artificial Sequence
  Synthetic construct
YRGHGRY

SEQ ID NO: 19082 - protein, 7 aa, Artificial Sequence
  Synthetic construct
YRGHGCF

SEQ ID NO: 19083 - protein, 7 aa, Artificial Sequence
  Synthetic construct
YRGHGCY

SEQ ID NO: 19084 - protein, 7 aa, Artificial Sequence
  Synthetic construct
YRGHGLF

SEQ ID NO: 19085 - protein, 7 aa, Artificial Sequence
  Synthetic construct
YRGHGLY

SEQ ID NO: 19086 - protein, 7 aa, Artificial Sequence
  Synthetic construct
YRGHGAF

SEQ ID NO: 19087 - protein, 7 aa, Artificial Sequence
  Synthetic construct
YRGHGAY

SEQ ID NO: 19088 - protein, 7 aa, Artificial Sequence
  Synthetic construct
YRGHGQF

SEQ ID NO: 19089 - protein, 7 aa, Artificial Sequence
  Synthetic construct
YRGHGQY

SEQ ID NO: 19090 - protein, 7 aa, Artificial Sequence
  Synthetic construct
YRGHGDF

SEQ ID NO: 19091 - protein, 7 aa, Artificial Sequence
  Synthetic construct
YRGHGDY

SEQ ID NO: 19092 - protein, 7 aa, Artificial Sequence
  Synthetic construct
YRGHGVF

SEQ ID NO: 19093 - protein, 7 aa, Artificial Sequence
  Synthetic construct
YRGHGVY

SEQ ID NO: 19094 - protein, 7 aa, Artificial Sequence
  Synthetic construct
YRGHAFF

SEQ ID NO: 19095 - protein, 7 aa, Artificial Sequence
  Synthetic construct
YRGHAFY

SEQ ID NO: 19096 - protein, 7 aa, Artificial Sequence
  Synthetic construct
YRGHARF

SEQ ID NO: 19097 - protein, 7 aa, Artificial Sequence
  Synthetic construct
YRGHARY

SEQ ID NO: 19098 - protein, 7 aa, Artificial Sequence
  Synthetic construct
YRGHACF

SEQ ID NO: 19099 - protein, 7 aa, Artificial Sequence
  Synthetic construct
YRGHACY

SEQ ID NO: 19100 - protein, 7 aa, Artificial Sequence
  Synthetic construct
YRGHALF

SEQ ID NO: 19101 - protein, 7 aa, Artificial Sequence
  Synthetic construct
YRGHALY

SEQ ID NO: 19102 - protein, 7 aa, Artificial Sequence
  Synthetic construct
YRGHAAF

SEQ ID NO: 19103 - protein, 7 aa, Artificial Sequence
  Synthetic construct
YRGHAAY

SEQ ID NO: 19104 - protein, 7 aa, Artificial Sequence
  Synthetic construct
YRGHAQF

SEQ ID NO: 19105 - protein, 7 aa, Artificial Sequence
  Synthetic construct
YRGHAQY

SEQ ID NO: 19106 - protein, 7 aa, Artificial Sequence
  Synthetic construct
YRGHADF

SEQ ID NO: 19107 - protein, 7 aa, Artificial Sequence
  Synthetic construct
YRGHADY

SEQ ID NO: 19108 - protein, 7 aa, Artificial Sequence
  Synthetic construct
YRGHAVF

SEQ ID NO: 19109 - protein, 7 aa, Artificial Sequence
  Synthetic construct
YRGHAVY

SEQ ID NO: 19110 - protein, 7 aa, Artificial Sequence
  Synthetic construct
YRGHQFF

SEQ ID NO: 19111 - protein, 7 aa, Artificial Sequence
  Synthetic construct
YRGHQFY

SEQ ID NO: 19112 - protein, 7 aa, Artificial Sequence
  Synthetic construct
YRGHQRF

SEQ ID NO: 19113 - protein, 7 aa, Artificial Sequence
  Synthetic construct
YRGHQRY

SEQ ID NO: 19114 - protein, 7 aa, Artificial Sequence
  Synthetic construct
YRGHQCF

SEQ ID NO: 19115 - protein, 7 aa, Artificial Sequence
  Synthetic construct
YRGHQCY

SEQ ID NO: 19116 - protein, 7 aa, Artificial Sequence
  Synthetic construct
YRGHQLF

SEQ ID NO: 19117 - protein, 7 aa, Artificial Sequence
  Synthetic construct
YRGHQLY

SEQ ID NO: 19118 - protein, 7 aa, Artificial Sequence
  Synthetic construct
YRGHQAF

SEQ ID NO: 19119 - protein, 7 aa, Artificial Sequence
  Synthetic construct
YRGHQAY

SEQ ID NO: 19120 - protein, 7 aa, Artificial Sequence
  Synthetic construct
YRGHQQF

SEQ ID NO: 19121 - protein, 7 aa, Artificial Sequence
  Synthetic construct
YRGHQQY

SEQ ID NO: 19122 - protein, 7 aa, Artificial Sequence
  Synthetic construct
YRGHQDF

SEQ ID NO: 19123 - protein, 7 aa, Artificial Sequence
  Synthetic construct
YRGHQDY

SEQ ID NO: 19124 - protein, 7 aa, Artificial Sequence
  Synthetic construct
YRGHQVF

SEQ ID NO: 19125 - protein, 7 aa, Artificial Sequence
  Synthetic construct
YRGHQVY

SEQ ID NO: 19126 - protein, 7 aa, Artificial Sequence
  Synthetic construct
YRGLIFF

SEQ ID NO: 19127 - protein, 7 aa, Artificial Sequence
  Synthetic construct
YRGLIFY

SEQ ID NO: 19128 - protein, 7 aa, Artificial Sequence
  Synthetic construct
YRGLIRF

SEQ ID NO: 19129 - protein, 7 aa, Artificial Sequence
  Synthetic construct
YRGLIRY

SEQ ID NO: 19130 - protein, 7 aa, Artificial Sequence
  Synthetic construct
YRGLICF

SEQ ID NO: 19131 - protein, 7 aa, Artificial Sequence
  Synthetic construct
YRGLICY

SEQ ID NO: 19132 - protein, 7 aa, Artificial Sequence
  Synthetic construct
YRGLILF

SEQ ID NO: 19133 - protein, 7 aa, Artificial Sequence
  Synthetic construct
YRGLILY

SEQ ID NO: 19134 - protein, 7 aa, Artificial Sequence
  Synthetic construct
YRGLIAF

SEQ ID NO: 19135 - protein, 7 aa, Artificial Sequence
  Synthetic construct
YRGLIAY

SEQ ID NO: 19136 - protein, 7 aa, Artificial Sequence
  Synthetic construct
YRGLIQF

SEQ ID NO: 19137 - protein, 7 aa, Artificial Sequence
  Synthetic construct
YRGLIQY

SEQ ID NO: 19138 - protein, 7 aa, Artificial Sequence
  Synthetic construct
YRGLIDF

SEQ ID NO: 19139 - protein, 7 aa, Artificial Sequence
  Synthetic construct
YRGLIDY

SEQ ID NO: 19140 - protein, 7 aa, Artificial Sequence
  Synthetic construct
YRGLIVF

SEQ ID NO: 19141 - protein, 7 aa, Artificial Sequence
  Synthetic construct
YRGLIVY

SEQ ID NO: 19142 - protein, 7 aa, Artificial Sequence
  Synthetic construct
YRGLDFF

SEQ ID NO: 19143 - protein, 7 aa, Artificial Sequence
  Synthetic construct
YRGLDFY

SEQ ID NO: 19144 - protein, 7 aa, Artificial Sequence
  Synthetic construct
YRGLDRF

SEQ ID NO: 19145 - protein, 7 aa, Artificial Sequence
  Synthetic construct
YRGLDRY

SEQ ID NO: 19146 - protein, 7 aa, Artificial Sequence
  Synthetic construct
YRGLDCF

SEQ ID NO: 19147 - protein, 7 aa, Artificial Sequence
  Synthetic construct
YRGLDCY

SEQ ID NO: 19148 - protein, 7 aa, Artificial Sequence
  Synthetic construct
YRGLDLF

SEQ ID NO: 19149 - protein, 7 aa, Artificial Sequence
  Synthetic construct
YRGLDLY

SEQ ID NO: 19150 - protein, 7 aa, Artificial Sequence
  Synthetic construct
YRGLDAF

SEQ ID NO: 19151 - protein, 7 aa, Artificial Sequence
  Synthetic construct
YRGLDAY

SEQ ID NO: 19152 - protein, 7 aa, Artificial Sequence
  Synthetic construct
YRGLDQF

SEQ ID NO: 19153 - protein, 7 aa, Artificial Sequence
  Synthetic construct
YRGLDQY

SEQ ID NO: 19154 - protein, 7 aa, Artificial Sequence
  Synthetic construct
YRGLDDF

SEQ ID NO: 19155 - protein, 7 aa, Artificial Sequence
  Synthetic construct
YRGLDDY

SEQ ID NO: 19156 - protein, 7 aa, Artificial Sequence
  Synthetic construct
YRGLDVF

SEQ ID NO: 19157 - protein, 7 aa, Artificial Sequence
  Synthetic construct
YRGLDVY

SEQ ID NO: 19158 - protein, 7 aa, Artificial Sequence
  Synthetic construct
YRGLYFF

SEQ ID NO: 19159 - protein, 7 aa, Artificial Sequence
  Synthetic construct
YRGLYFY

SEQ ID NO: 19160 - protein, 7 aa, Artificial Sequence
  Synthetic construct
YRGLYRF

SEQ ID NO: 19161 - protein, 7 aa, Artificial Sequence
  Synthetic construct
YRGLYRY

SEQ ID NO: 19162 - protein, 7 aa, Artificial Sequence
  Synthetic construct
YRGLYCF

SEQ ID NO: 19163 - protein, 7 aa, Artificial Sequence
  Synthetic construct
YRGLYCY

SEQ ID NO: 19164 - protein, 7 aa, Artificial Sequence
  Synthetic construct
YRGLYLF

SEQ ID NO: 19165 - protein, 7 aa, Artificial Sequence
  Synthetic construct
YRGLYLY

SEQ ID NO: 19166 - protein, 7 aa, Artificial Sequence
  Synthetic construct
YRGLYAF

SEQ ID NO: 19167 - protein, 7 aa, Artificial Sequence
  Synthetic construct
YRGLYAY

SEQ ID NO: 19168 - protein, 7 aa, Artificial Sequence
  Synthetic construct
YRGLYQF

SEQ ID NO: 19169 - protein, 7 aa, Artificial Sequence
  Synthetic construct
YRGLYQY

SEQ ID NO: 19170 - protein, 7 aa, Artificial Sequence
  Synthetic construct
YRGLYDF

SEQ ID NO: 19171 - protein, 7 aa, Artificial Sequence
  Synthetic construct
YRGLYDY

SEQ ID NO: 19172 - protein, 7 aa, Artificial Sequence
  Synthetic construct
YRGLYVF

SEQ ID NO: 19173 - protein, 7 aa, Artificial Sequence
  Synthetic construct
YRGLYVY

SEQ ID NO: 19174 - protein, 7 aa, Artificial Sequence
  Synthetic construct
YRGLFFF

SEQ ID NO: 19175 - protein, 7 aa, Artificial Sequence
  Synthetic construct
YRGLFFY

SEQ ID NO: 19176 - protein, 7 aa, Artificial Sequence
  Synthetic construct
YRGLFRF

SEQ ID NO: 19177 - protein, 7 aa, Artificial Sequence
  Synthetic construct
YRGLFRY

SEQ ID NO: 19178 - protein, 7 aa, Artificial Sequence
  Synthetic construct
YRGLFCF

SEQ ID NO: 19179 - protein, 7 aa, Artificial Sequence
  Synthetic construct
YRGLFCY

SEQ ID NO: 19180 - protein, 7 aa, Artificial Sequence
  Synthetic construct
YRGLFLF

SEQ ID NO: 19181 - protein, 7 aa, Artificial Sequence
  Synthetic construct
YRGLFLY

SEQ ID NO: 19182 - protein, 7 aa, Artificial Sequence
  Synthetic construct
YRGLFAF

SEQ ID NO: 19183 - protein, 7 aa, Artificial Sequence
  Synthetic construct
YRGLFAY

SEQ ID NO: 19184 - protein, 7 aa, Artificial Sequence
  Synthetic construct
YRGLFQF

SEQ ID NO: 19185 - protein, 7 aa, Artificial Sequence
  Synthetic construct
YRGLFQY

SEQ ID NO: 19186 - protein, 7 aa, Artificial Sequence
  Synthetic construct
YRGLFDF

SEQ ID NO: 19187 - protein, 7 aa, Artificial Sequence
  Synthetic construct
YRGLFDY

SEQ ID NO: 19188 - protein, 7 aa, Artificial Sequence
  Synthetic construct
YRGLFVF

SEQ ID NO: 19189 - protein, 7 aa, Artificial Sequence
  Synthetic construct
YRGLFVY

SEQ ID NO: 19190 - protein, 7 aa, Artificial Sequence
  Synthetic construct
YRGLVFF

SEQ ID NO: 19191 - protein, 7 aa, Artificial Sequence
  Synthetic construct
YRGLVFY

SEQ ID NO: 19192 - protein, 7 aa, Artificial Sequence
  Synthetic construct
YRGLVRF

SEQ ID NO: 19193 - protein, 7 aa, Artificial Sequence
  Synthetic construct
YRGLVRY

SEQ ID NO: 19194 - protein, 7 aa, Artificial Sequence
  Synthetic construct
YRGLVCF

SEQ ID NO: 19195 - protein, 7 aa, Artificial Sequence
  Synthetic construct
YRGLVCY

SEQ ID NO: 19196 - protein, 7 aa, Artificial Sequence
  Synthetic construct
YRGLVLF

SEQ ID NO: 19197 - protein, 7 aa, Artificial Sequence
  Synthetic construct
YRGLVLY

SEQ ID NO: 19198 - protein, 7 aa, Artificial Sequence
  Synthetic construct
YRGLVAF

SEQ ID NO: 19199 - protein, 7 aa, Artificial Sequence
  Synthetic construct
YRGLVAY

SEQ ID NO: 19200 - protein, 7 aa, Artificial Sequence
  Synthetic construct
YRGLVQF

SEQ ID NO: 19201 - protein, 7 aa, Artificial Sequence
  Synthetic construct
YRGLVQY

SEQ ID NO: 19202 - protein, 7 aa, Artificial Sequence
  Synthetic construct
YRGLVDF

SEQ ID NO: 19203 - protein, 7 aa, Artificial Sequence
  Synthetic construct
YRGLVDY

SEQ ID NO: 19204 - protein, 7 aa, Artificial Sequence
  Synthetic construct
YRGLVVF

SEQ ID NO: 19205 - protein, 7 aa, Artificial Sequence
  Synthetic construct
YRGLVVY

SEQ ID NO: 19206 - protein, 7 aa, Artificial Sequence
  Synthetic construct
YRGLTFF

SEQ ID NO: 19207 - protein, 7 aa, Artificial Sequence
  Synthetic construct
YRGLTFY

SEQ ID NO: 19208 - protein, 7 aa, Artificial Sequence
  Synthetic construct
YRGLTRF

SEQ ID NO: 19209 - protein, 7 aa, Artificial Sequence
  Synthetic construct
YRGLTRY

SEQ ID NO: 19210 - protein, 7 aa, Artificial Sequence
  Synthetic construct
YRGLTCF

SEQ ID NO: 19211 - protein, 7 aa, Artificial Sequence
  Synthetic construct
YRGLTCY

SEQ ID NO: 19212 - protein, 7 aa, Artificial Sequence
  Synthetic construct
YRGLTLF

SEQ ID NO: 19213 - protein, 7 aa, Artificial Sequence
  Synthetic construct
YRGLTLY

SEQ ID NO: 19214 - protein, 7 aa, Artificial Sequence
  Synthetic construct
YRGLTAF

SEQ ID NO: 19215 - protein, 7 aa, Artificial Sequence
  Synthetic construct
YRGLTAY

SEQ ID NO: 19216 - protein, 7 aa, Artificial Sequence
  Synthetic construct
YRGLTQF

SEQ ID NO: 19217 - protein, 7 aa, Artificial Sequence
  Synthetic construct
YRGLTQY

SEQ ID NO: 19218 - protein, 7 aa, Artificial Sequence
  Synthetic construct
YRGLTDF

SEQ ID NO: 19219 - protein, 7 aa, Artificial Sequence
  Synthetic construct
YRGLTDY

SEQ ID NO: 19220 - protein, 7 aa, Artificial Sequence
  Synthetic construct
YRGLTVF

SEQ ID NO: 19221 - protein, 7 aa, Artificial Sequence
  Synthetic construct
YRGLTVY

SEQ ID NO: 19222 - protein, 7 aa, Artificial Sequence
  Synthetic construct
YRGLGFF

SEQ ID NO: 19223 - protein, 7 aa, Artificial Sequence
  Synthetic construct
YRGLGFY

SEQ ID NO: 19224 - protein, 7 aa, Artificial Sequence
  Synthetic construct
YRGLGRF

SEQ ID NO: 19225 - protein, 7 aa, Artificial Sequence
  Synthetic construct
YRGLGRY

SEQ ID NO: 19226 - protein, 7 aa, Artificial Sequence
  Synthetic construct
YRGLGCF

SEQ ID NO: 19227 - protein, 7 aa, Artificial Sequence
  Synthetic construct
YRGLGCY

SEQ ID NO: 19228 - protein, 7 aa, Artificial Sequence
  Synthetic construct
YRGLGLF

SEQ ID NO: 19229 - protein, 7 aa, Artificial Sequence
  Synthetic construct
YRGLGLY

SEQ ID NO: 19230 - protein, 7 aa, Artificial Sequence
  Synthetic construct
YRGLGAF

SEQ ID NO: 19231 - protein, 7 aa, Artificial Sequence
  Synthetic construct
YRGLGAY

SEQ ID NO: 19232 - protein, 7 aa, Artificial Sequence
  Synthetic construct
YRGLGQF

SEQ ID NO: 19233 - protein, 7 aa, Artificial Sequence
  Synthetic construct
YRGLGQY

SEQ ID NO: 19234 - protein, 7 aa, Artificial Sequence
  Synthetic construct
YRGLGDF

SEQ ID NO: 19235 - protein, 7 aa, Artificial Sequence
  Synthetic construct
YRGLGDY

SEQ ID NO: 19236 - protein, 7 aa, Artificial Sequence
  Synthetic construct
YRGLGVF

SEQ ID NO: 19237 - protein, 7 aa, Artificial Sequence
  Synthetic construct
YRGLGVY

SEQ ID NO: 19238 - protein, 7 aa, Artificial Sequence
  Synthetic construct
YRGLAFF

SEQ ID NO: 19239 - protein, 7 aa, Artificial Sequence
  Synthetic construct
YRGLAFY

SEQ ID NO: 19240 - protein, 7 aa, Artificial Sequence
  Synthetic construct
YRGLARF

SEQ ID NO: 19241 - protein, 7 aa, Artificial Sequence
  Synthetic construct
YRGLARY

SEQ ID NO: 19242 - protein, 7 aa, Artificial Sequence
  Synthetic construct
YRGLACF

SEQ ID NO: 19243 - protein, 7 aa, Artificial Sequence
  Synthetic construct
YRGLACY

SEQ ID NO: 19244 - protein, 7 aa, Artificial Sequence
  Synthetic construct
YRGLALF

SEQ ID NO: 19245 - protein, 7 aa, Artificial Sequence
  Synthetic construct
YRGLALY

SEQ ID NO: 19246 - protein, 7 aa, Artificial Sequence
  Synthetic construct
YRGLAAF

SEQ ID NO: 19247 - protein, 7 aa, Artificial Sequence
  Synthetic construct
YRGLAAY

SEQ ID NO: 19248 - protein, 7 aa, Artificial Sequence
  Synthetic construct
YRGLAQF

SEQ ID NO: 19249 - protein, 7 aa, Artificial Sequence
  Synthetic construct
YRGLAQY

SEQ ID NO: 19250 - protein, 7 aa, Artificial Sequence
  Synthetic construct
YRGLADF

SEQ ID NO: 19251 - protein, 7 aa, Artificial Sequence
  Synthetic construct
YRGLADY

SEQ ID NO: 19252 - protein, 7 aa, Artificial Sequence
  Synthetic construct
YRGLAVF

SEQ ID NO: 19253 - protein, 7 aa, Artificial Sequence
  Synthetic construct
YRGLAVY

SEQ ID NO: 19254 - protein, 7 aa, Artificial Sequence
  Synthetic construct
YRGLQFF

SEQ ID NO: 19255 - protein, 7 aa, Artificial Sequence
  Synthetic construct
YRGLQFY

SEQ ID NO: 19256 - protein, 7 aa, Artificial Sequence
  Synthetic construct
YRGLQRF

SEQ ID NO: 19257 - protein, 7 aa, Artificial Sequence
  Synthetic construct
YRGLQRY

SEQ ID NO: 19258 - protein, 7 aa, Artificial Sequence
  Synthetic construct
YRGLQCF

SEQ ID NO: 19259 - protein, 7 aa, Artificial Sequence
  Synthetic construct
YRGLQCY

SEQ ID NO: 19260 - protein, 7 aa, Artificial Sequence
  Synthetic construct
YRGLQLF

SEQ ID NO: 19261 - protein, 7 aa, Artificial Sequence
  Synthetic construct
YRGLQLY

SEQ ID NO: 19262 - protein, 7 aa, Artificial Sequence
  Synthetic construct
YRGLQAF

SEQ ID NO: 19263 - protein, 7 aa, Artificial Sequence
  Synthetic construct
YRGLQAY

SEQ ID NO: 19264 - protein, 7 aa, Artificial Sequence
  Synthetic construct
YRGLQQF

SEQ ID NO: 19265 - protein, 7 aa, Artificial Sequence
  Synthetic construct
YRGLQQY

SEQ ID NO: 19266 - protein, 7 aa, Artificial Sequence
  Synthetic construct
YRGLQDF

SEQ ID NO: 19267 - protein, 7 aa, Artificial Sequence
  Synthetic construct
YRGLQDY

SEQ ID NO: 19268 - protein, 7 aa, Artificial Sequence
  Synthetic construct
YRGLQVF

SEQ ID NO: 19269 - protein, 7 aa, Artificial Sequence
  Synthetic construct
YRGLQVY

SEQ ID NO: 19270 - protein, 7 aa, Artificial Sequence
  Synthetic construct
YRGFIFF

SEQ ID NO: 19271 - protein, 7 aa, Artificial Sequence
  Synthetic construct
YRGFIFY

SEQ ID NO: 19272 - protein, 7 aa, Artificial Sequence
  Synthetic construct
YRGFIRF

SEQ ID NO: 19273 - protein, 7 aa, Artificial Sequence
  Synthetic construct
YRGFIRY

SEQ ID NO: 19274 - protein, 7 aa, Artificial Sequence
  Synthetic construct
YRGFICF

SEQ ID NO: 19275 - protein, 7 aa, Artificial Sequence
  Synthetic construct
YRGFICY

SEQ ID NO: 19276 - protein, 7 aa, Artificial Sequence
  Synthetic construct
YRGFILF

SEQ ID NO: 19277 - protein, 7 aa, Artificial Sequence
  Synthetic construct
YRGFILY

SEQ ID NO: 19278 - protein, 7 aa, Artificial Sequence
  Synthetic construct
YRGFIAF

SEQ ID NO: 19279 - protein, 7 aa, Artificial Sequence
  Synthetic construct
YRGFIAY

SEQ ID NO: 19280 - protein, 7 aa, Artificial Sequence
  Synthetic construct
YRGFIQF

SEQ ID NO: 19281 - protein, 7 aa, Artificial Sequence
  Synthetic construct
YRGFIQY

SEQ ID NO: 19282 - protein, 7 aa, Artificial Sequence
  Synthetic construct
YRGFIDF

SEQ ID NO: 19283 - protein, 7 aa, Artificial Sequence
  Synthetic construct
YRGFIDY

SEQ ID NO: 19284 - protein, 7 aa, Artificial Sequence
  Synthetic construct
YRGFIVF

SEQ ID NO: 19285 - protein, 7 aa, Artificial Sequence
  Synthetic construct
YRGFIVY

SEQ ID NO: 19286 - protein, 7 aa, Artificial Sequence
  Synthetic construct
YRGFDFF

SEQ ID NO: 19287 - protein, 7 aa, Artificial Sequence
  Synthetic construct
YRGFDFY

SEQ ID NO: 19288 - protein, 7 aa, Artificial Sequence
  Synthetic construct
YRGFDRF

SEQ ID NO: 19289 - protein, 7 aa, Artificial Sequence
  Synthetic construct
YRGFDRY

SEQ ID NO: 19290 - protein, 7 aa, Artificial Sequence
  Synthetic construct
YRGFDCF

SEQ ID NO: 19291 - protein, 7 aa, Artificial Sequence
  Synthetic construct
YRGFDCY

SEQ ID NO: 19292 - protein, 7 aa, Artificial Sequence
  Synthetic construct
YRGFDLF

SEQ ID NO: 19293 - protein, 7 aa, Artificial Sequence
  Synthetic construct
YRGFDLY

SEQ ID NO: 19294 - protein, 7 aa, Artificial Sequence
  Synthetic construct
YRGFDAF

SEQ ID NO: 19295 - protein, 7 aa, Artificial Sequence
  Synthetic construct
YRGFDAY

SEQ ID NO: 19296 - protein, 7 aa, Artificial Sequence
  Synthetic construct
YRGFDQF

SEQ ID NO: 19297 - protein, 7 aa, Artificial Sequence
  Synthetic construct
YRGFDQY

SEQ ID NO: 19298 - protein, 7 aa, Artificial Sequence
  Synthetic construct
YRGFDDF

SEQ ID NO: 19299 - protein, 7 aa, Artificial Sequence
  Synthetic construct
YRGFDDY

SEQ ID NO: 19300 - protein, 7 aa, Artificial Sequence
  Synthetic construct
YRGFDVF

SEQ ID NO: 19301 - protein, 7 aa, Artificial Sequence
  Synthetic construct
YRGFDVY

SEQ ID NO: 19302 - protein, 7 aa, Artificial Sequence
  Synthetic construct
YRGFYFF

SEQ ID NO: 19303 - protein, 7 aa, Artificial Sequence
  Synthetic construct
YRGFYFY

SEQ ID NO: 19304 - protein, 7 aa, Artificial Sequence
  Synthetic construct
YRGFYRF

SEQ ID NO: 19305 - protein, 7 aa, Artificial Sequence
  Synthetic construct
YRGFYRY

SEQ ID NO: 19306 - protein, 7 aa, Artificial Sequence
  Synthetic construct
YRGFYCF

SEQ ID NO: 19307 - protein, 7 aa, Artificial Sequence
  Synthetic construct
YRGFYCY

SEQ ID NO: 19308 - protein, 7 aa, Artificial Sequence
  Synthetic construct
YRGFYLF

SEQ ID NO: 19309 - protein, 7 aa, Artificial Sequence
  Synthetic construct
YRGFYLY

SEQ ID NO: 19310 - protein, 7 aa, Artificial Sequence
  Synthetic construct
YRGFYAF

SEQ ID NO: 19311 - protein, 7 aa, Artificial Sequence
  Synthetic construct
YRGFYAY

SEQ ID NO: 19312 - protein, 7 aa, Artificial Sequence
  Synthetic construct
YRGFYQF

SEQ ID NO: 19313 - protein, 7 aa, Artificial Sequence
  Synthetic construct
YRGFYQY

SEQ ID NO: 19314 - protein, 7 aa, Artificial Sequence
  Synthetic construct
YRGFYDF

SEQ ID NO: 19315 - protein, 7 aa, Artificial Sequence
  Synthetic construct
YRGFYDY

SEQ ID NO: 19316 - protein, 7 aa, Artificial Sequence
  Synthetic construct
YRGFYVF

SEQ ID NO: 19317 - protein, 7 aa, Artificial Sequence
  Synthetic construct
YRGFYVY

SEQ ID NO: 19318 - protein, 7 aa, Artificial Sequence
  Synthetic construct
YRGFFFF

SEQ ID NO: 19319 - protein, 7 aa, Artificial Sequence
  Synthetic construct
YRGFFFY

SEQ ID NO: 19320 - protein, 7 aa, Artificial Sequence
  Synthetic construct
YRGFFRF

SEQ ID NO: 19321 - protein, 7 aa, Artificial Sequence
  Synthetic construct
YRGFFRY

SEQ ID NO: 19322 - protein, 7 aa, Artificial Sequence
  Synthetic construct
YRGFFCF

SEQ ID NO: 19323 - protein, 7 aa, Artificial Sequence
  Synthetic construct
YRGFFCY

SEQ ID NO: 19324 - protein, 7 aa, Artificial Sequence
  Synthetic construct
YRGFFLF

SEQ ID NO: 19325 - protein, 7 aa, Artificial Sequence
  Synthetic construct
YRGFFLY

SEQ ID NO: 19326 - protein, 7 aa, Artificial Sequence
  Synthetic construct
YRGFFAF

SEQ ID NO: 19327 - protein, 7 aa, Artificial Sequence
  Synthetic construct
YRGFFAY

SEQ ID NO: 19328 - protein, 7 aa, Artificial Sequence
  Synthetic construct
YRGFFQF

SEQ ID NO: 19329 - protein, 7 aa, Artificial Sequence
  Synthetic construct
YRGFFQY

SEQ ID NO: 19330 - protein, 7 aa, Artificial Sequence
  Synthetic construct
YRGFFDF

SEQ ID NO: 19331 - protein, 7 aa, Artificial Sequence
  Synthetic construct
YRGFFDY

SEQ ID NO: 19332 - protein, 7 aa, Artificial Sequence
  Synthetic construct
YRGFFVF

SEQ ID NO: 19333 - protein, 7 aa, Artificial Sequence
  Synthetic construct
YRGFFVY

SEQ ID NO: 19334 - protein, 7 aa, Artificial Sequence
  Synthetic construct
YRGFVFF

SEQ ID NO: 19335 - protein, 7 aa, Artificial Sequence
  Synthetic construct
YRGFVFY

SEQ ID NO: 19336 - protein, 7 aa, Artificial Sequence
  Synthetic construct
YRGFVRF

SEQ ID NO: 19337 - protein, 7 aa, Artificial Sequence
  Synthetic construct
YRGFVRY

SEQ ID NO: 19338 - protein, 7 aa, Artificial Sequence
  Synthetic construct
YRGFVCF

SEQ ID NO: 19339 - protein, 7 aa, Artificial Sequence
  Synthetic construct
YRGFVCY

SEQ ID NO: 19340 - protein, 7 aa, Artificial Sequence
  Synthetic construct
YRGFVLF

SEQ ID NO: 19341 - protein, 7 aa, Artificial Sequence
  Synthetic construct
YRGFVLY

SEQ ID NO: 19342 - protein, 7 aa, Artificial Sequence
  Synthetic construct
YRGFVAF

SEQ ID NO: 19343 - protein, 7 aa, Artificial Sequence
  Synthetic construct
YRGFVAY

SEQ ID NO: 19344 - protein, 7 aa, Artificial Sequence
  Synthetic construct
YRGFVQF

SEQ ID NO: 19345 - protein, 7 aa, Artificial Sequence
  Synthetic construct
YRGFVQY

SEQ ID NO: 19346 - protein, 7 aa, Artificial Sequence
  Synthetic construct
YRGFVDF

SEQ ID NO: 19347 - protein, 7 aa, Artificial Sequence
  Synthetic construct
YRGFVDY

SEQ ID NO: 19348 - protein, 7 aa, Artificial Sequence
  Synthetic construct
YRGFVVF

SEQ ID NO: 19349 - protein, 7 aa, Artificial Sequence
  Synthetic construct
YRGFVVY

SEQ ID NO: 19350 - protein, 7 aa, Artificial Sequence
  Synthetic construct
YRGFTFF

SEQ ID NO: 19351 - protein, 7 aa, Artificial Sequence
  Synthetic construct
YRGFTFY

SEQ ID NO: 19352 - protein, 7 aa, Artificial Sequence
  Synthetic construct
YRGFTRF

SEQ ID NO: 19353 - protein, 7 aa, Artificial Sequence
  Synthetic construct
YRGFTRY

SEQ ID NO: 19354 - protein, 7 aa, Artificial Sequence
  Synthetic construct
YRGFTCF

SEQ ID NO: 19355 - protein, 7 aa, Artificial Sequence
  Synthetic construct
YRGFTCY

SEQ ID NO: 19356 - protein, 7 aa, Artificial Sequence
  Synthetic construct
YRGFTLF

SEQ ID NO: 19357 - protein, 7 aa, Artificial Sequence
  Synthetic construct
YRGFTLY

SEQ ID NO: 19358 - protein, 7 aa, Artificial Sequence
  Synthetic construct
YRGFTAF

SEQ ID NO: 19359 - protein, 7 aa, Artificial Sequence
  Synthetic construct
YRGFTAY

SEQ ID NO: 19360 - protein, 7 aa, Artificial Sequence
  Synthetic construct
YRGFTQF

SEQ ID NO: 19361 - protein, 7 aa, Artificial Sequence
  Synthetic construct
YRGFTQY

SEQ ID NO: 19362 - protein, 7 aa, Artificial Sequence
  Synthetic construct
YRGFTDF

SEQ ID NO: 19363 - protein, 7 aa, Artificial Sequence
  Synthetic construct
YRGFTDY

SEQ ID NO: 19364 - protein, 7 aa, Artificial Sequence
  Synthetic construct
YRGFTVF

SEQ ID NO: 19365 - protein, 7 aa, Artificial Sequence
  Synthetic construct
YRGFTVY

SEQ ID NO: 19366 - protein, 7 aa, Artificial Sequence
  Synthetic construct
YRGFGFF

SEQ ID NO: 19367 - protein, 7 aa, Artificial Sequence
  Synthetic construct
YRGFGFY

SEQ ID NO: 19368 - protein, 7 aa, Artificial Sequence
  Synthetic construct
YRGFGRF

SEQ ID NO: 19369 - protein, 7 aa, Artificial Sequence
  Synthetic construct
YRGFGRY

SEQ ID NO: 19370 - protein, 7 aa, Artificial Sequence
  Synthetic construct
YRGFGCF

SEQ ID NO: 19371 - protein, 7 aa, Artificial Sequence
  Synthetic construct
YRGFGCY

SEQ ID NO: 19372 - protein, 7 aa, Artificial Sequence
  Synthetic construct
YRGFGLF

SEQ ID NO: 19373 - protein, 7 aa, Artificial Sequence
  Synthetic construct
YRGFGLY

SEQ ID NO: 19374 - protein, 7 aa, Artificial Sequence
  Synthetic construct
YRGFGAF

SEQ ID NO: 19375 - protein, 7 aa, Artificial Sequence
  Synthetic construct
YRGFGAY

SEQ ID NO: 19376 - protein, 7 aa, Artificial Sequence
  Synthetic construct
YRGFGQF

SEQ ID NO: 19377 - protein, 7 aa, Artificial Sequence
  Synthetic construct
YRGFGQY

SEQ ID NO: 19378 - protein, 7 aa, Artificial Sequence
  Synthetic construct
YRGFGDF

SEQ ID NO: 19379 - protein, 7 aa, Artificial Sequence
  Synthetic construct
YRGFGDY

SEQ ID NO: 19380 - protein, 7 aa, Artificial Sequence
  Synthetic construct
YRGFGVF

SEQ ID NO: 19381 - protein, 7 aa, Artificial Sequence
  Synthetic construct
YRGFGVY

SEQ ID NO: 19382 - protein, 7 aa, Artificial Sequence
  Synthetic construct
YRGFAFF

SEQ ID NO: 19383 - protein, 7 aa, Artificial Sequence
  Synthetic construct
YRGFAFY

SEQ ID NO: 19384 - protein, 7 aa, Artificial Sequence
  Synthetic construct
YRGFARF

SEQ ID NO: 19385 - protein, 7 aa, Artificial Sequence
  Synthetic construct
YRGFARY

SEQ ID NO: 19386 - protein, 7 aa, Artificial Sequence
  Synthetic construct
YRGFACF

SEQ ID NO: 19387 - protein, 7 aa, Artificial Sequence
  Synthetic construct
YRGFACY

SEQ ID NO: 19388 - protein, 7 aa, Artificial Sequence
  Synthetic construct
YRGFALF

SEQ ID NO: 19389 - protein, 7 aa, Artificial Sequence
  Synthetic construct
YRGFALY

SEQ ID NO: 19390 - protein, 7 aa, Artificial Sequence
  Synthetic construct
YRGFAAF

SEQ ID NO: 19391 - protein, 7 aa, Artificial Sequence
  Synthetic construct
YRGFAAY

SEQ ID NO: 19392 - protein, 7 aa, Artificial Sequence
  Synthetic construct
YRGFAQF

SEQ ID NO: 19393 - protein, 7 aa, Artificial Sequence
  Synthetic construct
YRGFAQY

SEQ ID NO: 19394 - protein, 7 aa, Artificial Sequence
  Synthetic construct
YRGFADF

SEQ ID NO: 19395 - protein, 7 aa, Artificial Sequence
  Synthetic construct
YRGFADY

SEQ ID NO: 19396 - protein, 7 aa, Artificial Sequence
  Synthetic construct
YRGFAVF

SEQ ID NO: 19397 - protein, 7 aa, Artificial Sequence
  Synthetic construct
YRGFAVY

SEQ ID NO: 19398 - protein, 7 aa, Artificial Sequence
  Synthetic construct
YRGFQFF

SEQ ID NO: 19399 - protein, 7 aa, Artificial Sequence
  Synthetic construct
YRGFQFY

SEQ ID NO: 19400 - protein, 7 aa, Artificial Sequence
  Synthetic construct
YRGFQRF

SEQ ID NO: 19401 - protein, 7 aa, Artificial Sequence
  Synthetic construct
YRGFQRY

SEQ ID NO: 19402 - protein, 7 aa, Artificial Sequence
  Synthetic construct
YRGFQCF

SEQ ID NO: 19403 - protein, 7 aa, Artificial Sequence
  Synthetic construct
YRGFQCY

SEQ ID NO: 19404 - protein, 7 aa, Artificial Sequence
  Synthetic construct
YRGFQLF

SEQ ID NO: 19405 - protein, 7 aa, Artificial Sequence
  Synthetic construct
YRGFQLY

SEQ ID NO: 19406 - protein, 7 aa, Artificial Sequence
  Synthetic construct
YRGFQAF

SEQ ID NO: 19407 - protein, 7 aa, Artificial Sequence
  Synthetic construct
YRGFQAY

SEQ ID NO: 19408 - protein, 7 aa, Artificial Sequence
  Synthetic construct
YRGFQQF

SEQ ID NO: 19409 - protein, 7 aa, Artificial Sequence
  Synthetic construct
YRGFQQY

SEQ ID NO: 19410 - protein, 7 aa, Artificial Sequence
  Synthetic construct
YRGFQDF

SEQ ID NO: 19411 - protein, 7 aa, Artificial Sequence
  Synthetic construct
YRGFQDY

SEQ ID NO: 19412 - protein, 7 aa, Artificial Sequence
  Synthetic construct
YRGFQVF

SEQ ID NO: 19413 - protein, 7 aa, Artificial Sequence
  Synthetic construct
YRGFQVY

SEQ ID NO: 19414 - protein, 7 aa, Artificial Sequence
  Synthetic construct
YMIYIFF

SEQ ID NO: 19415 - protein, 7 aa, Artificial Sequence
  Synthetic construct
YMIYIFY

SEQ ID NO: 19416 - protein, 7 aa, Artificial Sequence
  Synthetic construct
YMIYIRF

SEQ ID NO: 19417 - protein, 7 aa, Artificial Sequence
  Synthetic construct
YMIYIRY

SEQ ID NO: 19418 - protein, 7 aa, Artificial Sequence
  Synthetic construct
YMIYICF

SEQ ID NO: 19419 - protein, 7 aa, Artificial Sequence
  Synthetic construct
YMIYICY

SEQ ID NO: 19420 - protein, 7 aa, Artificial Sequence
  Synthetic construct
YMIYILF

SEQ ID NO: 19421 - protein, 7 aa, Artificial Sequence
  Synthetic construct
YMIYILY

SEQ ID NO: 19422 - protein, 7 aa, Artificial Sequence
  Synthetic construct
YMIYIAF

SEQ ID NO: 19423 - protein, 7 aa, Artificial Sequence
  Synthetic construct
YMIYIAY

SEQ ID NO: 19424 - protein, 7 aa, Artificial Sequence
  Synthetic construct
YMIYIQF

SEQ ID NO: 19425 - protein, 7 aa, Artificial Sequence
  Synthetic construct
YMIYIQY

SEQ ID NO: 19426 - protein, 7 aa, Artificial Sequence
  Synthetic construct
YMIYIDF

SEQ ID NO: 19427 - protein, 7 aa, Artificial Sequence
  Synthetic construct
YMIYIDY

SEQ ID NO: 19428 - protein, 7 aa, Artificial Sequence
  Synthetic construct
YMIYIVF

SEQ ID NO: 19429 - protein, 7 aa, Artificial Sequence
  Synthetic construct
YMIYIVY

SEQ ID NO: 19430 - protein, 7 aa, Artificial Sequence
  Synthetic construct
YMIYDFF

SEQ ID NO: 19431 - protein, 7 aa, Artificial Sequence
  Synthetic construct
YMIYDFY

SEQ ID NO: 19432 - protein, 7 aa, Artificial Sequence
  Synthetic construct
YMIYDRF

SEQ ID NO: 19433 - protein, 7 aa, Artificial Sequence
  Synthetic construct
YMIYDRY

SEQ ID NO: 19434 - protein, 7 aa, Artificial Sequence
  Synthetic construct
YMIYDCF

SEQ ID NO: 19435 - protein, 7 aa, Artificial Sequence
  Synthetic construct
YMIYDCY

SEQ ID NO: 19436 - protein, 7 aa, Artificial Sequence
  Synthetic construct
YMIYDLF

SEQ ID NO: 19437 - protein, 7 aa, Artificial Sequence
  Synthetic construct
YMIYDLY

SEQ ID NO: 19438 - protein, 7 aa, Artificial Sequence
  Synthetic construct
YMIYDAF

SEQ ID NO: 19439 - protein, 7 aa, Artificial Sequence
  Synthetic construct
YMIYDAY

SEQ ID NO: 19440 - protein, 7 aa, Artificial Sequence
  Synthetic construct
YMIYDQF

SEQ ID NO: 19441 - protein, 7 aa, Artificial Sequence
  Synthetic construct
YMIYDQY

SEQ ID NO: 19442 - protein, 7 aa, Artificial Sequence
  Synthetic construct
YMIYDDF

SEQ ID NO: 19443 - protein, 7 aa, Artificial Sequence
  Synthetic construct
YMIYDDY

SEQ ID NO: 19444 - protein, 7 aa, Artificial Sequence
  Synthetic construct
YMIYDVF

SEQ ID NO: 19445 - protein, 7 aa, Artificial Sequence
  Synthetic construct
YMIYDVY

SEQ ID NO: 19446 - protein, 7 aa, Artificial Sequence
  Synthetic construct
YMIYYFF

SEQ ID NO: 19447 - protein, 7 aa, Artificial Sequence
  Synthetic construct
YMIYYFY

SEQ ID NO: 19448 - protein, 7 aa, Artificial Sequence
  Synthetic construct
YMIYYRF

SEQ ID NO: 19449 - protein, 7 aa, Artificial Sequence
  Synthetic construct
YMIYYRY

SEQ ID NO: 19450 - protein, 7 aa, Artificial Sequence
  Synthetic construct
YMIYYCF

SEQ ID NO: 19451 - protein, 7 aa, Artificial Sequence
  Synthetic construct
YMIYYCY

SEQ ID NO: 19452 - protein, 7 aa, Artificial Sequence
  Synthetic construct
YMIYYLF

SEQ ID NO: 19453 - protein, 7 aa, Artificial Sequence
  Synthetic construct
YMIYYLY

SEQ ID NO: 19454 - protein, 7 aa, Artificial Sequence
  Synthetic construct
YMIYYAF

SEQ ID NO: 19455 - protein, 7 aa, Artificial Sequence
  Synthetic construct
YMIYYAY

SEQ ID NO: 19456 - protein, 7 aa, Artificial Sequence
  Synthetic construct
YMIYYQF

SEQ ID NO: 19457 - protein, 7 aa, Artificial Sequence
  Synthetic construct
YMIYYQY

SEQ ID NO: 19458 - protein, 7 aa, Artificial Sequence
  Synthetic construct
YMIYYDF

SEQ ID NO: 19459 - protein, 7 aa, Artificial Sequence
  Synthetic construct
YMIYYDY

SEQ ID NO: 19460 - protein, 7 aa, Artificial Sequence
  Synthetic construct
YMIYYVF

SEQ ID NO: 19461 - protein, 7 aa, Artificial Sequence
  Synthetic construct
YMIYYVY

SEQ ID NO: 19462 - protein, 7 aa, Artificial Sequence
  Synthetic construct
YMIYFFF

SEQ ID NO: 19463 - protein, 7 aa, Artificial Sequence
  Synthetic construct
YMIYFFY

SEQ ID NO: 19464 - protein, 7 aa, Artificial Sequence
  Synthetic construct
YMIYFRF

SEQ ID NO: 19465 - protein, 7 aa, Artificial Sequence
  Synthetic construct
YMIYFRY

SEQ ID NO: 19466 - protein, 7 aa, Artificial Sequence
  Synthetic construct
YMIYFCF

SEQ ID NO: 19467 - protein, 7 aa, Artificial Sequence
  Synthetic construct
YMIYFCY

SEQ ID NO: 19468 - protein, 7 aa, Artificial Sequence
  Synthetic construct
YMIYFLF

SEQ ID NO: 19469 - protein, 7 aa, Artificial Sequence
  Synthetic construct
YMIYFLY

SEQ ID NO: 19470 - protein, 7 aa, Artificial Sequence
  Synthetic construct
YMIYFAF

SEQ ID NO: 19471 - protein, 7 aa, Artificial Sequence
  Synthetic construct
YMIYFAY

SEQ ID NO: 19472 - protein, 7 aa, Artificial Sequence
  Synthetic construct
YMIYFQF

SEQ ID NO: 19473 - protein, 7 aa, Artificial Sequence
  Synthetic construct
YMIYFQY

SEQ ID NO: 19474 - protein, 7 aa, Artificial Sequence
  Synthetic construct
YMIYFDF

SEQ ID NO: 19475 - protein, 7 aa, Artificial Sequence
  Synthetic construct
YMIYFDY

SEQ ID NO: 19476 - protein, 7 aa, Artificial Sequence
  Synthetic construct
YMIYFVF

SEQ ID NO: 19477 - protein, 7 aa, Artificial Sequence
  Synthetic construct
YMIYFVY

SEQ ID NO: 19478 - protein, 7 aa, Artificial Sequence
  Synthetic construct
YMIYVFF

SEQ ID NO: 19479 - protein, 7 aa, Artificial Sequence
  Synthetic construct
YMIYVFY

SEQ ID NO: 19480 - protein, 7 aa, Artificial Sequence
  Synthetic construct
YMIYVRF

SEQ ID NO: 19481 - protein, 7 aa, Artificial Sequence
  Synthetic construct
YMIYVRY

SEQ ID NO: 19482 - protein, 7 aa, Artificial Sequence
  Synthetic construct
YMIYVCF

SEQ ID NO: 19483 - protein, 7 aa, Artificial Sequence
  Synthetic construct
YMIYVCY

SEQ ID NO: 19484 - protein, 7 aa, Artificial Sequence
  Synthetic construct
YMIYVLF

SEQ ID NO: 19485 - protein, 7 aa, Artificial Sequence
  Synthetic construct
YMIYVLY

SEQ ID NO: 19486 - protein, 7 aa, Artificial Sequence
  Synthetic construct
YMIYVAF

SEQ ID NO: 19487 - protein, 7 aa, Artificial Sequence
  Synthetic construct
YMIYVAY

SEQ ID NO: 19488 - protein, 7 aa, Artificial Sequence
  Synthetic construct
YMIYVQF

SEQ ID NO: 19489 - protein, 7 aa, Artificial Sequence
  Synthetic construct
YMIYVQY

SEQ ID NO: 19490 - protein, 7 aa, Artificial Sequence
  Synthetic construct
YMIYVDF

SEQ ID NO: 19491 - protein, 7 aa, Artificial Sequence
  Synthetic construct
YMIYVDY

SEQ ID NO: 19492 - protein, 7 aa, Artificial Sequence
  Synthetic construct
YMIYVVF

SEQ ID NO: 19493 - protein, 7 aa, Artificial Sequence
  Synthetic construct
YMIYVVY

SEQ ID NO: 19494 - protein, 7 aa, Artificial Sequence
  Synthetic construct
YMIYTFF

SEQ ID NO: 19495 - protein, 7 aa, Artificial Sequence
  Synthetic construct
YMIYTFY

SEQ ID NO: 19496 - protein, 7 aa, Artificial Sequence
  Synthetic construct
YMIYTRF

SEQ ID NO: 19497 - protein, 7 aa, Artificial Sequence
  Synthetic construct
YMIYTRY

SEQ ID NO: 19498 - protein, 7 aa, Artificial Sequence
  Synthetic construct
YMIYTCF

SEQ ID NO: 19499 - protein, 7 aa, Artificial Sequence
  Synthetic construct
YMIYTCY

SEQ ID NO: 19500 - protein, 7 aa, Artificial Sequence
  Synthetic construct
YMIYTLF

SEQ ID NO: 19501 - protein, 7 aa, Artificial Sequence
  Synthetic construct
YMIYTLY

SEQ ID NO: 19502 - protein, 7 aa, Artificial Sequence
  Synthetic construct
YMIYTAF

SEQ ID NO: 19503 - protein, 7 aa, Artificial Sequence
  Synthetic construct
YMIYTAY

SEQ ID NO: 19504 - protein, 7 aa, Artificial Sequence
  Synthetic construct
YMIYTQF

SEQ ID NO: 19505 - protein, 7 aa, Artificial Sequence
  Synthetic construct
YMIYTQY

SEQ ID NO: 19506 - protein, 7 aa, Artificial Sequence
  Synthetic construct
YMIYTDF

SEQ ID NO: 19507 - protein, 7 aa, Artificial Sequence
  Synthetic construct
YMIYTDY

SEQ ID NO: 19508 - protein, 7 aa, Artificial Sequence
  Synthetic construct
YMIYTVF

SEQ ID NO: 19509 - protein, 7 aa, Artificial Sequence
  Synthetic construct
YMIYTVY

SEQ ID NO: 19510 - protein, 7 aa, Artificial Sequence
  Synthetic construct
YMIYGFF

SEQ ID NO: 19511 - protein, 7 aa, Artificial Sequence
  Synthetic construct
YMIYGFY

SEQ ID NO: 19512 - protein, 7 aa, Artificial Sequence
  Synthetic construct
YMIYGRF

SEQ ID NO: 19513 - protein, 7 aa, Artificial Sequence
  Synthetic construct
YMIYGRY

SEQ ID NO: 19514 - protein, 7 aa, Artificial Sequence
  Synthetic construct
YMIYGCF

SEQ ID NO: 19515 - protein, 7 aa, Artificial Sequence
  Synthetic construct
YMIYGCY

SEQ ID NO: 19516 - protein, 7 aa, Artificial Sequence
  Synthetic construct
YMIYGLF

SEQ ID NO: 19517 - protein, 7 aa, Artificial Sequence
  Synthetic construct
YMIYGLY

SEQ ID NO: 19518 - protein, 7 aa, Artificial Sequence
  Synthetic construct
YMIYGAF

SEQ ID NO: 19519 - protein, 7 aa, Artificial Sequence
  Synthetic construct
YMIYGAY

SEQ ID NO: 19520 - protein, 7 aa, Artificial Sequence
  Synthetic construct
YMIYGQF

SEQ ID NO: 19521 - protein, 7 aa, Artificial Sequence
  Synthetic construct
YMIYGQY

SEQ ID NO: 19522 - protein, 7 aa, Artificial Sequence
  Synthetic construct
YMIYGDF

SEQ ID NO: 19523 - protein, 7 aa, Artificial Sequence
  Synthetic construct
YMIYGDY

SEQ ID NO: 19524 - protein, 7 aa, Artificial Sequence
  Synthetic construct
YMIYGVF

SEQ ID NO: 19525 - protein, 7 aa, Artificial Sequence
  Synthetic construct
YMIYGVY

SEQ ID NO: 19526 - protein, 7 aa, Artificial Sequence
  Synthetic construct
YMIYAFF

SEQ ID NO: 19527 - protein, 7 aa, Artificial Sequence
  Synthetic construct
YMIYAFY

SEQ ID NO: 19528 - protein, 7 aa, Artificial Sequence
  Synthetic construct
YMIYARF

SEQ ID NO: 19529 - protein, 7 aa, Artificial Sequence
  Synthetic construct
YMIYARY

SEQ ID NO: 19530 - protein, 7 aa, Artificial Sequence
  Synthetic construct
YMIYACF

SEQ ID NO: 19531 - protein, 7 aa, Artificial Sequence
  Synthetic construct
YMIYACY

SEQ ID NO: 19532 - protein, 7 aa, Artificial Sequence
  Synthetic construct
YMIYALF

SEQ ID NO: 19533 - protein, 7 aa, Artificial Sequence
  Synthetic construct
YMIYALY

SEQ ID NO: 19534 - protein, 7 aa, Artificial Sequence
  Synthetic construct
YMIYAAF

SEQ ID NO: 19535 - protein, 7 aa, Artificial Sequence
  Synthetic construct
YMIYAAY

SEQ ID NO: 19536 - protein, 7 aa, Artificial Sequence
  Synthetic construct
YMIYAQF

SEQ ID NO: 19537 - protein, 7 aa, Artificial Sequence
  Synthetic construct
YMIYAQY

SEQ ID NO: 19538 - protein, 7 aa, Artificial Sequence
  Synthetic construct
YMIYADF

SEQ ID NO: 19539 - protein, 7 aa, Artificial Sequence
  Synthetic construct
YMIYADY

SEQ ID NO: 19540 - protein, 7 aa, Artificial Sequence
  Synthetic construct
YMIYAVF

SEQ ID NO: 19541 - protein, 7 aa, Artificial Sequence
  Synthetic construct
YMIYAVY

SEQ ID NO: 19542 - protein, 7 aa, Artificial Sequence
  Synthetic construct
YMIYQFF

SEQ ID NO: 19543 - protein, 7 aa, Artificial Sequence
  Synthetic construct
YMIYQFY

SEQ ID NO: 19544 - protein, 7 aa, Artificial Sequence
  Synthetic construct
YMIYQRF

SEQ ID NO: 19545 - protein, 7 aa, Artificial Sequence
  Synthetic construct
YMIYQRY

SEQ ID NO: 19546 - protein, 7 aa, Artificial Sequence
  Synthetic construct
YMIYQCF

SEQ ID NO: 19547 - protein, 7 aa, Artificial Sequence
  Synthetic construct
YMIYQCY

SEQ ID NO: 19548 - protein, 7 aa, Artificial Sequence
  Synthetic construct
YMIYQLF

SEQ ID NO: 19549 - protein, 7 aa, Artificial Sequence
  Synthetic construct
YMIYQLY

SEQ ID NO: 19550 - protein, 7 aa, Artificial Sequence
  Synthetic construct
YMIYQAF

SEQ ID NO: 19551 - protein, 7 aa, Artificial Sequence
  Synthetic construct
YMIYQAY

SEQ ID NO: 19552 - protein, 7 aa, Artificial Sequence
  Synthetic construct
YMIYQQF

SEQ ID NO: 19553 - protein, 7 aa, Artificial Sequence
  Synthetic construct
YMIYQQY

SEQ ID NO: 19554 - protein, 7 aa, Artificial Sequence
  Synthetic construct
YMIYQDF

SEQ ID NO: 19555 - protein, 7 aa, Artificial Sequence
  Synthetic construct
YMIYQDY

SEQ ID NO: 19556 - protein, 7 aa, Artificial Sequence
  Synthetic construct
YMIYQVF

SEQ ID NO: 19557 - protein, 7 aa, Artificial Sequence
  Synthetic construct
YMIYQVY

SEQ ID NO: 19558 - protein, 7 aa, Artificial Sequence
  Synthetic construct
YMIPIFF

SEQ ID NO: 19559 - protein, 7 aa, Artificial Sequence
  Synthetic construct
YMIPIFY

SEQ ID NO: 19560 - protein, 7 aa, Artificial Sequence
  Synthetic construct
YMIPIRF

SEQ ID NO: 19561 - protein, 7 aa, Artificial Sequence
  Synthetic construct
YMIPIRY

SEQ ID NO: 19562 - protein, 7 aa, Artificial Sequence
  Synthetic construct
YMIPICF

SEQ ID NO: 19563 - protein, 7 aa, Artificial Sequence
  Synthetic construct
YMIPICY

SEQ ID NO: 19564 - protein, 7 aa, Artificial Sequence
  Synthetic construct
YMIPILF

SEQ ID NO: 19565 - protein, 7 aa, Artificial Sequence
  Synthetic construct
YMIPILY

SEQ ID NO: 19566 - protein, 7 aa, Artificial Sequence
  Synthetic construct
YMIPIAF

SEQ ID NO: 19567 - protein, 7 aa, Artificial Sequence
  Synthetic construct
YMIPIAY

SEQ ID NO: 19568 - protein, 7 aa, Artificial Sequence
  Synthetic construct
YMIPIQF

SEQ ID NO: 19569 - protein, 7 aa, Artificial Sequence
  Synthetic construct
YMIPIQY

SEQ ID NO: 19570 - protein, 7 aa, Artificial Sequence
  Synthetic construct
YMIPIDF

SEQ ID NO: 19571 - protein, 7 aa, Artificial Sequence
  Synthetic construct
YMIPIDY

SEQ ID NO: 19572 - protein, 7 aa, Artificial Sequence
  Synthetic construct
YMIPIVF

SEQ ID NO: 19573 - protein, 7 aa, Artificial Sequence
  Synthetic construct
YMIPIVY

SEQ ID NO: 19574 - protein, 7 aa, Artificial Sequence
  Synthetic construct
YMIPDFF

SEQ ID NO: 19575 - protein, 7 aa, Artificial Sequence
  Synthetic construct
YMIPDFY

SEQ ID NO: 19576 - protein, 7 aa, Artificial Sequence
  Synthetic construct
YMIPDRF

SEQ ID NO: 19577 - protein, 7 aa, Artificial Sequence
  Synthetic construct
YMIPDRY

SEQ ID NO: 19578 - protein, 7 aa, Artificial Sequence
  Synthetic construct
YMIPDCF

SEQ ID NO: 19579 - protein, 7 aa, Artificial Sequence
  Synthetic construct
YMIPDCY

SEQ ID NO: 19580 - protein, 7 aa, Artificial Sequence
  Synthetic construct
YMIPDLF

SEQ ID NO: 19581 - protein, 7 aa, Artificial Sequence
  Synthetic construct
YMIPDLY

SEQ ID NO: 19582 - protein, 7 aa, Artificial Sequence
  Synthetic construct
YMIPDAF

SEQ ID NO: 19583 - protein, 7 aa, Artificial Sequence
  Synthetic construct
YMIPDAY

SEQ ID NO: 19584 - protein, 7 aa, Artificial Sequence
  Synthetic construct
YMIPDQF

SEQ ID NO: 19585 - protein, 7 aa, Artificial Sequence
  Synthetic construct
YMIPDQY

SEQ ID NO: 19586 - protein, 7 aa, Artificial Sequence
  Synthetic construct
YMIPDDF

SEQ ID NO: 19587 - protein, 7 aa, Artificial Sequence
  Synthetic construct
YMIPDDY

SEQ ID NO: 19588 - protein, 7 aa, Artificial Sequence
  Synthetic construct
YMIPDVF

SEQ ID NO: 19589 - protein, 7 aa, Artificial Sequence
  Synthetic construct
YMIPDVY

SEQ ID NO: 19590 - protein, 7 aa, Artificial Sequence
  Synthetic construct
YMIPYFF

SEQ ID NO: 19591 - protein, 7 aa, Artificial Sequence
  Synthetic construct
YMIPYFY

SEQ ID NO: 19592 - protein, 7 aa, Artificial Sequence
  Synthetic construct
YMIPYRF

SEQ ID NO: 19593 - protein, 7 aa, Artificial Sequence
  Synthetic construct
YMIPYRY

SEQ ID NO: 19594 - protein, 7 aa, Artificial Sequence
  Synthetic construct
YMIPYCF

SEQ ID NO: 19595 - protein, 7 aa, Artificial Sequence
  Synthetic construct
YMIPYCY

SEQ ID NO: 19596 - protein, 7 aa, Artificial Sequence
  Synthetic construct
YMIPYLF

SEQ ID NO: 19597 - protein, 7 aa, Artificial Sequence
  Synthetic construct
YMIPYLY

SEQ ID NO: 19598 - protein, 7 aa, Artificial Sequence
  Synthetic construct
YMIPYAF

SEQ ID NO: 19599 - protein, 7 aa, Artificial Sequence
  Synthetic construct
YMIPYAY

SEQ ID NO: 19600 - protein, 7 aa, Artificial Sequence
  Synthetic construct
YMIPYQF

SEQ ID NO: 19601 - protein, 7 aa, Artificial Sequence
  Synthetic construct
YMIPYQY

SEQ ID NO: 19602 - protein, 7 aa, Artificial Sequence
  Synthetic construct
YMIPYDF

SEQ ID NO: 19603 - protein, 7 aa, Artificial Sequence
  Synthetic construct
YMIPYDY

SEQ ID NO: 19604 - protein, 7 aa, Artificial Sequence
  Synthetic construct
YMIPYVF

SEQ ID NO: 19605 - protein, 7 aa, Artificial Sequence
  Synthetic construct
YMIPYVY

SEQ ID NO: 19606 - protein, 7 aa, Artificial Sequence
  Synthetic construct
YMIPFFF

SEQ ID NO: 19607 - protein, 7 aa, Artificial Sequence
  Synthetic construct
YMIPFFY

SEQ ID NO: 19608 - protein, 7 aa, Artificial Sequence
  Synthetic construct
YMIPFRF

SEQ ID NO: 19609 - protein, 7 aa, Artificial Sequence
  Synthetic construct
YMIPFRY

SEQ ID NO: 19610 - protein, 7 aa, Artificial Sequence
  Synthetic construct
YMIPFCF

SEQ ID NO: 19611 - protein, 7 aa, Artificial Sequence
  Synthetic construct
YMIPFCY

SEQ ID NO: 19612 - protein, 7 aa, Artificial Sequence
  Synthetic construct
YMIPFLF

SEQ ID NO: 19613 - protein, 7 aa, Artificial Sequence
  Synthetic construct
YMIPFLY

SEQ ID NO: 19614 - protein, 7 aa, Artificial Sequence
  Synthetic construct
YMIPFAF

SEQ ID NO: 19615 - protein, 7 aa, Artificial Sequence
  Synthetic construct
YMIPFAY

SEQ ID NO: 19616 - protein, 7 aa, Artificial Sequence
  Synthetic construct
YMIPFQF

SEQ ID NO: 19617 - protein, 7 aa, Artificial Sequence
  Synthetic construct
YMIPFQY

SEQ ID NO: 19618 - protein, 7 aa, Artificial Sequence
  Synthetic construct
YMIPFDF

SEQ ID NO: 19619 - protein, 7 aa, Artificial Sequence
  Synthetic construct
YMIPFDY

SEQ ID NO: 19620 - protein, 7 aa, Artificial Sequence
  Synthetic construct
YMIPFVF

SEQ ID NO: 19621 - protein, 7 aa, Artificial Sequence
  Synthetic construct
YMIPFVY

SEQ ID NO: 19622 - protein, 7 aa, Artificial Sequence
  Synthetic construct
YMIPVFF

SEQ ID NO: 19623 - protein, 7 aa, Artificial Sequence
  Synthetic construct
YMIPVFY

SEQ ID NO: 19624 - protein, 7 aa, Artificial Sequence
  Synthetic construct
YMIPVRF

SEQ ID NO: 19625 - protein, 7 aa, Artificial Sequence
  Synthetic construct
YMIPVRY

SEQ ID NO: 19626 - protein, 7 aa, Artificial Sequence
  Synthetic construct
YMIPVCF

SEQ ID NO: 19627 - protein, 7 aa, Artificial Sequence
  Synthetic construct
YMIPVCY

SEQ ID NO: 19628 - protein, 7 aa, Artificial Sequence
  Synthetic construct
YMIPVLF

SEQ ID NO: 19629 - protein, 7 aa, Artificial Sequence
  Synthetic construct
YMIPVLY

SEQ ID NO: 19630 - protein, 7 aa, Artificial Sequence
  Synthetic construct
YMIPVAF

SEQ ID NO: 19631 - protein, 7 aa, Artificial Sequence
  Synthetic construct
YMIPVAY

SEQ ID NO: 19632 - protein, 7 aa, Artificial Sequence
  Synthetic construct
YMIPVQF

SEQ ID NO: 19633 - protein, 7 aa, Artificial Sequence
  Synthetic construct
YMIPVQY

SEQ ID NO: 19634 - protein, 7 aa, Artificial Sequence
  Synthetic construct
YMIPVDF

SEQ ID NO: 19635 - protein, 7 aa, Artificial Sequence
  Synthetic construct
YMIPVDY

SEQ ID NO: 19636 - protein, 7 aa, Artificial Sequence
  Synthetic construct
YMIPVVF

SEQ ID NO: 19637 - protein, 7 aa, Artificial Sequence
  Synthetic construct
YMIPVVY

SEQ ID NO: 19638 - protein, 7 aa, Artificial Sequence
  Synthetic construct
YMIPTFF

SEQ ID NO: 19639 - protein, 7 aa, Artificial Sequence
  Synthetic construct
YMIPTFY

SEQ ID NO: 19640 - protein, 7 aa, Artificial Sequence
  Synthetic construct
YMIPTRF

SEQ ID NO: 19641 - protein, 7 aa, Artificial Sequence
  Synthetic construct
YMIPTRY

SEQ ID NO: 19642 - protein, 7 aa, Artificial Sequence
  Synthetic construct
YMIPTCF

SEQ ID NO: 19643 - protein, 7 aa, Artificial Sequence
  Synthetic construct
YMIPTCY

SEQ ID NO: 19644 - protein, 7 aa, Artificial Sequence
  Synthetic construct
YMIPTLF

SEQ ID NO: 19645 - protein, 7 aa, Artificial Sequence
  Synthetic construct
YMIPTLY

SEQ ID NO: 19646 - protein, 7 aa, Artificial Sequence
  Synthetic construct
YMIPTAF

SEQ ID NO: 19647 - protein, 7 aa, Artificial Sequence
  Synthetic construct
YMIPTAY

SEQ ID NO: 19648 - protein, 7 aa, Artificial Sequence
  Synthetic construct
YMIPTQF

SEQ ID NO: 19649 - protein, 7 aa, Artificial Sequence
  Synthetic construct
YMIPTQY

SEQ ID NO: 19650 - protein, 7 aa, Artificial Sequence
  Synthetic construct
YMIPTDF

SEQ ID NO: 19651 - protein, 7 aa, Artificial Sequence
  Synthetic construct
YMIPTDY

SEQ ID NO: 19652 - protein, 7 aa, Artificial Sequence
  Synthetic construct
YMIPTVF

SEQ ID NO: 19653 - protein, 7 aa, Artificial Sequence
  Synthetic construct
YMIPTVY

SEQ ID NO: 19654 - protein, 7 aa, Artificial Sequence
  Synthetic construct
YMIPGFF

SEQ ID NO: 19655 - protein, 7 aa, Artificial Sequence
  Synthetic construct
YMIPGFY

SEQ ID NO: 19656 - protein, 7 aa, Artificial Sequence
  Synthetic construct
YMIPGRF

SEQ ID NO: 19657 - protein, 7 aa, Artificial Sequence
  Synthetic construct
YMIPGRY

SEQ ID NO: 19658 - protein, 7 aa, Artificial Sequence
  Synthetic construct
YMIPGCF

SEQ ID NO: 19659 - protein, 7 aa, Artificial Sequence
  Synthetic construct
YMIPGCY

SEQ ID NO: 19660 - protein, 7 aa, Artificial Sequence
  Synthetic construct
YMIPGLF

SEQ ID NO: 19661 - protein, 7 aa, Artificial Sequence
  Synthetic construct
YMIPGLY

SEQ ID NO: 19662 - protein, 7 aa, Artificial Sequence
  Synthetic construct
YMIPGAF

SEQ ID NO: 19663 - protein, 7 aa, Artificial Sequence
  Synthetic construct
YMIPGAY

SEQ ID NO: 19664 - protein, 7 aa, Artificial Sequence
  Synthetic construct
YMIPGQF

SEQ ID NO: 19665 - protein, 7 aa, Artificial Sequence
  Synthetic construct
YMIPGQY

SEQ ID NO: 19666 - protein, 7 aa, Artificial Sequence
  Synthetic construct
YMIPGDF

SEQ ID NO: 19667 - protein, 7 aa, Artificial Sequence
  Synthetic construct
YMIPGDY

SEQ ID NO: 19668 - protein, 7 aa, Artificial Sequence
  Synthetic construct
YMIPGVF

SEQ ID NO: 19669 - protein, 7 aa, Artificial Sequence
  Synthetic construct
YMIPGVY

SEQ ID NO: 19670 - protein, 7 aa, Artificial Sequence
  Synthetic construct
YMIPAFF

SEQ ID NO: 19671 - protein, 7 aa, Artificial Sequence
  Synthetic construct
YMIPAFY

SEQ ID NO: 19672 - protein, 7 aa, Artificial Sequence
  Synthetic construct
YMIPARF

SEQ ID NO: 19673 - protein, 7 aa, Artificial Sequence
  Synthetic construct
YMIPARY

SEQ ID NO: 19674 - protein, 7 aa, Artificial Sequence
  Synthetic construct
YMIPACF

SEQ ID NO: 19675 - protein, 7 aa, Artificial Sequence
  Synthetic construct
YMIPACY

SEQ ID NO: 19676 - protein, 7 aa, Artificial Sequence
  Synthetic construct
YMIPALF

SEQ ID NO: 19677 - protein, 7 aa, Artificial Sequence
  Synthetic construct
YMIPALY

SEQ ID NO: 19678 - protein, 7 aa, Artificial Sequence
  Synthetic construct
YMIPAAF

SEQ ID NO: 19679 - protein, 7 aa, Artificial Sequence
  Synthetic construct
YMIPAAY

SEQ ID NO: 19680 - protein, 7 aa, Artificial Sequence
  Synthetic construct
YMIPAQF

SEQ ID NO: 19681 - protein, 7 aa, Artificial Sequence
  Synthetic construct
YMIPAQY

SEQ ID NO: 19682 - protein, 7 aa, Artificial Sequence
  Synthetic construct
YMIPADF

SEQ ID NO: 19683 - protein, 7 aa, Artificial Sequence
  Synthetic construct
YMIPADY

SEQ ID NO: 19684 - protein, 7 aa, Artificial Sequence
  Synthetic construct
YMIPAVF

SEQ ID NO: 19685 - protein, 7 aa, Artificial Sequence
  Synthetic construct
YMIPAVY

SEQ ID NO: 19686 - protein, 7 aa, Artificial Sequence
  Synthetic construct
YMIPQFF

SEQ ID NO: 19687 - protein, 7 aa, Artificial Sequence
  Synthetic construct
YMIPQFY

SEQ ID NO: 19688 - protein, 7 aa, Artificial Sequence
  Synthetic construct
YMIPQRF

SEQ ID NO: 19689 - protein, 7 aa, Artificial Sequence
  Synthetic construct
YMIPQRY

SEQ ID NO: 19690 - protein, 7 aa, Artificial Sequence
  Synthetic construct
YMIPQCF

SEQ ID NO: 19691 - protein, 7 aa, Artificial Sequence
  Synthetic construct
YMIPQCY

SEQ ID NO: 19692 - protein, 7 aa, Artificial Sequence
  Synthetic construct
YMIPQLF

SEQ ID NO: 19693 - protein, 7 aa, Artificial Sequence
  Synthetic construct
YMIPQLY

SEQ ID NO: 19694 - protein, 7 aa, Artificial Sequence
  Synthetic construct
YMIPQAF

SEQ ID NO: 19695 - protein, 7 aa, Artificial Sequence
  Synthetic construct
YMIPQAY

SEQ ID NO: 19696 - protein, 7 aa, Artificial Sequence
  Synthetic construct
YMIPQQF

SEQ ID NO: 19697 - protein, 7 aa, Artificial Sequence
  Synthetic construct
YMIPQQY

SEQ ID NO: 19698 - protein, 7 aa, Artificial Sequence
  Synthetic construct
YMIPQDF

SEQ ID NO: 19699 - protein, 7 aa, Artificial Sequence
  Synthetic construct
YMIPQDY

SEQ ID NO: 19700 - protein, 7 aa, Artificial Sequence
  Synthetic construct
YMIPQVF

SEQ ID NO: 19701 - protein, 7 aa, Artificial Sequence
  Synthetic construct
YMIPQVY

SEQ ID NO: 19702 - protein, 7 aa, Artificial Sequence
  Synthetic construct
YMIHIFF

SEQ ID NO: 19703 - protein, 7 aa, Artificial Sequence
  Synthetic construct
YMIHIFY

SEQ ID NO: 19704 - protein, 7 aa, Artificial Sequence
  Synthetic construct
YMIHIRF

SEQ ID NO: 19705 - protein, 7 aa, Artificial Sequence
  Synthetic construct
YMIHIRY

SEQ ID NO: 19706 - protein, 7 aa, Artificial Sequence
  Synthetic construct
YMIHICF

SEQ ID NO: 19707 - protein, 7 aa, Artificial Sequence
  Synthetic construct
YMIHICY

SEQ ID NO: 19708 - protein, 7 aa, Artificial Sequence
  Synthetic construct
YMIHILF

SEQ ID NO: 19709 - protein, 7 aa, Artificial Sequence
  Synthetic construct
YMIHILY

SEQ ID NO: 19710 - protein, 7 aa, Artificial Sequence
  Synthetic construct
YMIHIAF

SEQ ID NO: 19711 - protein, 7 aa, Artificial Sequence
  Synthetic construct
YMIHIAY

SEQ ID NO: 19712 - protein, 7 aa, Artificial Sequence
  Synthetic construct
YMIHIQF

SEQ ID NO: 19713 - protein, 7 aa, Artificial Sequence
  Synthetic construct
YMIHIQY

SEQ ID NO: 19714 - protein, 7 aa, Artificial Sequence
  Synthetic construct
YMIHIDF

SEQ ID NO: 19715 - protein, 7 aa, Artificial Sequence
  Synthetic construct
YMIHIDY

SEQ ID NO: 19716 - protein, 7 aa, Artificial Sequence
  Synthetic construct
YMIHIVF

SEQ ID NO: 19717 - protein, 7 aa, Artificial Sequence
  Synthetic construct
YMIHIVY

SEQ ID NO: 19718 - protein, 7 aa, Artificial Sequence
  Synthetic construct
YMIHDFF

SEQ ID NO: 19719 - protein, 7 aa, Artificial Sequence
  Synthetic construct
YMIHDFY

SEQ ID NO: 19720 - protein, 7 aa, Artificial Sequence
  Synthetic construct
YMIHDRF

SEQ ID NO: 19721 - protein, 7 aa, Artificial Sequence
  Synthetic construct
YMIHDRY

SEQ ID NO: 19722 - protein, 7 aa, Artificial Sequence
  Synthetic construct
YMIHDCF

SEQ ID NO: 19723 - protein, 7 aa, Artificial Sequence
  Synthetic construct
YMIHDCY

SEQ ID NO: 19724 - protein, 7 aa, Artificial Sequence
  Synthetic construct
YMIHDLF

SEQ ID NO: 19725 - protein, 7 aa, Artificial Sequence
  Synthetic construct
YMIHDLY

SEQ ID NO: 19726 - protein, 7 aa, Artificial Sequence
  Synthetic construct
YMIHDAF

SEQ ID NO: 19727 - protein, 7 aa, Artificial Sequence
  Synthetic construct
YMIHDAY

SEQ ID NO: 19728 - protein, 7 aa, Artificial Sequence
  Synthetic construct
YMIHDQF

SEQ ID NO: 19729 - protein, 7 aa, Artificial Sequence
  Synthetic construct
YMIHDQY

SEQ ID NO: 19730 - protein, 7 aa, Artificial Sequence
  Synthetic construct
YMIHDDF

SEQ ID NO: 19731 - protein, 7 aa, Artificial Sequence
  Synthetic construct
YMIHDDY

SEQ ID NO: 19732 - protein, 7 aa, Artificial Sequence
  Synthetic construct
YMIHDVF

SEQ ID NO: 19733 - protein, 7 aa, Artificial Sequence
  Synthetic construct
YMIHDVY

SEQ ID NO: 19734 - protein, 7 aa, Artificial Sequence
  Synthetic construct
YMIHYFF

SEQ ID NO: 19735 - protein, 7 aa, Artificial Sequence
  Synthetic construct
YMIHYFY

SEQ ID NO: 19736 - protein, 7 aa, Artificial Sequence
  Synthetic construct
YMIHYRF

SEQ ID NO: 19737 - protein, 7 aa, Artificial Sequence
  Synthetic construct
YMIHYRY

SEQ ID NO: 19738 - protein, 7 aa, Artificial Sequence
  Synthetic construct
YMIHYCF

SEQ ID NO: 19739 - protein, 7 aa, Artificial Sequence
  Synthetic construct
YMIHYCY

SEQ ID NO: 19740 - protein, 7 aa, Artificial Sequence
  Synthetic construct
YMIHYLF

SEQ ID NO: 19741 - protein, 7 aa, Artificial Sequence
  Synthetic construct
YMIHYLY

SEQ ID NO: 19742 - protein, 7 aa, Artificial Sequence
  Synthetic construct
YMIHYAF

SEQ ID NO: 19743 - protein, 7 aa, Artificial Sequence
  Synthetic construct
YMIHYAY

SEQ ID NO: 19744 - protein, 7 aa, Artificial Sequence
  Synthetic construct
YMIHYQF

SEQ ID NO: 19745 - protein, 7 aa, Artificial Sequence
  Synthetic construct
YMIHYQY

SEQ ID NO: 19746 - protein, 7 aa, Artificial Sequence
  Synthetic construct
YMIHYDF

SEQ ID NO: 19747 - protein, 7 aa, Artificial Sequence
  Synthetic construct
YMIHYDY

SEQ ID NO: 19748 - protein, 7 aa, Artificial Sequence
  Synthetic construct
YMIHYVF

SEQ ID NO: 19749 - protein, 7 aa, Artificial Sequence
  Synthetic construct
YMIHYVY

SEQ ID NO: 19750 - protein, 7 aa, Artificial Sequence
  Synthetic construct
YMIHFFF

SEQ ID NO: 19751 - protein, 7 aa, Artificial Sequence
  Synthetic construct
YMIHFFY

SEQ ID NO: 19752 - protein, 7 aa, Artificial Sequence
  Synthetic construct
YMIHFRF

SEQ ID NO: 19753 - protein, 7 aa, Artificial Sequence
  Synthetic construct
YMIHFRY

SEQ ID NO: 19754 - protein, 7 aa, Artificial Sequence
  Synthetic construct
YMIHFCF

SEQ ID NO: 19755 - protein, 7 aa, Artificial Sequence
  Synthetic construct
YMIHFCY

SEQ ID NO: 19756 - protein, 7 aa, Artificial Sequence
  Synthetic construct
YMIHFLF

SEQ ID NO: 19757 - protein, 7 aa, Artificial Sequence
  Synthetic construct
YMIHFLY

SEQ ID NO: 19758 - protein, 7 aa, Artificial Sequence
  Synthetic construct
YMIHFAF

SEQ ID NO: 19759 - protein, 7 aa, Artificial Sequence
  Synthetic construct
YMIHFAY

SEQ ID NO: 19760 - protein, 7 aa, Artificial Sequence
  Synthetic construct
YMIHFQF

SEQ ID NO: 19761 - protein, 7 aa, Artificial Sequence
  Synthetic construct
YMIHFQY

SEQ ID NO: 19762 - protein, 7 aa, Artificial Sequence
  Synthetic construct
YMIHFDF

SEQ ID NO: 19763 - protein, 7 aa, Artificial Sequence
  Synthetic construct
YMIHFDY

SEQ ID NO: 19764 - protein, 7 aa, Artificial Sequence
  Synthetic construct
YMIHFVF

SEQ ID NO: 19765 - protein, 7 aa, Artificial Sequence
  Synthetic construct
YMIHFVY

SEQ ID NO: 19766 - protein, 7 aa, Artificial Sequence
  Synthetic construct
YMIHVFF

SEQ ID NO: 19767 - protein, 7 aa, Artificial Sequence
  Synthetic construct
YMIHVFY

SEQ ID NO: 19768 - protein, 7 aa, Artificial Sequence
  Synthetic construct
YMIHVRF

SEQ ID NO: 19769 - protein, 7 aa, Artificial Sequence
  Synthetic construct
YMIHVRY

SEQ ID NO: 19770 - protein, 7 aa, Artificial Sequence
  Synthetic construct
YMIHVCF

SEQ ID NO: 19771 - protein, 7 aa, Artificial Sequence
  Synthetic construct
YMIHVCY

SEQ ID NO: 19772 - protein, 7 aa, Artificial Sequence
  Synthetic construct
YMIHVLF

SEQ ID NO: 19773 - protein, 7 aa, Artificial Sequence
  Synthetic construct
YMIHVLY

SEQ ID NO: 19774 - protein, 7 aa, Artificial Sequence
  Synthetic construct
YMIHVAF

SEQ ID NO: 19775 - protein, 7 aa, Artificial Sequence
  Synthetic construct
YMIHVAY

SEQ ID NO: 19776 - protein, 7 aa, Artificial Sequence
  Synthetic construct
YMIHVQF

SEQ ID NO: 19777 - protein, 7 aa, Artificial Sequence
  Synthetic construct
YMIHVQY

SEQ ID NO: 19778 - protein, 7 aa, Artificial Sequence
  Synthetic construct
YMIHVDF

SEQ ID NO: 19779 - protein, 7 aa, Artificial Sequence
  Synthetic construct
YMIHVDY

SEQ ID NO: 19780 - protein, 7 aa, Artificial Sequence
  Synthetic construct
YMIHVVF

SEQ ID NO: 19781 - protein, 7 aa, Artificial Sequence
  Synthetic construct
YMIHVVY

SEQ ID NO: 19782 - protein, 7 aa, Artificial Sequence
  Synthetic construct
YMIHTFF

SEQ ID NO: 19783 - protein, 7 aa, Artificial Sequence
  Synthetic construct
YMIHTFY

SEQ ID NO: 19784 - protein, 7 aa, Artificial Sequence
  Synthetic construct
YMIHTRF

SEQ ID NO: 19785 - protein, 7 aa, Artificial Sequence
  Synthetic construct
YMIHTRY

SEQ ID NO: 19786 - protein, 7 aa, Artificial Sequence
  Synthetic construct
YMIHTCF

SEQ ID NO: 19787 - protein, 7 aa, Artificial Sequence
  Synthetic construct
YMIHTCY

SEQ ID NO: 19788 - protein, 7 aa, Artificial Sequence
  Synthetic construct
YMIHTLF

SEQ ID NO: 19789 - protein, 7 aa, Artificial Sequence
  Synthetic construct
YMIHTLY

SEQ ID NO: 19790 - protein, 7 aa, Artificial Sequence
  Synthetic construct
YMIHTAF

SEQ ID NO: 19791 - protein, 7 aa, Artificial Sequence
  Synthetic construct
YMIHTAY

SEQ ID NO: 19792 - protein, 7 aa, Artificial Sequence
  Synthetic construct
YMIHTQF

SEQ ID NO: 19793 - protein, 7 aa, Artificial Sequence
  Synthetic construct
YMIHTQY

SEQ ID NO: 19794 - protein, 7 aa, Artificial Sequence
  Synthetic construct
YMIHTDF

SEQ ID NO: 19795 - protein, 7 aa, Artificial Sequence
  Synthetic construct
YMIHTDY

SEQ ID NO: 19796 - protein, 7 aa, Artificial Sequence
  Synthetic construct
YMIHTVF

SEQ ID NO: 19797 - protein, 7 aa, Artificial Sequence
  Synthetic construct
YMIHTVY

SEQ ID NO: 19798 - protein, 7 aa, Artificial Sequence
  Synthetic construct
YMIHGFF

SEQ ID NO: 19799 - protein, 7 aa, Artificial Sequence
  Synthetic construct
YMIHGFY

SEQ ID NO: 19800 - protein, 7 aa, Artificial Sequence
  Synthetic construct
YMIHGRF

SEQ ID NO: 19801 - protein, 7 aa, Artificial Sequence
  Synthetic construct
YMIHGRY

SEQ ID NO: 19802 - protein, 7 aa, Artificial Sequence
  Synthetic construct
YMIHGCF

SEQ ID NO: 19803 - protein, 7 aa, Artificial Sequence
  Synthetic construct
YMIHGCY

SEQ ID NO: 19804 - protein, 7 aa, Artificial Sequence
  Synthetic construct
YMIHGLF

SEQ ID NO: 19805 - protein, 7 aa, Artificial Sequence
  Synthetic construct
YMIHGLY

SEQ ID NO: 19806 - protein, 7 aa, Artificial Sequence
  Synthetic construct
YMIHGAF

SEQ ID NO: 19807 - protein, 7 aa, Artificial Sequence
  Synthetic construct
YMIHGAY

SEQ ID NO: 19808 - protein, 7 aa, Artificial Sequence
  Synthetic construct
YMIHGQF

SEQ ID NO: 19809 - protein, 7 aa, Artificial Sequence
  Synthetic construct
YMIHGQY

SEQ ID NO: 19810 - protein, 7 aa, Artificial Sequence
  Synthetic construct
YMIHGDF

SEQ ID NO: 19811 - protein, 7 aa, Artificial Sequence
  Synthetic construct
YMIHGDY

SEQ ID NO: 19812 - protein, 7 aa, Artificial Sequence
  Synthetic construct
YMIHGVF

SEQ ID NO: 19813 - protein, 7 aa, Artificial Sequence
  Synthetic construct
YMIHGVY

SEQ ID NO: 19814 - protein, 7 aa, Artificial Sequence
  Synthetic construct
YMIHAFF

SEQ ID NO: 19815 - protein, 7 aa, Artificial Sequence
  Synthetic construct
YMIHAFY

SEQ ID NO: 19816 - protein, 7 aa, Artificial Sequence
  Synthetic construct
YMIHARF

SEQ ID NO: 19817 - protein, 7 aa, Artificial Sequence
  Synthetic construct
YMIHARY

SEQ ID NO: 19818 - protein, 7 aa, Artificial Sequence
  Synthetic construct
YMIHACF

SEQ ID NO: 19819 - protein, 7 aa, Artificial Sequence
  Synthetic construct
YMIHACY

SEQ ID NO: 19820 - protein, 7 aa, Artificial Sequence
  Synthetic construct
YMIHALF

SEQ ID NO: 19821 - protein, 7 aa, Artificial Sequence
  Synthetic construct
YMIHALY

SEQ ID NO: 19822 - protein, 7 aa, Artificial Sequence
  Synthetic construct
YMIHAAF

SEQ ID NO: 19823 - protein, 7 aa, Artificial Sequence
  Synthetic construct
YMIHAAY

SEQ ID NO: 19824 - protein, 7 aa, Artificial Sequence
  Synthetic construct
YMIHAQF

SEQ ID NO: 19825 - protein, 7 aa, Artificial Sequence
  Synthetic construct
YMIHAQY

SEQ ID NO: 19826 - protein, 7 aa, Artificial Sequence
  Synthetic construct
YMIHADF

SEQ ID NO: 19827 - protein, 7 aa, Artificial Sequence
  Synthetic construct
YMIHADY

SEQ ID NO: 19828 - protein, 7 aa, Artificial Sequence
  Synthetic construct
YMIHAVF

SEQ ID NO: 19829 - protein, 7 aa, Artificial Sequence
  Synthetic construct
YMIHAVY

SEQ ID NO: 19830 - protein, 7 aa, Artificial Sequence
  Synthetic construct
YMIHQFF

SEQ ID NO: 19831 - protein, 7 aa, Artificial Sequence
  Synthetic construct
YMIHQFY

SEQ ID NO: 19832 - protein, 7 aa, Artificial Sequence
  Synthetic construct
YMIHQRF

SEQ ID NO: 19833 - protein, 7 aa, Artificial Sequence
  Synthetic construct
YMIHQRY

SEQ ID NO: 19834 - protein, 7 aa, Artificial Sequence
  Synthetic construct
YMIHQCF

SEQ ID NO: 19835 - protein, 7 aa, Artificial Sequence
  Synthetic construct
YMIHQCY

SEQ ID NO: 19836 - protein, 7 aa, Artificial Sequence
  Synthetic construct
YMIHQLF

SEQ ID NO: 19837 - protein, 7 aa, Artificial Sequence
  Synthetic construct
YMIHQLY

SEQ ID NO: 19838 - protein, 7 aa, Artificial Sequence
  Synthetic construct
YMIHQAF

SEQ ID NO: 19839 - protein, 7 aa, Artificial Sequence
  Synthetic construct
YMIHQAY

SEQ ID NO: 19840 - protein, 7 aa, Artificial Sequence
  Synthetic construct
YMIHQQF

SEQ ID NO: 19841 - protein, 7 aa, Artificial Sequence
  Synthetic construct
YMIHQQY

SEQ ID NO: 19842 - protein, 7 aa, Artificial Sequence
  Synthetic construct
YMIHQDF

SEQ ID NO: 19843 - protein, 7 aa, Artificial Sequence
  Synthetic construct
YMIHQDY

SEQ ID NO: 19844 - protein, 7 aa, Artificial Sequence
  Synthetic construct
YMIHQVF

SEQ ID NO: 19845 - protein, 7 aa, Artificial Sequence
  Synthetic construct
YMIHQVY

SEQ ID NO: 19846 - protein, 7 aa, Artificial Sequence
  Synthetic construct
YMILIFF

SEQ ID NO: 19847 - protein, 7 aa, Artificial Sequence
  Synthetic construct
YMILIFY

SEQ ID NO: 19848 - protein, 7 aa, Artificial Sequence
  Synthetic construct
YMILIRF

SEQ ID NO: 19849 - protein, 7 aa, Artificial Sequence
  Synthetic construct
YMILIRY

SEQ ID NO: 19850 - protein, 7 aa, Artificial Sequence
  Synthetic construct
YMILICF

SEQ ID NO: 19851 - protein, 7 aa, Artificial Sequence
  Synthetic construct
YMILICY

SEQ ID NO: 19852 - protein, 7 aa, Artificial Sequence
  Synthetic construct
YMILILF

SEQ ID NO: 19853 - protein, 7 aa, Artificial Sequence
  Synthetic construct
YMILILY

SEQ ID NO: 19854 - protein, 7 aa, Artificial Sequence
  Synthetic construct
YMILIAF

SEQ ID NO: 19855 - protein, 7 aa, Artificial Sequence
  Synthetic construct
YMILIAY

SEQ ID NO: 19856 - protein, 7 aa, Artificial Sequence
  Synthetic construct
YMILIQF

SEQ ID NO: 19857 - protein, 7 aa, Artificial Sequence
  Synthetic construct
YMILIQY

SEQ ID NO: 19858 - protein, 7 aa, Artificial Sequence
  Synthetic construct
YMILIDF

SEQ ID NO: 19859 - protein, 7 aa, Artificial Sequence
  Synthetic construct
YMILIDY

SEQ ID NO: 19860 - protein, 7 aa, Artificial Sequence
  Synthetic construct
YMILIVF

SEQ ID NO: 19861 - protein, 7 aa, Artificial Sequence
  Synthetic construct
YMILIVY

SEQ ID NO: 19862 - protein, 7 aa, Artificial Sequence
  Synthetic construct
YMILDFF

SEQ ID NO: 19863 - protein, 7 aa, Artificial Sequence
  Synthetic construct
YMILDFY

SEQ ID NO: 19864 - protein, 7 aa, Artificial Sequence
  Synthetic construct
YMILDRF

SEQ ID NO: 19865 - protein, 7 aa, Artificial Sequence
  Synthetic construct
YMILDRY

SEQ ID NO: 19866 - protein, 7 aa, Artificial Sequence
  Synthetic construct
YMILDCF

SEQ ID NO: 19867 - protein, 7 aa, Artificial Sequence
  Synthetic construct
YMILDCY

SEQ ID NO: 19868 - protein, 7 aa, Artificial Sequence
  Synthetic construct
YMILDLF

SEQ ID NO: 19869 - protein, 7 aa, Artificial Sequence
  Synthetic construct
YMILDLY

SEQ ID NO: 19870 - protein, 7 aa, Artificial Sequence
  Synthetic construct
YMILDAF

SEQ ID NO: 19871 - protein, 7 aa, Artificial Sequence
  Synthetic construct
YMILDAY

SEQ ID NO: 19872 - protein, 7 aa, Artificial Sequence
  Synthetic construct
YMILDQF

SEQ ID NO: 19873 - protein, 7 aa, Artificial Sequence
  Synthetic construct
YMILDQY

SEQ ID NO: 19874 - protein, 7 aa, Artificial Sequence
  Synthetic construct
YMILDDF

SEQ ID NO: 19875 - protein, 7 aa, Artificial Sequence
  Synthetic construct
YMILDDY

SEQ ID NO: 19876 - protein, 7 aa, Artificial Sequence
  Synthetic construct
YMILDVF

SEQ ID NO: 19877 - protein, 7 aa, Artificial Sequence
  Synthetic construct
YMILDVY

SEQ ID NO: 19878 - protein, 7 aa, Artificial Sequence
  Synthetic construct
YMILYFF

SEQ ID NO: 19879 - protein, 7 aa, Artificial Sequence
  Synthetic construct
YMILYFY

SEQ ID NO: 19880 - protein, 7 aa, Artificial Sequence
  Synthetic construct
YMILYRF

SEQ ID NO: 19881 - protein, 7 aa, Artificial Sequence
  Synthetic construct
YMILYRY

SEQ ID NO: 19882 - protein, 7 aa, Artificial Sequence
  Synthetic construct
YMILYCF

SEQ ID NO: 19883 - protein, 7 aa, Artificial Sequence
  Synthetic construct
YMILYCY

SEQ ID NO: 19884 - protein, 7 aa, Artificial Sequence
  Synthetic construct
YMILYLF

SEQ ID NO: 19885 - protein, 7 aa, Artificial Sequence
  Synthetic construct
YMILYLY

SEQ ID NO: 19886 - protein, 7 aa, Artificial Sequence
  Synthetic construct
YMILYAF

SEQ ID NO: 19887 - protein, 7 aa, Artificial Sequence
  Synthetic construct
YMILYAY

SEQ ID NO: 19888 - protein, 7 aa, Artificial Sequence
  Synthetic construct
YMILYQF

SEQ ID NO: 19889 - protein, 7 aa, Artificial Sequence
  Synthetic construct
YMILYQY

SEQ ID NO: 19890 - protein, 7 aa, Artificial Sequence
  Synthetic construct
YMILYDF

SEQ ID NO: 19891 - protein, 7 aa, Artificial Sequence
  Synthetic construct
YMILYDY

SEQ ID NO: 19892 - protein, 7 aa, Artificial Sequence
  Synthetic construct
YMILYVF

SEQ ID NO: 19893 - protein, 7 aa, Artificial Sequence
  Synthetic construct
YMILYVY

SEQ ID NO: 19894 - protein, 7 aa, Artificial Sequence
  Synthetic construct
YMILFFF

SEQ ID NO: 19895 - protein, 7 aa, Artificial Sequence
  Synthetic construct
YMILFFY

SEQ ID NO: 19896 - protein, 7 aa, Artificial Sequence
  Synthetic construct
YMILFRF

SEQ ID NO: 19897 - protein, 7 aa, Artificial Sequence
  Synthetic construct
YMILFRY

SEQ ID NO: 19898 - protein, 7 aa, Artificial Sequence
  Synthetic construct
YMILFCF

SEQ ID NO: 19899 - protein, 7 aa, Artificial Sequence
  Synthetic construct
YMILFCY

SEQ ID NO: 19900 - protein, 7 aa, Artificial Sequence
  Synthetic construct
YMILFLF

SEQ ID NO: 19901 - protein, 7 aa, Artificial Sequence
  Synthetic construct
YMILFLY

SEQ ID NO: 19902 - protein, 7 aa, Artificial Sequence
  Synthetic construct
YMILFAF

SEQ ID NO: 19903 - protein, 7 aa, Artificial Sequence
  Synthetic construct
YMILFAY

SEQ ID NO: 19904 - protein, 7 aa, Artificial Sequence
  Synthetic construct
YMILFQF

SEQ ID NO: 19905 - protein, 7 aa, Artificial Sequence
  Synthetic construct
YMILFQY

SEQ ID NO: 19906 - protein, 7 aa, Artificial Sequence
  Synthetic construct
YMILFDF

SEQ ID NO: 19907 - protein, 7 aa, Artificial Sequence
  Synthetic construct
YMILFDY

SEQ ID NO: 19908 - protein, 7 aa, Artificial Sequence
  Synthetic construct
YMILFVF

SEQ ID NO: 19909 - protein, 7 aa, Artificial Sequence
  Synthetic construct
YMILFVY

SEQ ID NO: 19910 - protein, 7 aa, Artificial Sequence
  Synthetic construct
YMILVFF

SEQ ID NO: 19911 - protein, 7 aa, Artificial Sequence
  Synthetic construct
YMILVFY

SEQ ID NO: 19912 - protein, 7 aa, Artificial Sequence
  Synthetic construct
YMILVRF

SEQ ID NO: 19913 - protein, 7 aa, Artificial Sequence
  Synthetic construct
YMILVRY

SEQ ID NO: 19914 - protein, 7 aa, Artificial Sequence
  Synthetic construct
YMILVCF

SEQ ID NO: 19915 - protein, 7 aa, Artificial Sequence
  Synthetic construct
YMILVCY

SEQ ID NO: 19916 - protein, 7 aa, Artificial Sequence
  Synthetic construct
YMILVLF

SEQ ID NO: 19917 - protein, 7 aa, Artificial Sequence
  Synthetic construct
YMILVLY

SEQ ID NO: 19918 - protein, 7 aa, Artificial Sequence
  Synthetic construct
YMILVAF

SEQ ID NO: 19919 - protein, 7 aa, Artificial Sequence
  Synthetic construct
YMILVAY

SEQ ID NO: 19920 - protein, 7 aa, Artificial Sequence
  Synthetic construct
YMILVQF

SEQ ID NO: 19921 - protein, 7 aa, Artificial Sequence
  Synthetic construct
YMILVQY

SEQ ID NO: 19922 - protein, 7 aa, Artificial Sequence
  Synthetic construct
YMILVDF

SEQ ID NO: 19923 - protein, 7 aa, Artificial Sequence
  Synthetic construct
YMILVDY

SEQ ID NO: 19924 - protein, 7 aa, Artificial Sequence
  Synthetic construct
YMILVVF

SEQ ID NO: 19925 - protein, 7 aa, Artificial Sequence
  Synthetic construct
YMILVVY

SEQ ID NO: 19926 - protein, 7 aa, Artificial Sequence
  Synthetic construct
YMILTFF

SEQ ID NO: 19927 - protein, 7 aa, Artificial Sequence
  Synthetic construct
YMILTFY

SEQ ID NO: 19928 - protein, 7 aa, Artificial Sequence
  Synthetic construct
YMILTRF

SEQ ID NO: 19929 - protein, 7 aa, Artificial Sequence
  Synthetic construct
YMILTRY

SEQ ID NO: 19930 - protein, 7 aa, Artificial Sequence
  Synthetic construct
YMILTCF

SEQ ID NO: 19931 - protein, 7 aa, Artificial Sequence
  Synthetic construct
YMILTCY

SEQ ID NO: 19932 - protein, 7 aa, Artificial Sequence
  Synthetic construct
YMILTLF

SEQ ID NO: 19933 - protein, 7 aa, Artificial Sequence
  Synthetic construct
YMILTLY

SEQ ID NO: 19934 - protein, 7 aa, Artificial Sequence
  Synthetic construct
YMILTAF

SEQ ID NO: 19935 - protein, 7 aa, Artificial Sequence
  Synthetic construct
YMILTAY

SEQ ID NO: 19936 - protein, 7 aa, Artificial Sequence
  Synthetic construct
YMILTQF

SEQ ID NO: 19937 - protein, 7 aa, Artificial Sequence
  Synthetic construct
YMILTQY

SEQ ID NO: 19938 - protein, 7 aa, Artificial Sequence
  Synthetic construct
YMILTDF

SEQ ID NO: 19939 - protein, 7 aa, Artificial Sequence
  Synthetic construct
YMILTDY

SEQ ID NO: 19940 - protein, 7 aa, Artificial Sequence
  Synthetic construct
YMILTVF

SEQ ID NO: 19941 - protein, 7 aa, Artificial Sequence
  Synthetic construct
YMILTVY

SEQ ID NO: 19942 - protein, 7 aa, Artificial Sequence
  Synthetic construct
YMILGFF

SEQ ID NO: 19943 - protein, 7 aa, Artificial Sequence
  Synthetic construct
YMILGFY

SEQ ID NO: 19944 - protein, 7 aa, Artificial Sequence
  Synthetic construct
YMILGRF

SEQ ID NO: 19945 - protein, 7 aa, Artificial Sequence
  Synthetic construct
YMILGRY

SEQ ID NO: 19946 - protein, 7 aa, Artificial Sequence
  Synthetic construct
YMILGCF

SEQ ID NO: 19947 - protein, 7 aa, Artificial Sequence
  Synthetic construct
YMILGCY

SEQ ID NO: 19948 - protein, 7 aa, Artificial Sequence
  Synthetic construct
YMILGLF

SEQ ID NO: 19949 - protein, 7 aa, Artificial Sequence
  Synthetic construct
YMILGLY

SEQ ID NO: 19950 - protein, 7 aa, Artificial Sequence
  Synthetic construct
YMILGAF

SEQ ID NO: 19951 - protein, 7 aa, Artificial Sequence
  Synthetic construct
YMILGAY

SEQ ID NO: 19952 - protein, 7 aa, Artificial Sequence
  Synthetic construct
YMILGQF

SEQ ID NO: 19953 - protein, 7 aa, Artificial Sequence
  Synthetic construct
YMILGQY

SEQ ID NO: 19954 - protein, 7 aa, Artificial Sequence
  Synthetic construct
YMILGDF

SEQ ID NO: 19955 - protein, 7 aa, Artificial Sequence
  Synthetic construct
YMILGDY

SEQ ID NO: 19956 - protein, 7 aa, Artificial Sequence
  Synthetic construct
YMILGVF

SEQ ID NO: 19957 - protein, 7 aa, Artificial Sequence
  Synthetic construct
YMILGVY

SEQ ID NO: 19958 - protein, 7 aa, Artificial Sequence
  Synthetic construct
YMILAFF

SEQ ID NO: 19959 - protein, 7 aa, Artificial Sequence
  Synthetic construct
YMILAFY

SEQ ID NO: 19960 - protein, 7 aa, Artificial Sequence
  Synthetic construct
YMILARF

SEQ ID NO: 19961 - protein, 7 aa, Artificial Sequence
  Synthetic construct
YMILARY

SEQ ID NO: 19962 - protein, 7 aa, Artificial Sequence
  Synthetic construct
YMILACF

SEQ ID NO: 19963 - protein, 7 aa, Artificial Sequence
  Synthetic construct
YMILACY

SEQ ID NO: 19964 - protein, 7 aa, Artificial Sequence
  Synthetic construct
YMILALF

SEQ ID NO: 19965 - protein, 7 aa, Artificial Sequence
  Synthetic construct
YMILALY

SEQ ID NO: 19966 - protein, 7 aa, Artificial Sequence
  Synthetic construct
YMILAAF

SEQ ID NO: 19967 - protein, 7 aa, Artificial Sequence
  Synthetic construct
YMILAAY

SEQ ID NO: 19968 - protein, 7 aa, Artificial Sequence
  Synthetic construct
YMILAQF

SEQ ID NO: 19969 - protein, 7 aa, Artificial Sequence
  Synthetic construct
YMILAQY

SEQ ID NO: 19970 - protein, 7 aa, Artificial Sequence
  Synthetic construct
YMILADF

SEQ ID NO: 19971 - protein, 7 aa, Artificial Sequence
  Synthetic construct
YMILADY

SEQ ID NO: 19972 - protein, 7 aa, Artificial Sequence
  Synthetic construct
YMILAVF

SEQ ID NO: 19973 - protein, 7 aa, Artificial Sequence
  Synthetic construct
YMILAVY

SEQ ID NO: 19974 - protein, 7 aa, Artificial Sequence
  Synthetic construct
YMILQFF

SEQ ID NO: 19975 - protein, 7 aa, Artificial Sequence
  Synthetic construct
YMILQFY

SEQ ID NO: 19976 - protein, 7 aa, Artificial Sequence
  Synthetic construct
YMILQRF

SEQ ID NO: 19977 - protein, 7 aa, Artificial Sequence
  Synthetic construct
YMILQRY

SEQ ID NO: 19978 - protein, 7 aa, Artificial Sequence
  Synthetic construct
YMILQCF

SEQ ID NO: 19979 - protein, 7 aa, Artificial Sequence
  Synthetic construct
YMILQCY

SEQ ID NO: 19980 - protein, 7 aa, Artificial Sequence
  Synthetic construct
YMILQLF

SEQ ID NO: 19981 - protein, 7 aa, Artificial Sequence
  Synthetic construct
YMILQLY

SEQ ID NO: 19982 - protein, 7 aa, Artificial Sequence
  Synthetic construct
YMILQAF

SEQ ID NO: 19983 - protein, 7 aa, Artificial Sequence
  Synthetic construct
YMILQAY

SEQ ID NO: 19984 - protein, 7 aa, Artificial Sequence
  Synthetic construct
YMILQQF

SEQ ID NO: 19985 - protein, 7 aa, Artificial Sequence
  Synthetic construct
YMILQQY

SEQ ID NO: 19986 - protein, 7 aa, Artificial Sequence
  Synthetic construct
YMILQDF

SEQ ID NO: 19987 - protein, 7 aa, Artificial Sequence
  Synthetic construct
YMILQDY

SEQ ID NO: 19988 - protein, 7 aa, Artificial Sequence
  Synthetic construct
YMILQVF

SEQ ID NO: 19989 - protein, 7 aa, Artificial Sequence
  Synthetic construct
YMILQVY

SEQ ID NO: 19990 - protein, 7 aa, Artificial Sequence
  Synthetic construct
YMIFIFF

SEQ ID NO: 19991 - protein, 7 aa, Artificial Sequence
  Synthetic construct
YMIFIFY

SEQ ID NO: 19992 - protein, 7 aa, Artificial Sequence
  Synthetic construct
YMIFIRF

SEQ ID NO: 19993 - protein, 7 aa, Artificial Sequence
  Synthetic construct
YMIFIRY

SEQ ID NO: 19994 - protein, 7 aa, Artificial Sequence
  Synthetic construct
YMIFICF

SEQ ID NO: 19995 - protein, 7 aa, Artificial Sequence
  Synthetic construct
YMIFICY

SEQ ID NO: 19996 - protein, 7 aa, Artificial Sequence
  Synthetic construct
YMIFILF

SEQ ID NO: 19997 - protein, 7 aa, Artificial Sequence
  Synthetic construct
YMIFILY

SEQ ID NO: 19998 - protein, 7 aa, Artificial Sequence
  Synthetic construct
YMIFIAF

SEQ ID NO: 19999 - protein, 7 aa, Artificial Sequence
  Synthetic construct
YMIFIAY

SEQ ID NO: 20000 - protein, 7 aa, Artificial Sequence
  Synthetic construct
YMIFIQF

SEQ ID NO: 20001 - protein, 7 aa, Artificial Sequence
  Synthetic construct
YMIFIQY

SEQ ID NO: 20002 - protein, 7 aa, Artificial Sequence
  Synthetic construct
YMIFIDF

SEQ ID NO: 20003 - protein, 7 aa, Artificial Sequence
  Synthetic construct
YMIFIDY

SEQ ID NO: 20004 - protein, 7 aa, Artificial Sequence
  Synthetic construct
YMIFIVF

SEQ ID NO: 20005 - protein, 7 aa, Artificial Sequence
  Synthetic construct
YMIFIVY

SEQ ID NO: 20006 - protein, 7 aa, Artificial Sequence
  Synthetic construct
YMIFDFF

SEQ ID NO: 20007 - protein, 7 aa, Artificial Sequence
  Synthetic construct
YMIFDFY

SEQ ID NO: 20008 - protein, 7 aa, Artificial Sequence
  Synthetic construct
YMIFDRF

SEQ ID NO: 20009 - protein, 7 aa, Artificial Sequence
  Synthetic construct
YMIFDRY

SEQ ID NO: 20010 - protein, 7 aa, Artificial Sequence
  Synthetic construct
YMIFDCF

SEQ ID NO: 20011 - protein, 7 aa, Artificial Sequence
  Synthetic construct
YMIFDCY

SEQ ID NO: 20012 - protein, 7 aa, Artificial Sequence
  Synthetic construct
YMIFDLF

SEQ ID NO: 20013 - protein, 7 aa, Artificial Sequence
  Synthetic construct
YMIFDLY

SEQ ID NO: 20014 - protein, 7 aa, Artificial Sequence
  Synthetic construct
YMIFDAF

SEQ ID NO: 20015 - protein, 7 aa, Artificial Sequence
  Synthetic construct
YMIFDAY

SEQ ID NO: 20016 - protein, 7 aa, Artificial Sequence
  Synthetic construct
YMIFDQF

SEQ ID NO: 20017 - protein, 7 aa, Artificial Sequence
  Synthetic construct
YMIFDQY

SEQ ID NO: 20018 - protein, 7 aa, Artificial Sequence
  Synthetic construct
YMIFDDF

SEQ ID NO: 20019 - protein, 7 aa, Artificial Sequence
  Synthetic construct
YMIFDDY

SEQ ID NO: 20020 - protein, 7 aa, Artificial Sequence
  Synthetic construct
YMIFDVF

SEQ ID NO: 20021 - protein, 7 aa, Artificial Sequence
  Synthetic construct
YMIFDVY

SEQ ID NO: 20022 - protein, 7 aa, Artificial Sequence
  Synthetic construct
YMIFYFF

SEQ ID NO: 20023 - protein, 7 aa, Artificial Sequence
  Synthetic construct
YMIFYFY

SEQ ID NO: 20024 - protein, 7 aa, Artificial Sequence
  Synthetic construct
YMIFYRF

SEQ ID NO: 20025 - protein, 7 aa, Artificial Sequence
  Synthetic construct
YMIFYRY

SEQ ID NO: 20026 - protein, 7 aa, Artificial Sequence
  Synthetic construct
YMIFYCF

SEQ ID NO: 20027 - protein, 7 aa, Artificial Sequence
  Synthetic construct
YMIFYCY

SEQ ID NO: 20028 - protein, 7 aa, Artificial Sequence
  Synthetic construct
YMIFYLF

SEQ ID NO: 20029 - protein, 7 aa, Artificial Sequence
  Synthetic construct
YMIFYLY

SEQ ID NO: 20030 - protein, 7 aa, Artificial Sequence
  Synthetic construct
YMIFYAF

SEQ ID NO: 20031 - protein, 7 aa, Artificial Sequence
  Synthetic construct
YMIFYAY

SEQ ID NO: 20032 - protein, 7 aa, Artificial Sequence
  Synthetic construct
YMIFYQF

SEQ ID NO: 20033 - protein, 7 aa, Artificial Sequence
  Synthetic construct
YMIFYQY

SEQ ID NO: 20034 - protein, 7 aa, Artificial Sequence
  Synthetic construct
YMIFYDF

SEQ ID NO: 20035 - protein, 7 aa, Artificial Sequence
  Synthetic construct
YMIFYDY

SEQ ID NO: 20036 - protein, 7 aa, Artificial Sequence
  Synthetic construct
YMIFYVF

SEQ ID NO: 20037 - protein, 7 aa, Artificial Sequence
  Synthetic construct
YMIFYVY

SEQ ID NO: 20038 - protein, 7 aa, Artificial Sequence
  Synthetic construct
YMIFFFF

SEQ ID NO: 20039 - protein, 7 aa, Artificial Sequence
  Synthetic construct
YMIFFFY

SEQ ID NO: 20040 - protein, 7 aa, Artificial Sequence
  Synthetic construct
YMIFFRF

SEQ ID NO: 20041 - protein, 7 aa, Artificial Sequence
  Synthetic construct
YMIFFRY

SEQ ID NO: 20042 - protein, 7 aa, Artificial Sequence
  Synthetic construct
YMIFFCF

SEQ ID NO: 20043 - protein, 7 aa, Artificial Sequence
  Synthetic construct
YMIFFCY

SEQ ID NO: 20044 - protein, 7 aa, Artificial Sequence
  Synthetic construct
YMIFFLF

SEQ ID NO: 20045 - protein, 7 aa, Artificial Sequence
  Synthetic construct
YMIFFLY

SEQ ID NO: 20046 - protein, 7 aa, Artificial Sequence
  Synthetic construct
YMIFFAF

SEQ ID NO: 20047 - protein, 7 aa, Artificial Sequence
  Synthetic construct
YMIFFAY

SEQ ID NO: 20048 - protein, 7 aa, Artificial Sequence
  Synthetic construct
YMIFFQF

SEQ ID NO: 20049 - protein, 7 aa, Artificial Sequence
  Synthetic construct
YMIFFQY

SEQ ID NO: 20050 - protein, 7 aa, Artificial Sequence
  Synthetic construct
YMIFFDF

SEQ ID NO: 20051 - protein, 7 aa, Artificial Sequence
  Synthetic construct
YMIFFDY

SEQ ID NO: 20052 - protein, 7 aa, Artificial Sequence
  Synthetic construct
YMIFFVF

SEQ ID NO: 20053 - protein, 7 aa, Artificial Sequence
  Synthetic construct
YMIFFVY

SEQ ID NO: 20054 - protein, 7 aa, Artificial Sequence
  Synthetic construct
YMIFVFF

SEQ ID NO: 20055 - protein, 7 aa, Artificial Sequence
  Synthetic construct
YMIFVFY

SEQ ID NO: 20056 - protein, 7 aa, Artificial Sequence
  Synthetic construct
YMIFVRF

SEQ ID NO: 20057 - protein, 7 aa, Artificial Sequence
  Synthetic construct
YMIFVRY

SEQ ID NO: 20058 - protein, 7 aa, Artificial Sequence
  Synthetic construct
YMIFVCF

SEQ ID NO: 20059 - protein, 7 aa, Artificial Sequence
  Synthetic construct
YMIFVCY

SEQ ID NO: 20060 - protein, 7 aa, Artificial Sequence
  Synthetic construct
YMIFVLF

SEQ ID NO: 20061 - protein, 7 aa, Artificial Sequence
  Synthetic construct
YMIFVLY

SEQ ID NO: 20062 - protein, 7 aa, Artificial Sequence
  Synthetic construct
YMIFVAF

SEQ ID NO: 20063 - protein, 7 aa, Artificial Sequence
  Synthetic construct
YMIFVAY

SEQ ID NO: 20064 - protein, 7 aa, Artificial Sequence
  Synthetic construct
YMIFVQF

SEQ ID NO: 20065 - protein, 7 aa, Artificial Sequence
  Synthetic construct
YMIFVQY

SEQ ID NO: 20066 - protein, 7 aa, Artificial Sequence
  Synthetic construct
YMIFVDF

SEQ ID NO: 20067 - protein, 7 aa, Artificial Sequence
  Synthetic construct
YMIFVDY

SEQ ID NO: 20068 - protein, 7 aa, Artificial Sequence
  Synthetic construct
YMIFVVF

SEQ ID NO: 20069 - protein, 7 aa, Artificial Sequence
  Synthetic construct
YMIFVVY

SEQ ID NO: 20070 - protein, 7 aa, Artificial Sequence
  Synthetic construct
YMIFTFF

SEQ ID NO: 20071 - protein, 7 aa, Artificial Sequence
  Synthetic construct
YMIFTFY

SEQ ID NO: 20072 - protein, 7 aa, Artificial Sequence
  Synthetic construct
YMIFTRF

SEQ ID NO: 20073 - protein, 7 aa, Artificial Sequence
  Synthetic construct
YMIFTRY

SEQ ID NO: 20074 - protein, 7 aa, Artificial Sequence
  Synthetic construct
YMIFTCF

SEQ ID NO: 20075 - protein, 7 aa, Artificial Sequence
  Synthetic construct
YMIFTCY

SEQ ID NO: 20076 - protein, 7 aa, Artificial Sequence
  Synthetic construct
YMIFTLF

SEQ ID NO: 20077 - protein, 7 aa, Artificial Sequence
  Synthetic construct
YMIFTLY

SEQ ID NO: 20078 - protein, 7 aa, Artificial Sequence
  Synthetic construct
YMIFTAF

SEQ ID NO: 20079 - protein, 7 aa, Artificial Sequence
  Synthetic construct
YMIFTAY

SEQ ID NO: 20080 - protein, 7 aa, Artificial Sequence
  Synthetic construct
YMIFTQF

SEQ ID NO: 20081 - protein, 7 aa, Artificial Sequence
  Synthetic construct
YMIFTQY

SEQ ID NO: 20082 - protein, 7 aa, Artificial Sequence
  Synthetic construct
YMIFTDF

SEQ ID NO: 20083 - protein, 7 aa, Artificial Sequence
  Synthetic construct
YMIFTDY

SEQ ID NO: 20084 - protein, 7 aa, Artificial Sequence
  Synthetic construct
YMIFTVF

SEQ ID NO: 20085 - protein, 7 aa, Artificial Sequence
  Synthetic construct
YMIFTVY

SEQ ID NO: 20086 - protein, 7 aa, Artificial Sequence
  Synthetic construct
YMIFGFF

SEQ ID NO: 20087 - protein, 7 aa, Artificial Sequence
  Synthetic construct
YMIFGFY

SEQ ID NO: 20088 - protein, 7 aa, Artificial Sequence
  Synthetic construct
YMIFGRF

SEQ ID NO: 20089 - protein, 7 aa, Artificial Sequence
  Synthetic construct
YMIFGRY

SEQ ID NO: 20090 - protein, 7 aa, Artificial Sequence
  Synthetic construct
YMIFGCF

SEQ ID NO: 20091 - protein, 7 aa, Artificial Sequence
  Synthetic construct
YMIFGCY

SEQ ID NO: 20092 - protein, 7 aa, Artificial Sequence
  Synthetic construct
YMIFGLF

SEQ ID NO: 20093 - protein, 7 aa, Artificial Sequence
  Synthetic construct
YMIFGLY

SEQ ID NO: 20094 - protein, 7 aa, Artificial Sequence
  Synthetic construct
YMIFGAF

SEQ ID NO: 20095 - protein, 7 aa, Artificial Sequence
  Synthetic construct
YMIFGAY

SEQ ID NO: 20096 - protein, 7 aa, Artificial Sequence
  Synthetic construct
YMIFGQF

SEQ ID NO: 20097 - protein, 7 aa, Artificial Sequence
  Synthetic construct
YMIFGQY

SEQ ID NO: 20098 - protein, 7 aa, Artificial Sequence
  Synthetic construct
YMIFGDF

SEQ ID NO: 20099 - protein, 7 aa, Artificial Sequence
  Synthetic construct
YMIFGDY

SEQ ID NO: 20100 - protein, 7 aa, Artificial Sequence
  Synthetic construct
YMIFGVF

SEQ ID NO: 20101 - protein, 7 aa, Artificial Sequence
  Synthetic construct
YMIFGVY

SEQ ID NO: 20102 - protein, 7 aa, Artificial Sequence
  Synthetic construct
YMIFAFF

SEQ ID NO: 20103 - protein, 7 aa, Artificial Sequence
  Synthetic construct
YMIFAFY

SEQ ID NO: 20104 - protein, 7 aa, Artificial Sequence
  Synthetic construct
YMIFARF

SEQ ID NO: 20105 - protein, 7 aa, Artificial Sequence
  Synthetic construct
YMIFARY

SEQ ID NO: 20106 - protein, 7 aa, Artificial Sequence
  Synthetic construct
YMIFACF

SEQ ID NO: 20107 - protein, 7 aa, Artificial Sequence
  Synthetic construct
YMIFACY

SEQ ID NO: 20108 - protein, 7 aa, Artificial Sequence
  Synthetic construct
YMIFALF

SEQ ID NO: 20109 - protein, 7 aa, Artificial Sequence
  Synthetic construct
YMIFALY

SEQ ID NO: 20110 - protein, 7 aa, Artificial Sequence
  Synthetic construct
YMIFAAF

SEQ ID NO: 20111 - protein, 7 aa, Artificial Sequence
  Synthetic construct
YMIFAAY

SEQ ID NO: 20112 - protein, 7 aa, Artificial Sequence
  Synthetic construct
YMIFAQF

SEQ ID NO: 20113 - protein, 7 aa, Artificial Sequence
  Synthetic construct
YMIFAQY

SEQ ID NO: 20114 - protein, 7 aa, Artificial Sequence
  Synthetic construct
YMIFADF

SEQ ID NO: 20115 - protein, 7 aa, Artificial Sequence
  Synthetic construct
YMIFADY

SEQ ID NO: 20116 - protein, 7 aa, Artificial Sequence
  Synthetic construct
YMIFAVF

SEQ ID NO: 20117 - protein, 7 aa, Artificial Sequence
  Synthetic construct
YMIFAVY

SEQ ID NO: 20118 - protein, 7 aa, Artificial Sequence
  Synthetic construct
YMIFQFF

SEQ ID NO: 20119 - protein, 7 aa, Artificial Sequence
  Synthetic construct
YMIFQFY

SEQ ID NO: 20120 - protein, 7 aa, Artificial Sequence
  Synthetic construct
YMIFQRF

SEQ ID NO: 20121 - protein, 7 aa, Artificial Sequence
  Synthetic construct
YMIFQRY

SEQ ID NO: 20122 - protein, 7 aa, Artificial Sequence
  Synthetic construct
YMIFQCF

SEQ ID NO: 20123 - protein, 7 aa, Artificial Sequence
  Synthetic construct
YMIFQCY

SEQ ID NO: 20124 - protein, 7 aa, Artificial Sequence
  Synthetic construct
YMIFQLF

SEQ ID NO: 20125 - protein, 7 aa, Artificial Sequence
  Synthetic construct
YMIFQLY

SEQ ID NO: 20126 - protein, 7 aa, Artificial Sequence
  Synthetic construct
YMIFQAF

SEQ ID NO: 20127 - protein, 7 aa, Artificial Sequence
  Synthetic construct
YMIFQAY

SEQ ID NO: 20128 - protein, 7 aa, Artificial Sequence
  Synthetic construct
YMIFQQF

SEQ ID NO: 20129 - protein, 7 aa, Artificial Sequence
  Synthetic construct
YMIFQQY

SEQ ID NO: 20130 - protein, 7 aa, Artificial Sequence
  Synthetic construct
YMIFQDF

SEQ ID NO: 20131 - protein, 7 aa, Artificial Sequence
  Synthetic construct
YMIFQDY

SEQ ID NO: 20132 - protein, 7 aa, Artificial Sequence
  Synthetic construct
YMIFQVF

SEQ ID NO: 20133 - protein, 7 aa, Artificial Sequence
  Synthetic construct
YMIFQVY

SEQ ID NO: 20134 - protein, 7 aa, Artificial Sequence
  Synthetic construct
YMGYIFF

SEQ ID NO: 20135 - protein, 7 aa, Artificial Sequence
  Synthetic construct
YMGYIFY

SEQ ID NO: 20136 - protein, 7 aa, Artificial Sequence
  Synthetic construct
YMGYIRF

SEQ ID NO: 20137 - protein, 7 aa, Artificial Sequence
  Synthetic construct
YMGYIRY

SEQ ID NO: 20138 - protein, 7 aa, Artificial Sequence
  Synthetic construct
YMGYICF

SEQ ID NO: 20139 - protein, 7 aa, Artificial Sequence
  Synthetic construct
YMGYICY

SEQ ID NO: 20140 - protein, 7 aa, Artificial Sequence
  Synthetic construct
YMGYILF

SEQ ID NO: 20141 - protein, 7 aa, Artificial Sequence
  Synthetic construct
YMGYILY

SEQ ID NO: 20142 - protein, 7 aa, Artificial Sequence
  Synthetic construct
YMGYIAF

SEQ ID NO: 20143 - protein, 7 aa, Artificial Sequence
  Synthetic construct
YMGYIAY

SEQ ID NO: 20144 - protein, 7 aa, Artificial Sequence
  Synthetic construct
YMGYIQF

SEQ ID NO: 20145 - protein, 7 aa, Artificial Sequence
  Synthetic construct
YMGYIQY

SEQ ID NO: 20146 - protein, 7 aa, Artificial Sequence
  Synthetic construct
YMGYIDF

SEQ ID NO: 20147 - protein, 7 aa, Artificial Sequence
  Synthetic construct
YMGYIDY

SEQ ID NO: 20148 - protein, 7 aa, Artificial Sequence
  Synthetic construct
YMGYIVF

SEQ ID NO: 20149 - protein, 7 aa, Artificial Sequence
  Synthetic construct
YMGYIVY

SEQ ID NO: 20150 - protein, 7 aa, Artificial Sequence
  Synthetic construct
YMGYDFF

SEQ ID NO: 20151 - protein, 7 aa, Artificial Sequence
  Synthetic construct
YMGYDFY

SEQ ID NO: 20152 - protein, 7 aa, Artificial Sequence
  Synthetic construct
YMGYDRF

SEQ ID NO: 20153 - protein, 7 aa, Artificial Sequence
  Synthetic construct
YMGYDRY

SEQ ID NO: 20154 - protein, 7 aa, Artificial Sequence
  Synthetic construct
YMGYDCF

SEQ ID NO: 20155 - protein, 7 aa, Artificial Sequence
  Synthetic construct
YMGYDCY

SEQ ID NO: 20156 - protein, 7 aa, Artificial Sequence
  Synthetic construct
YMGYDLF

SEQ ID NO: 20157 - protein, 7 aa, Artificial Sequence
  Synthetic construct
YMGYDLY

SEQ ID NO: 20158 - protein, 7 aa, Artificial Sequence
  Synthetic construct
YMGYDAF

SEQ ID NO: 20159 - protein, 7 aa, Artificial Sequence
  Synthetic construct
YMGYDAY

SEQ ID NO: 20160 - protein, 7 aa, Artificial Sequence
  Synthetic construct
YMGYDQF

SEQ ID NO: 20161 - protein, 7 aa, Artificial Sequence
  Synthetic construct
YMGYDQY

SEQ ID NO: 20162 - protein, 7 aa, Artificial Sequence
  Synthetic construct
YMGYDDF

SEQ ID NO: 20163 - protein, 7 aa, Artificial Sequence
  Synthetic construct
YMGYDDY

SEQ ID NO: 20164 - protein, 7 aa, Artificial Sequence
  Synthetic construct
YMGYDVF

SEQ ID NO: 20165 - protein, 7 aa, Artificial Sequence
  Synthetic construct
YMGYDVY

SEQ ID NO: 20166 - protein, 7 aa, Artificial Sequence
  Synthetic construct
YMGYYFF

SEQ ID NO: 20167 - protein, 7 aa, Artificial Sequence
  Synthetic construct
YMGYYFY

SEQ ID NO: 20168 - protein, 7 aa, Artificial Sequence
  Synthetic construct
YMGYYRF

SEQ ID NO: 20169 - protein, 7 aa, Artificial Sequence
  Synthetic construct
YMGYYRY

SEQ ID NO: 20170 - protein, 7 aa, Artificial Sequence
  Synthetic construct
YMGYYCF

SEQ ID NO: 20171 - protein, 7 aa, Artificial Sequence
  Synthetic construct
YMGYYCY

SEQ ID NO: 20172 - protein, 7 aa, Artificial Sequence
  Synthetic construct
YMGYYLF

SEQ ID NO: 20173 - protein, 7 aa, Artificial Sequence
  Synthetic construct
YMGYYLY

SEQ ID NO: 20174 - protein, 7 aa, Artificial Sequence
  Synthetic construct
YMGYYAF

SEQ ID NO: 20175 - protein, 7 aa, Artificial Sequence
  Synthetic construct
YMGYYAY

SEQ ID NO: 20176 - protein, 7 aa, Artificial Sequence
  Synthetic construct
YMGYYQF

SEQ ID NO: 20177 - protein, 7 aa, Artificial Sequence
  Synthetic construct
YMGYYQY

SEQ ID NO: 20178 - protein, 7 aa, Artificial Sequence
  Synthetic construct
YMGYYDF

SEQ ID NO: 20179 - protein, 7 aa, Artificial Sequence
  Synthetic construct
YMGYYDY

SEQ ID NO: 20180 - protein, 7 aa, Artificial Sequence
  Synthetic construct
YMGYYVF

SEQ ID NO: 20181 - protein, 7 aa, Artificial Sequence
  Synthetic construct
YMGYYVY

SEQ ID NO: 20182 - protein, 7 aa, Artificial Sequence
  Synthetic construct
YMGYFFF

SEQ ID NO: 20183 - protein, 7 aa, Artificial Sequence
  Synthetic construct
YMGYFFY

SEQ ID NO: 20184 - protein, 7 aa, Artificial Sequence
  Synthetic construct
YMGYFRF

SEQ ID NO: 20185 - protein, 7 aa, Artificial Sequence
  Synthetic construct
YMGYFRY

SEQ ID NO: 20186 - protein, 7 aa, Artificial Sequence
  Synthetic construct
YMGYFCF

SEQ ID NO: 20187 - protein, 7 aa, Artificial Sequence
  Synthetic construct
YMGYFCY

SEQ ID NO: 20188 - protein, 7 aa, Artificial Sequence
  Synthetic construct
YMGYFLF

SEQ ID NO: 20189 - protein, 7 aa, Artificial Sequence
  Synthetic construct
YMGYFLY

SEQ ID NO: 20190 - protein, 7 aa, Artificial Sequence
  Synthetic construct
YMGYFAF

SEQ ID NO: 20191 - protein, 7 aa, Artificial Sequence
  Synthetic construct
YMGYFAY

SEQ ID NO: 20192 - protein, 7 aa, Artificial Sequence
  Synthetic construct
YMGYFQF

SEQ ID NO: 20193 - protein, 7 aa, Artificial Sequence
  Synthetic construct
YMGYFQY

SEQ ID NO: 20194 - protein, 7 aa, Artificial Sequence
  Synthetic construct
YMGYFDF

SEQ ID NO: 20195 - protein, 7 aa, Artificial Sequence
  Synthetic construct
YMGYFDY

SEQ ID NO: 20196 - protein, 7 aa, Artificial Sequence
  Synthetic construct
YMGYFVF

SEQ ID NO: 20197 - protein, 7 aa, Artificial Sequence
  Synthetic construct
YMGYFVY

SEQ ID NO: 20198 - protein, 7 aa, Artificial Sequence
  Synthetic construct
YMGYVFF

SEQ ID NO: 20199 - protein, 7 aa, Artificial Sequence
  Synthetic construct
YMGYVFY

SEQ ID NO: 20200 - protein, 7 aa, Artificial Sequence
  Synthetic construct
YMGYVRF

SEQ ID NO: 20201 - protein, 7 aa, Artificial Sequence
  Synthetic construct
YMGYVRY

SEQ ID NO: 20202 - protein, 7 aa, Artificial Sequence
  Synthetic construct
YMGYVCF

SEQ ID NO: 20203 - protein, 7 aa, Artificial Sequence
  Synthetic construct
YMGYVCY

SEQ ID NO: 20204 - protein, 7 aa, Artificial Sequence
  Synthetic construct
YMGYVLF

SEQ ID NO: 20205 - protein, 7 aa, Artificial Sequence
  Synthetic construct
YMGYVLY

SEQ ID NO: 20206 - protein, 7 aa, Artificial Sequence
  Synthetic construct
YMGYVAF

SEQ ID NO: 20207 - protein, 7 aa, Artificial Sequence
  Synthetic construct
YMGYVAY

SEQ ID NO: 20208 - protein, 7 aa, Artificial Sequence
  Synthetic construct
YMGYVQF

SEQ ID NO: 20209 - protein, 7 aa, Artificial Sequence
  Synthetic construct
YMGYVQY

SEQ ID NO: 20210 - protein, 7 aa, Artificial Sequence
  Synthetic construct
YMGYVDF

SEQ ID NO: 20211 - protein, 7 aa, Artificial Sequence
  Synthetic construct
YMGYVDY

SEQ ID NO: 20212 - protein, 7 aa, Artificial Sequence
  Synthetic construct
YMGYVVF

SEQ ID NO: 20213 - protein, 7 aa, Artificial Sequence
  Synthetic construct
YMGYVVY

SEQ ID NO: 20214 - protein, 7 aa, Artificial Sequence
  Synthetic construct
YMGYTFF

SEQ ID NO: 20215 - protein, 7 aa, Artificial Sequence
  Synthetic construct
YMGYTFY

SEQ ID NO: 20216 - protein, 7 aa, Artificial Sequence
  Synthetic construct
YMGYTRF

SEQ ID NO: 20217 - protein, 7 aa, Artificial Sequence
  Synthetic construct
YMGYTRY

SEQ ID NO: 20218 - protein, 7 aa, Artificial Sequence
  Synthetic construct
YMGYTCF

SEQ ID NO: 20219 - protein, 7 aa, Artificial Sequence
  Synthetic construct
YMGYTCY

SEQ ID NO: 20220 - protein, 7 aa, Artificial Sequence
  Synthetic construct
YMGYTLF

SEQ ID NO: 20221 - protein, 7 aa, Artificial Sequence
  Synthetic construct
YMGYTLY

SEQ ID NO: 20222 - protein, 7 aa, Artificial Sequence
  Synthetic construct
YMGYTAF

SEQ ID NO: 20223 - protein, 7 aa, Artificial Sequence
  Synthetic construct
YMGYTAY

SEQ ID NO: 20224 - protein, 7 aa, Artificial Sequence
  Synthetic construct
YMGYTQF

SEQ ID NO: 20225 - protein, 7 aa, Artificial Sequence
  Synthetic construct
YMGYTQY

SEQ ID NO: 20226 - protein, 7 aa, Artificial Sequence
  Synthetic construct
YMGYTDF

SEQ ID NO: 20227 - protein, 7 aa, Artificial Sequence
  Synthetic construct
YMGYTDY

SEQ ID NO: 20228 - protein, 7 aa, Artificial Sequence
  Synthetic construct
YMGYTVF

SEQ ID NO: 20229 - protein, 7 aa, Artificial Sequence
  Synthetic construct
YMGYTVY

SEQ ID NO: 20230 - protein, 7 aa, Artificial Sequence
  Synthetic construct
YMGYGFF

SEQ ID NO: 20231 - protein, 7 aa, Artificial Sequence
  Synthetic construct
YMGYGFY

SEQ ID NO: 20232 - protein, 7 aa, Artificial Sequence
  Synthetic construct
YMGYGRF

SEQ ID NO: 20233 - protein, 7 aa, Artificial Sequence
  Synthetic construct
YMGYGRY

SEQ ID NO: 20234 - protein, 7 aa, Artificial Sequence
  Synthetic construct
YMGYGCF

SEQ ID NO: 20235 - protein, 7 aa, Artificial Sequence
  Synthetic construct
YMGYGCY

SEQ ID NO: 20236 - protein, 7 aa, Artificial Sequence
  Synthetic construct
YMGYGLF

SEQ ID NO: 20237 - protein, 7 aa, Artificial Sequence
  Synthetic construct
YMGYGLY

SEQ ID NO: 20238 - protein, 7 aa, Artificial Sequence
  Synthetic construct
YMGYGAF

SEQ ID NO: 20239 - protein, 7 aa, Artificial Sequence
  Synthetic construct
YMGYGAY

SEQ ID NO: 20240 - protein, 7 aa, Artificial Sequence
  Synthetic construct
YMGYGQF

SEQ ID NO: 20241 - protein, 7 aa, Artificial Sequence
  Synthetic construct
YMGYGQY

SEQ ID NO: 20242 - protein, 7 aa, Artificial Sequence
  Synthetic construct
YMGYGDF

SEQ ID NO: 20243 - protein, 7 aa, Artificial Sequence
  Synthetic construct
YMGYGDY

SEQ ID NO: 20244 - protein, 7 aa, Artificial Sequence
  Synthetic construct
YMGYGVF

SEQ ID NO: 20245 - protein, 7 aa, Artificial Sequence
  Synthetic construct
YMGYGVY

SEQ ID NO: 20246 - protein, 7 aa, Artificial Sequence
  Synthetic construct
YMGYAFF

SEQ ID NO: 20247 - protein, 7 aa, Artificial Sequence
  Synthetic construct
YMGYAFY

SEQ ID NO: 20248 - protein, 7 aa, Artificial Sequence
  Synthetic construct
YMGYARF

SEQ ID NO: 20249 - protein, 7 aa, Artificial Sequence
  Synthetic construct
YMGYARY

SEQ ID NO: 20250 - protein, 7 aa, Artificial Sequence
  Synthetic construct
YMGYACF

SEQ ID NO: 20251 - protein, 7 aa, Artificial Sequence
  Synthetic construct
YMGYACY

SEQ ID NO: 20252 - protein, 7 aa, Artificial Sequence
  Synthetic construct
YMGYALF

SEQ ID NO: 20253 - protein, 7 aa, Artificial Sequence
  Synthetic construct
YMGYALY

SEQ ID NO: 20254 - protein, 7 aa, Artificial Sequence
  Synthetic construct
YMGYAAF

SEQ ID NO: 20255 - protein, 7 aa, Artificial Sequence
  Synthetic construct
YMGYAAY

SEQ ID NO: 20256 - protein, 7 aa, Artificial Sequence
  Synthetic construct
YMGYAQF

SEQ ID NO: 20257 - protein, 7 aa, Artificial Sequence
  Synthetic construct
YMGYAQY

SEQ ID NO: 20258 - protein, 7 aa, Artificial Sequence
  Synthetic construct
YMGYADF

SEQ ID NO: 20259 - protein, 7 aa, Artificial Sequence
  Synthetic construct
YMGYADY

SEQ ID NO: 20260 - protein, 7 aa, Artificial Sequence
  Synthetic construct
YMGYAVF

SEQ ID NO: 20261 - protein, 7 aa, Artificial Sequence
  Synthetic construct
YMGYAVY

SEQ ID NO: 20262 - protein, 7 aa, Artificial Sequence
  Synthetic construct
YMGYQFF

SEQ ID NO: 20263 - protein, 7 aa, Artificial Sequence
  Synthetic construct
YMGYQFY

SEQ ID NO: 20264 - protein, 7 aa, Artificial Sequence
  Synthetic construct
YMGYQRF

SEQ ID NO: 20265 - protein, 7 aa, Artificial Sequence
  Synthetic construct
YMGYQRY

SEQ ID NO: 20266 - protein, 7 aa, Artificial Sequence
  Synthetic construct
YMGYQCF

SEQ ID NO: 20267 - protein, 7 aa, Artificial Sequence
  Synthetic construct
YMGYQCY

SEQ ID NO: 20268 - protein, 7 aa, Artificial Sequence
  Synthetic construct
YMGYQLF

SEQ ID NO: 20269 - protein, 7 aa, Artificial Sequence
  Synthetic construct
YMGYQLY

SEQ ID NO: 20270 - protein, 7 aa, Artificial Sequence
  Synthetic construct
YMGYQAF

SEQ ID NO: 20271 - protein, 7 aa, Artificial Sequence
  Synthetic construct
YMGYQAY

SEQ ID NO: 20272 - protein, 7 aa, Artificial Sequence
  Synthetic construct
YMGYQQF

SEQ ID NO: 20273 - protein, 7 aa, Artificial Sequence
  Synthetic construct
YMGYQQY

SEQ ID NO: 20274 - protein, 7 aa, Artificial Sequence
  Synthetic construct
YMGYQDF

SEQ ID NO: 20275 - protein, 7 aa, Artificial Sequence
  Synthetic construct
YMGYQDY

SEQ ID NO: 20276 - protein, 7 aa, Artificial Sequence
  Synthetic construct
YMGYQVF

SEQ ID NO: 20277 - protein, 7 aa, Artificial Sequence
  Synthetic construct
YMGYQVY

SEQ ID NO: 20278 - protein, 7 aa, Artificial Sequence
  Synthetic construct
YMGPIFF

SEQ ID NO: 20279 - protein, 7 aa, Artificial Sequence
  Synthetic construct
YMGPIFY

SEQ ID NO: 20280 - protein, 7 aa, Artificial Sequence
  Synthetic construct
YMGPIRF

SEQ ID NO: 20281 - protein, 7 aa, Artificial Sequence
  Synthetic construct
YMGPIRY

SEQ ID NO: 20282 - protein, 7 aa, Artificial Sequence
  Synthetic construct
YMGPICF

SEQ ID NO: 20283 - protein, 7 aa, Artificial Sequence
  Synthetic construct
YMGPICY

SEQ ID NO: 20284 - protein, 7 aa, Artificial Sequence
  Synthetic construct
YMGPILF

SEQ ID NO: 20285 - protein, 7 aa, Artificial Sequence
  Synthetic construct
YMGPILY

SEQ ID NO: 20286 - protein, 7 aa, Artificial Sequence
  Synthetic construct
YMGPIAF

SEQ ID NO: 20287 - protein, 7 aa, Artificial Sequence
  Synthetic construct
YMGPIAY

SEQ ID NO: 20288 - protein, 7 aa, Artificial Sequence
  Synthetic construct
YMGPIQF

SEQ ID NO: 20289 - protein, 7 aa, Artificial Sequence
  Synthetic construct
YMGPIQY

SEQ ID NO: 20290 - protein, 7 aa, Artificial Sequence
  Synthetic construct
YMGPIDF

SEQ ID NO: 20291 - protein, 7 aa, Artificial Sequence
  Synthetic construct
YMGPIDY

SEQ ID NO: 20292 - protein, 7 aa, Artificial Sequence
  Synthetic construct
YMGPIVF

SEQ ID NO: 20293 - protein, 7 aa, Artificial Sequence
  Synthetic construct
YMGPIVY

SEQ ID NO: 20294 - protein, 7 aa, Artificial Sequence
  Synthetic construct
YMGPDFF

SEQ ID NO: 20295 - protein, 7 aa, Artificial Sequence
  Synthetic construct
YMGPDFY

SEQ ID NO: 20296 - protein, 7 aa, Artificial Sequence
  Synthetic construct
YMGPDRF

SEQ ID NO: 20297 - protein, 7 aa, Artificial Sequence
  Synthetic construct
YMGPDRY

SEQ ID NO: 20298 - protein, 7 aa, Artificial Sequence
  Synthetic construct
YMGPDCF

SEQ ID NO: 20299 - protein, 7 aa, Artificial Sequence
  Synthetic construct
YMGPDCY

SEQ ID NO: 20300 - protein, 7 aa, Artificial Sequence
  Synthetic construct
YMGPDLF

SEQ ID NO: 20301 - protein, 7 aa, Artificial Sequence
  Synthetic construct
YMGPDLY

SEQ ID NO: 20302 - protein, 7 aa, Artificial Sequence
  Synthetic construct
YMGPDAF

SEQ ID NO: 20303 - protein, 7 aa, Artificial Sequence
  Synthetic construct
YMGPDAY

SEQ ID NO: 20304 - protein, 7 aa, Artificial Sequence
  Synthetic construct
YMGPDQF

SEQ ID NO: 20305 - protein, 7 aa, Artificial Sequence
  Synthetic construct
YMGPDQY

SEQ ID NO: 20306 - protein, 7 aa, Artificial Sequence
  Synthetic construct
YMGPDDF

SEQ ID NO: 20307 - protein, 7 aa, Artificial Sequence
  Synthetic construct
YMGPDDY

SEQ ID NO: 20308 - protein, 7 aa, Artificial Sequence
  Synthetic construct
YMGPDVF

SEQ ID NO: 20309 - protein, 7 aa, Artificial Sequence
  Synthetic construct
YMGPDVY

SEQ ID NO: 20310 - protein, 7 aa, Artificial Sequence
  Synthetic construct
YMGPYFF

SEQ ID NO: 20311 - protein, 7 aa, Artificial Sequence
  Synthetic construct
YMGPYFY

SEQ ID NO: 20312 - protein, 7 aa, Artificial Sequence
  Synthetic construct
YMGPYRF

SEQ ID NO: 20313 - protein, 7 aa, Artificial Sequence
  Synthetic construct
YMGPYRY

SEQ ID NO: 20314 - protein, 7 aa, Artificial Sequence
  Synthetic construct
YMGPYCF

SEQ ID NO: 20315 - protein, 7 aa, Artificial Sequence
  Synthetic construct
YMGPYCY

SEQ ID NO: 20316 - protein, 7 aa, Artificial Sequence
  Synthetic construct
YMGPYLF

SEQ ID NO: 20317 - protein, 7 aa, Artificial Sequence
  Synthetic construct
YMGPYLY

SEQ ID NO: 20318 - protein, 7 aa, Artificial Sequence
  Synthetic construct
YMGPYAF

SEQ ID NO: 20319 - protein, 7 aa, Artificial Sequence
  Synthetic construct
YMGPYAY

SEQ ID NO: 20320 - protein, 7 aa, Artificial Sequence
  Synthetic construct
YMGPYQF

SEQ ID NO: 20321 - protein, 7 aa, Artificial Sequence
  Synthetic construct
YMGPYQY

SEQ ID NO: 20322 - protein, 7 aa, Artificial Sequence
  Synthetic construct
YMGPYDF

SEQ ID NO: 20323 - protein, 7 aa, Artificial Sequence
  Synthetic construct
YMGPYDY

SEQ ID NO: 20324 - protein, 7 aa, Artificial Sequence
  Synthetic construct
YMGPYVF

SEQ ID NO: 20325 - protein, 7 aa, Artificial Sequence
  Synthetic construct
YMGPYVY

SEQ ID NO: 20326 - protein, 7 aa, Artificial Sequence
  Synthetic construct
YMGPFFF

SEQ ID NO: 20327 - protein, 7 aa, Artificial Sequence
  Synthetic construct
YMGPFFY

SEQ ID NO: 20328 - protein, 7 aa, Artificial Sequence
  Synthetic construct
YMGPFRF

SEQ ID NO: 20329 - protein, 7 aa, Artificial Sequence
  Synthetic construct
YMGPFRY

SEQ ID NO: 20330 - protein, 7 aa, Artificial Sequence
  Synthetic construct
YMGPFCF

SEQ ID NO: 20331 - protein, 7 aa, Artificial Sequence
  Synthetic construct
YMGPFCY

SEQ ID NO: 20332 - protein, 7 aa, Artificial Sequence
  Synthetic construct
YMGPFLF

SEQ ID NO: 20333 - protein, 7 aa, Artificial Sequence
  Synthetic construct
YMGPFLY

SEQ ID NO: 20334 - protein, 7 aa, Artificial Sequence
  Synthetic construct
YMGPFAF

SEQ ID NO: 20335 - protein, 7 aa, Artificial Sequence
  Synthetic construct
YMGPFAY

SEQ ID NO: 20336 - protein, 7 aa, Artificial Sequence
  Synthetic construct
YMGPFQF

SEQ ID NO: 20337 - protein, 7 aa, Artificial Sequence
  Synthetic construct
YMGPFQY

SEQ ID NO: 20338 - protein, 7 aa, Artificial Sequence
  Synthetic construct
YMGPFDF

SEQ ID NO: 20339 - protein, 7 aa, Artificial Sequence
  Synthetic construct
YMGPFDY

SEQ ID NO: 20340 - protein, 7 aa, Artificial Sequence
  Synthetic construct
YMGPFVF

SEQ ID NO: 20341 - protein, 7 aa, Artificial Sequence
  Synthetic construct
YMGPFVY

SEQ ID NO: 20342 - protein, 7 aa, Artificial Sequence
  Synthetic construct
YMGPVFF

SEQ ID NO: 20343 - protein, 7 aa, Artificial Sequence
  Synthetic construct
YMGPVFY

SEQ ID NO: 20344 - protein, 7 aa, Artificial Sequence
  Synthetic construct
YMGPVRF

SEQ ID NO: 20345 - protein, 7 aa, Artificial Sequence
  Synthetic construct
YMGPVRY

SEQ ID NO: 20346 - protein, 7 aa, Artificial Sequence
  Synthetic construct
YMGPVCF

SEQ ID NO: 20347 - protein, 7 aa, Artificial Sequence
  Synthetic construct
YMGPVCY

SEQ ID NO: 20348 - protein, 7 aa, Artificial Sequence
  Synthetic construct
YMGPVLF

SEQ ID NO: 20349 - protein, 7 aa, Artificial Sequence
  Synthetic construct
YMGPVLY

SEQ ID NO: 20350 - protein, 7 aa, Artificial Sequence
  Synthetic construct
YMGPVAF

SEQ ID NO: 20351 - protein, 7 aa, Artificial Sequence
  Synthetic construct
YMGPVAY

SEQ ID NO: 20352 - protein, 7 aa, Artificial Sequence
  Synthetic construct
YMGPVQF

SEQ ID NO: 20353 - protein, 7 aa, Artificial Sequence
  Synthetic construct
YMGPVQY

SEQ ID NO: 20354 - protein, 7 aa, Artificial Sequence
  Synthetic construct
YMGPVDF

SEQ ID NO: 20355 - protein, 7 aa, Artificial Sequence
  Synthetic construct
YMGPVDY

SEQ ID NO: 20356 - protein, 7 aa, Artificial Sequence
  Synthetic construct
YMGPVVF

SEQ ID NO: 20357 - protein, 7 aa, Artificial Sequence
  Synthetic construct
YMGPVVY

SEQ ID NO: 20358 - protein, 7 aa, Artificial Sequence
  Synthetic construct
YMGPTFF

SEQ ID NO: 20359 - protein, 7 aa, Artificial Sequence
  Synthetic construct
YMGPTFY

SEQ ID NO: 20360 - protein, 7 aa, Artificial Sequence
  Synthetic construct
YMGPTRF

SEQ ID NO: 20361 - protein, 7 aa, Artificial Sequence
  Synthetic construct
YMGPTRY

SEQ ID NO: 20362 - protein, 7 aa, Artificial Sequence
  Synthetic construct
YMGPTCF

SEQ ID NO: 20363 - protein, 7 aa, Artificial Sequence
  Synthetic construct
YMGPTCY

SEQ ID NO: 20364 - protein, 7 aa, Artificial Sequence
  Synthetic construct
YMGPTLF

SEQ ID NO: 20365 - protein, 7 aa, Artificial Sequence
  Synthetic construct
YMGPTLY

SEQ ID NO: 20366 - protein, 7 aa, Artificial Sequence
  Synthetic construct
YMGPTAF

SEQ ID NO: 20367 - protein, 7 aa, Artificial Sequence
  Synthetic construct
YMGPTAY

SEQ ID NO: 20368 - protein, 7 aa, Artificial Sequence
  Synthetic construct
YMGPTQF

SEQ ID NO: 20369 - protein, 7 aa, Artificial Sequence
  Synthetic construct
YMGPTQY

SEQ ID NO: 20370 - protein, 7 aa, Artificial Sequence
  Synthetic construct
YMGPTDF

SEQ ID NO: 20371 - protein, 7 aa, Artificial Sequence
  Synthetic construct
YMGPTDY

SEQ ID NO: 20372 - protein, 7 aa, Artificial Sequence
  Synthetic construct
YMGPTVF

SEQ ID NO: 20373 - protein, 7 aa, Artificial Sequence
  Synthetic construct
YMGPTVY

SEQ ID NO: 20374 - protein, 7 aa, Artificial Sequence
  Synthetic construct
YMGPGFF

SEQ ID NO: 20375 - protein, 7 aa, Artificial Sequence
  Synthetic construct
YMGPGFY

SEQ ID NO: 20376 - protein, 7 aa, Artificial Sequence
  Synthetic construct
YMGPGRF

SEQ ID NO: 20377 - protein, 7 aa, Artificial Sequence
  Synthetic construct
YMGPGRY

SEQ ID NO: 20378 - protein, 7 aa, Artificial Sequence
  Synthetic construct
YMGPGCF

SEQ ID NO: 20379 - protein, 7 aa, Artificial Sequence
  Synthetic construct
YMGPGCY

SEQ ID NO: 20380 - protein, 7 aa, Artificial Sequence
  Synthetic construct
YMGPGLF

SEQ ID NO: 20381 - protein, 7 aa, Artificial Sequence
  Synthetic construct
YMGPGLY

SEQ ID NO: 20382 - protein, 7 aa, Artificial Sequence
  Synthetic construct
YMGPGAF

SEQ ID NO: 20383 - protein, 7 aa, Artificial Sequence
  Synthetic construct
YMGPGAY

SEQ ID NO: 20384 - protein, 7 aa, Artificial Sequence
  Synthetic construct
YMGPGQF

SEQ ID NO: 20385 - protein, 7 aa, Artificial Sequence
  Synthetic construct
YMGPGQY

SEQ ID NO: 20386 - protein, 7 aa, Artificial Sequence
  Synthetic construct
YMGPGDF

SEQ ID NO: 20387 - protein, 7 aa, Artificial Sequence
  Synthetic construct
YMGPGDY

SEQ ID NO: 20388 - protein, 7 aa, Artificial Sequence
  Synthetic construct
YMGPGVF

SEQ ID NO: 20389 - protein, 7 aa, Artificial Sequence
  Synthetic construct
YMGPGVY

SEQ ID NO: 20390 - protein, 7 aa, Artificial Sequence
  Synthetic construct
YMGPAFF

SEQ ID NO: 20391 - protein, 7 aa, Artificial Sequence
  Synthetic construct
YMGPAFY

SEQ ID NO: 20392 - protein, 7 aa, Artificial Sequence
  Synthetic construct
YMGPARF

SEQ ID NO: 20393 - protein, 7 aa, Artificial Sequence
  Synthetic construct
YMGPARY

SEQ ID NO: 20394 - protein, 7 aa, Artificial Sequence
  Synthetic construct
YMGPACF

SEQ ID NO: 20395 - protein, 7 aa, Artificial Sequence
  Synthetic construct
YMGPACY

SEQ ID NO: 20396 - protein, 7 aa, Artificial Sequence
  Synthetic construct
YMGPALF

SEQ ID NO: 20397 - protein, 7 aa, Artificial Sequence
  Synthetic construct
YMGPALY

SEQ ID NO: 20398 - protein, 7 aa, Artificial Sequence
  Synthetic construct
YMGPAAF

SEQ ID NO: 20399 - protein, 7 aa, Artificial Sequence
  Synthetic construct
YMGPAAY

SEQ ID NO: 20400 - protein, 7 aa, Artificial Sequence
  Synthetic construct
YMGPAQF

SEQ ID NO: 20401 - protein, 7 aa, Artificial Sequence
  Synthetic construct
YMGPAQY

SEQ ID NO: 20402 - protein, 7 aa, Artificial Sequence
  Synthetic construct
YMGPADF

SEQ ID NO: 20403 - protein, 7 aa, Artificial Sequence
  Synthetic construct
YMGPADY

SEQ ID NO: 20404 - protein, 7 aa, Artificial Sequence
  Synthetic construct
YMGPAVF

SEQ ID NO: 20405 - protein, 7 aa, Artificial Sequence
  Synthetic construct
YMGPAVY

SEQ ID NO: 20406 - protein, 7 aa, Artificial Sequence
  Synthetic construct
YMGPQFF

SEQ ID NO: 20407 - protein, 7 aa, Artificial Sequence
  Synthetic construct
YMGPQFY

SEQ ID NO: 20408 - protein, 7 aa, Artificial Sequence
  Synthetic construct
YMGPQRF

SEQ ID NO: 20409 - protein, 7 aa, Artificial Sequence
  Synthetic construct
YMGPQRY

SEQ ID NO: 20410 - protein, 7 aa, Artificial Sequence
  Synthetic construct
YMGPQCF

SEQ ID NO: 20411 - protein, 7 aa, Artificial Sequence
  Synthetic construct
YMGPQCY

SEQ ID NO: 20412 - protein, 7 aa, Artificial Sequence
  Synthetic construct
YMGPQLF

SEQ ID NO: 20413 - protein, 7 aa, Artificial Sequence
  Synthetic construct
YMGPQLY

SEQ ID NO: 20414 - protein, 7 aa, Artificial Sequence
  Synthetic construct
YMGPQAF

SEQ ID NO: 20415 - protein, 7 aa, Artificial Sequence
  Synthetic construct
YMGPQAY

SEQ ID NO: 20416 - protein, 7 aa, Artificial Sequence
  Synthetic construct
YMGPQQF

SEQ ID NO: 20417 - protein, 7 aa, Artificial Sequence
  Synthetic construct
YMGPQQY

SEQ ID NO: 20418 - protein, 7 aa, Artificial Sequence
  Synthetic construct
YMGPQDF

SEQ ID NO: 20419 - protein, 7 aa, Artificial Sequence
  Synthetic construct
YMGPQDY

SEQ ID NO: 20420 - protein, 7 aa, Artificial Sequence
  Synthetic construct
YMGPQVF

SEQ ID NO: 20421 - protein, 7 aa, Artificial Sequence
  Synthetic construct
YMGPQVY

SEQ ID NO: 20422 - protein, 7 aa, Artificial Sequence
  Synthetic construct
YMGHIFF

SEQ ID NO: 20423 - protein, 7 aa, Artificial Sequence
  Synthetic construct
YMGHIFY

SEQ ID NO: 20424 - protein, 7 aa, Artificial Sequence
  Synthetic construct
YMGHIRF

SEQ ID NO: 20425 - protein, 7 aa, Artificial Sequence
  Synthetic construct
YMGHIRY

SEQ ID NO: 20426 - protein, 7 aa, Artificial Sequence
  Synthetic construct
YMGHICF

SEQ ID NO: 20427 - protein, 7 aa, Artificial Sequence
  Synthetic construct
YMGHICY

SEQ ID NO: 20428 - protein, 7 aa, Artificial Sequence
  Synthetic construct
YMGHILF

SEQ ID NO: 20429 - protein, 7 aa, Artificial Sequence
  Synthetic construct
YMGHILY

SEQ ID NO: 20430 - protein, 7 aa, Artificial Sequence
  Synthetic construct
YMGHIAF

SEQ ID NO: 20431 - protein, 7 aa, Artificial Sequence
  Synthetic construct
YMGHIAY

SEQ ID NO: 20432 - protein, 7 aa, Artificial Sequence
  Synthetic construct
YMGHIQF

SEQ ID NO: 20433 - protein, 7 aa, Artificial Sequence
  Synthetic construct
YMGHIQY

SEQ ID NO: 20434 - protein, 7 aa, Artificial Sequence
  Synthetic construct
YMGHIDF

SEQ ID NO: 20435 - protein, 7 aa, Artificial Sequence
  Synthetic construct
YMGHIDY

SEQ ID NO: 20436 - protein, 7 aa, Artificial Sequence
  Synthetic construct
YMGHIVF

SEQ ID NO: 20437 - protein, 7 aa, Artificial Sequence
  Synthetic construct
YMGHIVY

SEQ ID NO: 20438 - protein, 7 aa, Artificial Sequence
  Synthetic construct
YMGHDFF

SEQ ID NO: 20439 - protein, 7 aa, Artificial Sequence
  Synthetic construct
YMGHDFY

SEQ ID NO: 20440 - protein, 7 aa, Artificial Sequence
  Synthetic construct
YMGHDRF

SEQ ID NO: 20441 - protein, 7 aa, Artificial Sequence
  Synthetic construct
YMGHDRY

SEQ ID NO: 20442 - protein, 7 aa, Artificial Sequence
  Synthetic construct
YMGHDCF

SEQ ID NO: 20443 - protein, 7 aa, Artificial Sequence
  Synthetic construct
YMGHDCY

SEQ ID NO: 20444 - protein, 7 aa, Artificial Sequence
  Synthetic construct
YMGHDLF

SEQ ID NO: 20445 - protein, 7 aa, Artificial Sequence
  Synthetic construct
YMGHDLY

SEQ ID NO: 20446 - protein, 7 aa, Artificial Sequence
  Synthetic construct
YMGHDAF

SEQ ID NO: 20447 - protein, 7 aa, Artificial Sequence
  Synthetic construct
YMGHDAY

SEQ ID NO: 20448 - protein, 7 aa, Artificial Sequence
  Synthetic construct
YMGHDQF

SEQ ID NO: 20449 - protein, 7 aa, Artificial Sequence
  Synthetic construct
YMGHDQY

SEQ ID NO: 20450 - protein, 7 aa, Artificial Sequence
  Synthetic construct
YMGHDDF

SEQ ID NO: 20451 - protein, 7 aa, Artificial Sequence
  Synthetic construct
YMGHDDY

SEQ ID NO: 20452 - protein, 7 aa, Artificial Sequence
  Synthetic construct
YMGHDVF

SEQ ID NO: 20453 - protein, 7 aa, Artificial Sequence
  Synthetic construct
YMGHDVY

SEQ ID NO: 20454 - protein, 7 aa, Artificial Sequence
  Synthetic construct
YMGHYFF

SEQ ID NO: 20455 - protein, 7 aa, Artificial Sequence
  Synthetic construct
YMGHYFY

SEQ ID NO: 20456 - protein, 7 aa, Artificial Sequence
  Synthetic construct
YMGHYRF

SEQ ID NO: 20457 - protein, 7 aa, Artificial Sequence
  Synthetic construct
YMGHYRY

SEQ ID NO: 20458 - protein, 7 aa, Artificial Sequence
  Synthetic construct
YMGHYCF

SEQ ID NO: 20459 - protein, 7 aa, Artificial Sequence
  Synthetic construct
YMGHYCY

SEQ ID NO: 20460 - protein, 7 aa, Artificial Sequence
  Synthetic construct
YMGHYLF

SEQ ID NO: 20461 - protein, 7 aa, Artificial Sequence
  Synthetic construct
YMGHYLY

SEQ ID NO: 20462 - protein, 7 aa, Artificial Sequence
  Synthetic construct
YMGHYAF

SEQ ID NO: 20463 - protein, 7 aa, Artificial Sequence
  Synthetic construct
YMGHYAY

SEQ ID NO: 20464 - protein, 7 aa, Artificial Sequence
  Synthetic construct
YMGHYQF

SEQ ID NO: 20465 - protein, 7 aa, Artificial Sequence
  Synthetic construct
YMGHYQY

SEQ ID NO: 20466 - protein, 7 aa, Artificial Sequence
  Synthetic construct
YMGHYDF

SEQ ID NO: 20467 - protein, 7 aa, Artificial Sequence
  Synthetic construct
YMGHYDY

SEQ ID NO: 20468 - protein, 7 aa, Artificial Sequence
  Synthetic construct
YMGHYVF

SEQ ID NO: 20469 - protein, 7 aa, Artificial Sequence
  Synthetic construct
YMGHYVY

SEQ ID NO: 20470 - protein, 7 aa, Artificial Sequence
  Synthetic construct
YMGHFFF

SEQ ID NO: 20471 - protein, 7 aa, Artificial Sequence
  Synthetic construct
YMGHFFY

SEQ ID NO: 20472 - protein, 7 aa, Artificial Sequence
  Synthetic construct
YMGHFRF

SEQ ID NO: 20473 - protein, 7 aa, Artificial Sequence
  Synthetic construct
YMGHFRY

SEQ ID NO: 20474 - protein, 7 aa, Artificial Sequence
  Synthetic construct
YMGHFCF

SEQ ID NO: 20475 - protein, 7 aa, Artificial Sequence
  Synthetic construct
YMGHFCY

SEQ ID NO: 20476 - protein, 7 aa, Artificial Sequence
  Synthetic construct
YMGHFLF

SEQ ID NO: 20477 - protein, 7 aa, Artificial Sequence
  Synthetic construct
YMGHFLY

SEQ ID NO: 20478 - protein, 7 aa, Artificial Sequence
  Synthetic construct
YMGHFAF

SEQ ID NO: 20479 - protein, 7 aa, Artificial Sequence
  Synthetic construct
YMGHFAY

SEQ ID NO: 20480 - protein, 7 aa, Artificial Sequence
  Synthetic construct
YMGHFQF

SEQ ID NO: 20481 - protein, 7 aa, Artificial Sequence
  Synthetic construct
YMGHFQY

SEQ ID NO: 20482 - protein, 7 aa, Artificial Sequence
  Synthetic construct
YMGHFDF

SEQ ID NO: 20483 - protein, 7 aa, Artificial Sequence
  Synthetic construct
YMGHFDY

SEQ ID NO: 20484 - protein, 7 aa, Artificial Sequence
  Synthetic construct
YMGHFVF

SEQ ID NO: 20485 - protein, 7 aa, Artificial Sequence
  Synthetic construct
YMGHFVY

SEQ ID NO: 20486 - protein, 7 aa, Artificial Sequence
  Synthetic construct
YMGHVFF

SEQ ID NO: 20487 - protein, 7 aa, Artificial Sequence
  Synthetic construct
YMGHVFY

SEQ ID NO: 20488 - protein, 7 aa, Artificial Sequence
  Synthetic construct
YMGHVRF

SEQ ID NO: 20489 - protein, 7 aa, Artificial Sequence
  Synthetic construct
YMGHVRY

SEQ ID NO: 20490 - protein, 7 aa, Artificial Sequence
  Synthetic construct
YMGHVCF

SEQ ID NO: 20491 - protein, 7 aa, Artificial Sequence
  Synthetic construct
YMGHVCY

SEQ ID NO: 20492 - protein, 7 aa, Artificial Sequence
  Synthetic construct
YMGHVLF

SEQ ID NO: 20493 - protein, 7 aa, Artificial Sequence
  Synthetic construct
YMGHVLY

SEQ ID NO: 20494 - protein, 7 aa, Artificial Sequence
  Synthetic construct
YMGHVAF

SEQ ID NO: 20495 - protein, 7 aa, Artificial Sequence
  Synthetic construct
YMGHVAY

SEQ ID NO: 20496 - protein, 7 aa, Artificial Sequence
  Synthetic construct
YMGHVQF

SEQ ID NO: 20497 - protein, 7 aa, Artificial Sequence
  Synthetic construct
YMGHVQY

SEQ ID NO: 20498 - protein, 7 aa, Artificial Sequence
  Synthetic construct
YMGHVDF

SEQ ID NO: 20499 - protein, 7 aa, Artificial Sequence
  Synthetic construct
YMGHVDY

SEQ ID NO: 20500 - protein, 7 aa, Artificial Sequence
  Synthetic construct
YMGHVVF

SEQ ID NO: 20501 - protein, 7 aa, Artificial Sequence
  Synthetic construct
YMGHVVY

SEQ ID NO: 20502 - protein, 7 aa, Artificial Sequence
  Synthetic construct
YMGHTFF

SEQ ID NO: 20503 - protein, 7 aa, Artificial Sequence
  Synthetic construct
YMGHTFY

SEQ ID NO: 20504 - protein, 7 aa, Artificial Sequence
  Synthetic construct
YMGHTRF

SEQ ID NO: 20505 - protein, 7 aa, Artificial Sequence
  Synthetic construct
YMGHTRY

SEQ ID NO: 20506 - protein, 7 aa, Artificial Sequence
  Synthetic construct
YMGHTCF

SEQ ID NO: 20507 - protein, 7 aa, Artificial Sequence
  Synthetic construct
YMGHTCY

SEQ ID NO: 20508 - protein, 7 aa, Artificial Sequence
  Synthetic construct
YMGHTLF

SEQ ID NO: 20509 - protein, 7 aa, Artificial Sequence
  Synthetic construct
YMGHTLY

SEQ ID NO: 20510 - protein, 7 aa, Artificial Sequence
  Synthetic construct
YMGHTAF

SEQ ID NO: 20511 - protein, 7 aa, Artificial Sequence
  Synthetic construct
YMGHTAY

SEQ ID NO: 20512 - protein, 7 aa, Artificial Sequence
  Synthetic construct
YMGHTQF

SEQ ID NO: 20513 - protein, 7 aa, Artificial Sequence
  Synthetic construct
YMGHTQY

SEQ ID NO: 20514 - protein, 7 aa, Artificial Sequence
  Synthetic construct
YMGHTDF

SEQ ID NO: 20515 - protein, 7 aa, Artificial Sequence
  Synthetic construct
YMGHTDY

SEQ ID NO: 20516 - protein, 7 aa, Artificial Sequence
  Synthetic construct
YMGHTVF

SEQ ID NO: 20517 - protein, 7 aa, Artificial Sequence
  Synthetic construct
YMGHTVY

SEQ ID NO: 20518 - protein, 7 aa, Artificial Sequence
  Synthetic construct
YMGHGFF

SEQ ID NO: 20519 - protein, 7 aa, Artificial Sequence
  Synthetic construct
YMGHGFY

SEQ ID NO: 20520 - protein, 7 aa, Artificial Sequence
  Synthetic construct
YMGHGRF

SEQ ID NO: 20521 - protein, 7 aa, Artificial Sequence
  Synthetic construct
YMGHGRY

SEQ ID NO: 20522 - protein, 7 aa, Artificial Sequence
  Synthetic construct
YMGHGCF

SEQ ID NO: 20523 - protein, 7 aa, Artificial Sequence
  Synthetic construct
YMGHGCY

SEQ ID NO: 20524 - protein, 7 aa, Artificial Sequence
  Synthetic construct
YMGHGLF

SEQ ID NO: 20525 - protein, 7 aa, Artificial Sequence
  Synthetic construct
YMGHGLY

SEQ ID NO: 20526 - protein, 7 aa, Artificial Sequence
  Synthetic construct
YMGHGAF

SEQ ID NO: 20527 - protein, 7 aa, Artificial Sequence
  Synthetic construct
YMGHGAY

SEQ ID NO: 20528 - protein, 7 aa, Artificial Sequence
  Synthetic construct
YMGHGQF

SEQ ID NO: 20529 - protein, 7 aa, Artificial Sequence
  Synthetic construct
YMGHGQY

SEQ ID NO: 20530 - protein, 7 aa, Artificial Sequence
  Synthetic construct
YMGHGDF

SEQ ID NO: 20531 - protein, 7 aa, Artificial Sequence
  Synthetic construct
YMGHGDY

SEQ ID NO: 20532 - protein, 7 aa, Artificial Sequence
  Synthetic construct
YMGHGVF

SEQ ID NO: 20533 - protein, 7 aa, Artificial Sequence
  Synthetic construct
YMGHGVY

SEQ ID NO: 20534 - protein, 7 aa, Artificial Sequence
  Synthetic construct
YMGHAFF

SEQ ID NO: 20535 - protein, 7 aa, Artificial Sequence
  Synthetic construct
YMGHAFY

SEQ ID NO: 20536 - protein, 7 aa, Artificial Sequence
  Synthetic construct
YMGHARF

SEQ ID NO: 20537 - protein, 7 aa, Artificial Sequence
  Synthetic construct
YMGHARY

SEQ ID NO: 20538 - protein, 7 aa, Artificial Sequence
  Synthetic construct
YMGHACF

SEQ ID NO: 20539 - protein, 7 aa, Artificial Sequence
  Synthetic construct
YMGHACY

SEQ ID NO: 20540 - protein, 7 aa, Artificial Sequence
  Synthetic construct
YMGHALF

SEQ ID NO: 20541 - protein, 7 aa, Artificial Sequence
  Synthetic construct
YMGHALY

SEQ ID NO: 20542 - protein, 7 aa, Artificial Sequence
  Synthetic construct
YMGHAAF

SEQ ID NO: 20543 - protein, 7 aa, Artificial Sequence
  Synthetic construct
YMGHAAY

SEQ ID NO: 20544 - protein, 7 aa, Artificial Sequence
  Synthetic construct
YMGHAQF

SEQ ID NO: 20545 - protein, 7 aa, Artificial Sequence
  Synthetic construct
YMGHAQY

SEQ ID NO: 20546 - protein, 7 aa, Artificial Sequence
  Synthetic construct
YMGHADF

SEQ ID NO: 20547 - protein, 7 aa, Artificial Sequence
  Synthetic construct
YMGHADY

SEQ ID NO: 20548 - protein, 7 aa, Artificial Sequence
  Synthetic construct
YMGHAVF

SEQ ID NO: 20549 - protein, 7 aa, Artificial Sequence
  Synthetic construct
YMGHAVY

SEQ ID NO: 20550 - protein, 7 aa, Artificial Sequence
  Synthetic construct
YMGHQFF

SEQ ID NO: 20551 - protein, 7 aa, Artificial Sequence
  Synthetic construct
YMGHQFY

SEQ ID NO: 20552 - protein, 7 aa, Artificial Sequence
  Synthetic construct
YMGHQRF

SEQ ID NO: 20553 - protein, 7 aa, Artificial Sequence
  Synthetic construct
YMGHQRY

SEQ ID NO: 20554 - protein, 7 aa, Artificial Sequence
  Synthetic construct
YMGHQCF

SEQ ID NO: 20555 - protein, 7 aa, Artificial Sequence
  Synthetic construct
YMGHQCY

SEQ ID NO: 20556 - protein, 7 aa, Artificial Sequence
  Synthetic construct
YMGHQLF

SEQ ID NO: 20557 - protein, 7 aa, Artificial Sequence
  Synthetic construct
YMGHQLY

SEQ ID NO: 20558 - protein, 7 aa, Artificial Sequence
  Synthetic construct
YMGHQAF

SEQ ID NO: 20559 - protein, 7 aa, Artificial Sequence
  Synthetic construct
YMGHQAY

SEQ ID NO: 20560 - protein, 7 aa, Artificial Sequence
  Synthetic construct
YMGHQQF

SEQ ID NO: 20561 - protein, 7 aa, Artificial Sequence
  Synthetic construct
YMGHQQY

SEQ ID NO: 20562 - protein, 7 aa, Artificial Sequence
  Synthetic construct
YMGHQDF

SEQ ID NO: 20563 - protein, 7 aa, Artificial Sequence
  Synthetic construct
YMGHQDY

SEQ ID NO: 20564 - protein, 7 aa, Artificial Sequence
  Synthetic construct
YMGHQVF

SEQ ID NO: 20565 - protein, 7 aa, Artificial Sequence
  Synthetic construct
YMGHQVY

SEQ ID NO: 20566 - protein, 7 aa, Artificial Sequence
  Synthetic construct
YMGLIFF

SEQ ID NO: 20567 - protein, 7 aa, Artificial Sequence
  Synthetic construct
YMGLIFY

SEQ ID NO: 20568 - protein, 7 aa, Artificial Sequence
  Synthetic construct
YMGLIRF

SEQ ID NO: 20569 - protein, 7 aa, Artificial Sequence
  Synthetic construct
YMGLIRY

SEQ ID NO: 20570 - protein, 7 aa, Artificial Sequence
  Synthetic construct
YMGLICF

SEQ ID NO: 20571 - protein, 7 aa, Artificial Sequence
  Synthetic construct
YMGLICY

SEQ ID NO: 20572 - protein, 7 aa, Artificial Sequence
  Synthetic construct
YMGLILF

SEQ ID NO: 20573 - protein, 7 aa, Artificial Sequence
  Synthetic construct
YMGLILY

SEQ ID NO: 20574 - protein, 7 aa, Artificial Sequence
  Synthetic construct
YMGLIAF

SEQ ID NO: 20575 - protein, 7 aa, Artificial Sequence
  Synthetic construct
YMGLIAY

SEQ ID NO: 20576 - protein, 7 aa, Artificial Sequence
  Synthetic construct
YMGLIQF

SEQ ID NO: 20577 - protein, 7 aa, Artificial Sequence
  Synthetic construct
YMGLIQY

SEQ ID NO: 20578 - protein, 7 aa, Artificial Sequence
  Synthetic construct
YMGLIDF

SEQ ID NO: 20579 - protein, 7 aa, Artificial Sequence
  Synthetic construct
YMGLIDY

SEQ ID NO: 20580 - protein, 7 aa, Artificial Sequence
  Synthetic construct
YMGLIVF

SEQ ID NO: 20581 - protein, 7 aa, Artificial Sequence
  Synthetic construct
YMGLIVY

SEQ ID NO: 20582 - protein, 7 aa, Artificial Sequence
  Synthetic construct
YMGLDFF

SEQ ID NO: 20583 - protein, 7 aa, Artificial Sequence
  Synthetic construct
YMGLDFY

SEQ ID NO: 20584 - protein, 7 aa, Artificial Sequence
  Synthetic construct
YMGLDRF

SEQ ID NO: 20585 - protein, 7 aa, Artificial Sequence
  Synthetic construct
YMGLDRY

SEQ ID NO: 20586 - protein, 7 aa, Artificial Sequence
  Synthetic construct
YMGLDCF

SEQ ID NO: 20587 - protein, 7 aa, Artificial Sequence
  Synthetic construct
YMGLDCY

SEQ ID NO: 20588 - protein, 7 aa, Artificial Sequence
  Synthetic construct
YMGLDLF

SEQ ID NO: 20589 - protein, 7 aa, Artificial Sequence
  Synthetic construct
YMGLDLY

SEQ ID NO: 20590 - protein, 7 aa, Artificial Sequence
  Synthetic construct
YMGLDAF

SEQ ID NO: 20591 - protein, 7 aa, Artificial Sequence
  Synthetic construct
YMGLDAY

SEQ ID NO: 20592 - protein, 7 aa, Artificial Sequence
  Synthetic construct
YMGLDQF

SEQ ID NO: 20593 - protein, 7 aa, Artificial Sequence
  Synthetic construct
YMGLDQY

SEQ ID NO: 20594 - protein, 7 aa, Artificial Sequence
  Synthetic construct
YMGLDDF

SEQ ID NO: 20595 - protein, 7 aa, Artificial Sequence
  Synthetic construct
YMGLDDY

SEQ ID NO: 20596 - protein, 7 aa, Artificial Sequence
  Synthetic construct
YMGLDVF

SEQ ID NO: 20597 - protein, 7 aa, Artificial Sequence
  Synthetic construct
YMGLDVY

SEQ ID NO: 20598 - protein, 7 aa, Artificial Sequence
  Synthetic construct
YMGLYFF

SEQ ID NO: 20599 - protein, 7 aa, Artificial Sequence
  Synthetic construct
YMGLYFY

SEQ ID NO: 20600 - protein, 7 aa, Artificial Sequence
  Synthetic construct
YMGLYRF

SEQ ID NO: 20601 - protein, 7 aa, Artificial Sequence
  Synthetic construct
YMGLYRY

SEQ ID NO: 20602 - protein, 7 aa, Artificial Sequence
  Synthetic construct
YMGLYCF

SEQ ID NO: 20603 - protein, 7 aa, Artificial Sequence
  Synthetic construct
YMGLYCY

SEQ ID NO: 20604 - protein, 7 aa, Artificial Sequence
  Synthetic construct
YMGLYLF

SEQ ID NO: 20605 - protein, 7 aa, Artificial Sequence
  Synthetic construct
YMGLYLY

SEQ ID NO: 20606 - protein, 7 aa, Artificial Sequence
  Synthetic construct
YMGLYAF

SEQ ID NO: 20607 - protein, 7 aa, Artificial Sequence
  Synthetic construct
YMGLYAY

SEQ ID NO: 20608 - protein, 7 aa, Artificial Sequence
  Synthetic construct
YMGLYQF

SEQ ID NO: 20609 - protein, 7 aa, Artificial Sequence
  Synthetic construct
YMGLYQY

SEQ ID NO: 20610 - protein, 7 aa, Artificial Sequence
  Synthetic construct
YMGLYDF

SEQ ID NO: 20611 - protein, 7 aa, Artificial Sequence
  Synthetic construct
YMGLYDY

SEQ ID NO: 20612 - protein, 7 aa, Artificial Sequence
  Synthetic construct
YMGLYVF

SEQ ID NO: 20613 - protein, 7 aa, Artificial Sequence
  Synthetic construct
YMGLYVY

SEQ ID NO: 20614 - protein, 7 aa, Artificial Sequence
  Synthetic construct
YMGLFFF

SEQ ID NO: 20615 - protein, 7 aa, Artificial Sequence
  Synthetic construct
YMGLFFY

SEQ ID NO: 20616 - protein, 7 aa, Artificial Sequence
  Synthetic construct
YMGLFRF

SEQ ID NO: 20617 - protein, 7 aa, Artificial Sequence
  Synthetic construct
YMGLFRY

SEQ ID NO: 20618 - protein, 7 aa, Artificial Sequence
  Synthetic construct
YMGLFCF

SEQ ID NO: 20619 - protein, 7 aa, Artificial Sequence
  Synthetic construct
YMGLFCY

SEQ ID NO: 20620 - protein, 7 aa, Artificial Sequence
  Synthetic construct
YMGLFLF

SEQ ID NO: 20621 - protein, 7 aa, Artificial Sequence
  Synthetic construct
YMGLFLY

SEQ ID NO: 20622 - protein, 7 aa, Artificial Sequence
  Synthetic construct
YMGLFAF

SEQ ID NO: 20623 - protein, 7 aa, Artificial Sequence
  Synthetic construct
YMGLFAY

SEQ ID NO: 20624 - protein, 7 aa, Artificial Sequence
  Synthetic construct
YMGLFQF

SEQ ID NO: 20625 - protein, 7 aa, Artificial Sequence
  Synthetic construct
YMGLFQY

SEQ ID NO: 20626 - protein, 7 aa, Artificial Sequence
  Synthetic construct
YMGLFDF

SEQ ID NO: 20627 - protein, 7 aa, Artificial Sequence
  Synthetic construct
YMGLFDY

SEQ ID NO: 20628 - protein, 7 aa, Artificial Sequence
  Synthetic construct
YMGLFVF

SEQ ID NO: 20629 - protein, 7 aa, Artificial Sequence
  Synthetic construct
YMGLFVY

SEQ ID NO: 20630 - protein, 7 aa, Artificial Sequence
  Synthetic construct
YMGLVFF

SEQ ID NO: 20631 - protein, 7 aa, Artificial Sequence
  Synthetic construct
YMGLVFY

SEQ ID NO: 20632 - protein, 7 aa, Artificial Sequence
  Synthetic construct
YMGLVRF

SEQ ID NO: 20633 - protein, 7 aa, Artificial Sequence
  Synthetic construct
YMGLVRY

SEQ ID NO: 20634 - protein, 7 aa, Artificial Sequence
  Synthetic construct
YMGLVCF

SEQ ID NO: 20635 - protein, 7 aa, Artificial Sequence
  Synthetic construct
YMGLVCY

SEQ ID NO: 20636 - protein, 7 aa, Artificial Sequence
  Synthetic construct
YMGLVLF

SEQ ID NO: 20637 - protein, 7 aa, Artificial Sequence
  Synthetic construct
YMGLVLY

SEQ ID NO: 20638 - protein, 7 aa, Artificial Sequence
  Synthetic construct
YMGLVAF

SEQ ID NO: 20639 - protein, 7 aa, Artificial Sequence
  Synthetic construct
YMGLVAY

SEQ ID NO: 20640 - protein, 7 aa, Artificial Sequence
  Synthetic construct
YMGLVQF

SEQ ID NO: 20641 - protein, 7 aa, Artificial Sequence
  Synthetic construct
YMGLVQY

SEQ ID NO: 20642 - protein, 7 aa, Artificial Sequence
  Synthetic construct
YMGLVDF

SEQ ID NO: 20643 - protein, 7 aa, Artificial Sequence
  Synthetic construct
YMGLVDY

SEQ ID NO: 20644 - protein, 7 aa, Artificial Sequence
  Synthetic construct
YMGLVVF

SEQ ID NO: 20645 - protein, 7 aa, Artificial Sequence
  Synthetic construct
YMGLVVY

SEQ ID NO: 20646 - protein, 7 aa, Artificial Sequence
  Synthetic construct
YMGLTFF

SEQ ID NO: 20647 - protein, 7 aa, Artificial Sequence
  Synthetic construct
YMGLTFY

SEQ ID NO: 20648 - protein, 7 aa, Artificial Sequence
  Synthetic construct
YMGLTRF

SEQ ID NO: 20649 - protein, 7 aa, Artificial Sequence
  Synthetic construct
YMGLTRY

SEQ ID NO: 20650 - protein, 7 aa, Artificial Sequence
  Synthetic construct
YMGLTCF

SEQ ID NO: 20651 - protein, 7 aa, Artificial Sequence
  Synthetic construct
YMGLTCY

SEQ ID NO: 20652 - protein, 7 aa, Artificial Sequence
  Synthetic construct
YMGLTLF

SEQ ID NO: 20653 - protein, 7 aa, Artificial Sequence
  Synthetic construct
YMGLTLY

SEQ ID NO: 20654 - protein, 7 aa, Artificial Sequence
  Synthetic construct
YMGLTAF

SEQ ID NO: 20655 - protein, 7 aa, Artificial Sequence
  Synthetic construct
YMGLTAY

SEQ ID NO: 20656 - protein, 7 aa, Artificial Sequence
  Synthetic construct
YMGLTQF

SEQ ID NO: 20657 - protein, 7 aa, Artificial Sequence
  Synthetic construct
YMGLTQY

SEQ ID NO: 20658 - protein, 7 aa, Artificial Sequence
  Synthetic construct
YMGLTDF

SEQ ID NO: 20659 - protein, 7 aa, Artificial Sequence
  Synthetic construct
YMGLTDY

SEQ ID NO: 20660 - protein, 7 aa, Artificial Sequence
  Synthetic construct
YMGLTVF

SEQ ID NO: 20661 - protein, 7 aa, Artificial Sequence
  Synthetic construct
YMGLTVY

SEQ ID NO: 20662 - protein, 7 aa, Artificial Sequence
  Synthetic construct
YMGLGFF

SEQ ID NO: 20663 - protein, 7 aa, Artificial Sequence
  Synthetic construct
YMGLGFY

SEQ ID NO: 20664 - protein, 7 aa, Artificial Sequence
  Synthetic construct
YMGLGRF

SEQ ID NO: 20665 - protein, 7 aa, Artificial Sequence
  Synthetic construct
YMGLGRY

SEQ ID NO: 20666 - protein, 7 aa, Artificial Sequence
  Synthetic construct
YMGLGCF

SEQ ID NO: 20667 - protein, 7 aa, Artificial Sequence
  Synthetic construct
YMGLGCY

SEQ ID NO: 20668 - protein, 7 aa, Artificial Sequence
  Synthetic construct
YMGLGLF

SEQ ID NO: 20669 - protein, 7 aa, Artificial Sequence
  Synthetic construct
YMGLGLY

SEQ ID NO: 20670 - protein, 7 aa, Artificial Sequence
  Synthetic construct
YMGLGAF

SEQ ID NO: 20671 - protein, 7 aa, Artificial Sequence
  Synthetic construct
YMGLGAY

SEQ ID NO: 20672 - protein, 7 aa, Artificial Sequence
  Synthetic construct
YMGLGQF

SEQ ID NO: 20673 - protein, 7 aa, Artificial Sequence
  Synthetic construct
YMGLGQY

SEQ ID NO: 20674 - protein, 7 aa, Artificial Sequence
  Synthetic construct
YMGLGDF

SEQ ID NO: 20675 - protein, 7 aa, Artificial Sequence
  Synthetic construct
YMGLGDY

SEQ ID NO: 20676 - protein, 7 aa, Artificial Sequence
  Synthetic construct
YMGLGVF

SEQ ID NO: 20677 - protein, 7 aa, Artificial Sequence
  Synthetic construct
YMGLGVY

SEQ ID NO: 20678 - protein, 7 aa, Artificial Sequence
  Synthetic construct
YMGLAFF

SEQ ID NO: 20679 - protein, 7 aa, Artificial Sequence
  Synthetic construct
YMGLAFY

SEQ ID NO: 20680 - protein, 7 aa, Artificial Sequence
  Synthetic construct
YMGLARF

SEQ ID NO: 20681 - protein, 7 aa, Artificial Sequence
  Synthetic construct
YMGLARY

SEQ ID NO: 20682 - protein, 7 aa, Artificial Sequence
  Synthetic construct
YMGLACF

SEQ ID NO: 20683 - protein, 7 aa, Artificial Sequence
  Synthetic construct
YMGLACY

SEQ ID NO: 20684 - protein, 7 aa, Artificial Sequence
  Synthetic construct
YMGLALF

SEQ ID NO: 20685 - protein, 7 aa, Artificial Sequence
  Synthetic construct
YMGLALY

SEQ ID NO: 20686 - protein, 7 aa, Artificial Sequence
  Synthetic construct
YMGLAAF

SEQ ID NO: 20687 - protein, 7 aa, Artificial Sequence
  Synthetic construct
YMGLAAY

SEQ ID NO: 20688 - protein, 7 aa, Artificial Sequence
  Synthetic construct
YMGLAQF

SEQ ID NO: 20689 - protein, 7 aa, Artificial Sequence
  Synthetic construct
YMGLAQY

SEQ ID NO: 20690 - protein, 7 aa, Artificial Sequence
  Synthetic construct
YMGLADF

SEQ ID NO: 20691 - protein, 7 aa, Artificial Sequence
  Synthetic construct
YMGLADY

SEQ ID NO: 20692 - protein, 7 aa, Artificial Sequence
  Synthetic construct
YMGLAVF

SEQ ID NO: 20693 - protein, 7 aa, Artificial Sequence
  Synthetic construct
YMGLAVY

SEQ ID NO: 20694 - protein, 7 aa, Artificial Sequence
  Synthetic construct
YMGLQFF

SEQ ID NO: 20695 - protein, 7 aa, Artificial Sequence
  Synthetic construct
YMGLQFY

SEQ ID NO: 20696 - protein, 7 aa, Artificial Sequence
  Synthetic construct
YMGLQRF

SEQ ID NO: 20697 - protein, 7 aa, Artificial Sequence
  Synthetic construct
YMGLQRY

SEQ ID NO: 20698 - protein, 7 aa, Artificial Sequence
  Synthetic construct
YMGLQCF

SEQ ID NO: 20699 - protein, 7 aa, Artificial Sequence
  Synthetic construct
YMGLQCY

SEQ ID NO: 20700 - protein, 7 aa, Artificial Sequence
  Synthetic construct
YMGLQLF

SEQ ID NO: 20701 - protein, 7 aa, Artificial Sequence
  Synthetic construct
YMGLQLY

SEQ ID NO: 20702 - protein, 7 aa, Artificial Sequence
  Synthetic construct
YMGLQAF

SEQ ID NO: 20703 - protein, 7 aa, Artificial Sequence
  Synthetic construct
YMGLQAY

SEQ ID NO: 20704 - protein, 7 aa, Artificial Sequence
  Synthetic construct
YMGLQQF

SEQ ID NO: 20705 - protein, 7 aa, Artificial Sequence
  Synthetic construct
YMGLQQY

SEQ ID NO: 20706 - protein, 7 aa, Artificial Sequence
  Synthetic construct
YMGLQDF

SEQ ID NO: 20707 - protein, 7 aa, Artificial Sequence
  Synthetic construct
YMGLQDY

SEQ ID NO: 20708 - protein, 7 aa, Artificial Sequence
  Synthetic construct
YMGLQVF

SEQ ID NO: 20709 - protein, 7 aa, Artificial Sequence
  Synthetic construct
YMGLQVY

SEQ ID NO: 20710 - protein, 7 aa, Artificial Sequence
  Synthetic construct
YMGFIFF

SEQ ID NO: 20711 - protein, 7 aa, Artificial Sequence
  Synthetic construct
YMGFIFY

SEQ ID NO: 20712 - protein, 7 aa, Artificial Sequence
  Synthetic construct
YMGFIRF

SEQ ID NO: 20713 - protein, 7 aa, Artificial Sequence
  Synthetic construct
YMGFIRY

SEQ ID NO: 20714 - protein, 7 aa, Artificial Sequence
  Synthetic construct
YMGFICF

SEQ ID NO: 20715 - protein, 7 aa, Artificial Sequence
  Synthetic construct
YMGFICY

SEQ ID NO: 20716 - protein, 7 aa, Artificial Sequence
  Synthetic construct
YMGFILF

SEQ ID NO: 20717 - protein, 7 aa, Artificial Sequence
  Synthetic construct
YMGFILY

SEQ ID NO: 20718 - protein, 7 aa, Artificial Sequence
  Synthetic construct
YMGFIAF

SEQ ID NO: 20719 - protein, 7 aa, Artificial Sequence
  Synthetic construct
YMGFIAY

SEQ ID NO: 20720 - protein, 7 aa, Artificial Sequence
  Synthetic construct
YMGFIQF

SEQ ID NO: 20721 - protein, 7 aa, Artificial Sequence
  Synthetic construct
YMGFIQY

SEQ ID NO: 20722 - protein, 7 aa, Artificial Sequence
  Synthetic construct
YMGFIDF

SEQ ID NO: 20723 - protein, 7 aa, Artificial Sequence
  Synthetic construct
YMGFIDY

SEQ ID NO: 20724 - protein, 7 aa, Artificial Sequence
  Synthetic construct
YMGFIVF

SEQ ID NO: 20725 - protein, 7 aa, Artificial Sequence
  Synthetic construct
YMGFIVY

SEQ ID NO: 20726 - protein, 7 aa, Artificial Sequence
  Synthetic construct
YMGFDFF

SEQ ID NO: 20727 - protein, 7 aa, Artificial Sequence
  Synthetic construct
YMGFDFY

SEQ ID NO: 20728 - protein, 7 aa, Artificial Sequence
  Synthetic construct
YMGFDRF

SEQ ID NO: 20729 - protein, 7 aa, Artificial Sequence
  Synthetic construct
YMGFDRY

SEQ ID NO: 20730 - protein, 7 aa, Artificial Sequence
  Synthetic construct
YMGFDCF

SEQ ID NO: 20731 - protein, 7 aa, Artificial Sequence
  Synthetic construct
YMGFDCY

SEQ ID NO: 20732 - protein, 7 aa, Artificial Sequence
  Synthetic construct
YMGFDLF

SEQ ID NO: 20733 - protein, 7 aa, Artificial Sequence
  Synthetic construct
YMGFDLY

SEQ ID NO: 20734 - protein, 7 aa, Artificial Sequence
  Synthetic construct
YMGFDAF

SEQ ID NO: 20735 - protein, 7 aa, Artificial Sequence
  Synthetic construct
YMGFDAY

SEQ ID NO: 20736 - protein, 7 aa, Artificial Sequence
  Synthetic construct
YMGFDQF

SEQ ID NO: 20737 - protein, 7 aa, Artificial Sequence
  Synthetic construct
YMGFDQY

SEQ ID NO: 20738 - protein, 7 aa, Artificial Sequence
  Synthetic construct
YMGFDDF

SEQ ID NO: 20739 - protein, 7 aa, Artificial Sequence
  Synthetic construct
YMGFDDY

SEQ ID NO: 20740 - protein, 7 aa, Artificial Sequence
  Synthetic construct
YMGFDVF

SEQ ID NO: 20741 - protein, 7 aa, Artificial Sequence
  Synthetic construct
YMGFDVY

SEQ ID NO: 20742 - protein, 7 aa, Artificial Sequence
  Synthetic construct
YMGFYFF

SEQ ID NO: 20743 - protein, 7 aa, Artificial Sequence
  Synthetic construct
YMGFYFY

SEQ ID NO: 20744 - protein, 7 aa, Artificial Sequence
  Synthetic construct
YMGFYRF

SEQ ID NO: 20745 - protein, 7 aa, Artificial Sequence
  Synthetic construct
YMGFYRY

SEQ ID NO: 20746 - protein, 7 aa, Artificial Sequence
  Synthetic construct
YMGFYCF

SEQ ID NO: 20747 - protein, 7 aa, Artificial Sequence
  Synthetic construct
YMGFYCY

SEQ ID NO: 20748 - protein, 7 aa, Artificial Sequence
  Synthetic construct
YMGFYLF

SEQ ID NO: 20749 - protein, 7 aa, Artificial Sequence
  Synthetic construct
YMGFYLY

SEQ ID NO: 20750 - protein, 7 aa, Artificial Sequence
  Synthetic construct
YMGFYAF

SEQ ID NO: 20751 - protein, 7 aa, Artificial Sequence
  Synthetic construct
YMGFYAY

SEQ ID NO: 20752 - protein, 7 aa, Artificial Sequence
  Synthetic construct
YMGFYQF

SEQ ID NO: 20753 - protein, 7 aa, Artificial Sequence
  Synthetic construct
YMGFYQY

SEQ ID NO: 20754 - protein, 7 aa, Artificial Sequence
  Synthetic construct
YMGFYDF

SEQ ID NO: 20755 - protein, 7 aa, Artificial Sequence
  Synthetic construct
YMGFYDY

SEQ ID NO: 20756 - protein, 7 aa, Artificial Sequence
  Synthetic construct
YMGFYVF

SEQ ID NO: 20757 - protein, 7 aa, Artificial Sequence
  Synthetic construct
YMGFYVY

SEQ ID NO: 20758 - protein, 7 aa, Artificial Sequence
  Synthetic construct
YMGFFFF

SEQ ID NO: 20759 - protein, 7 aa, Artificial Sequence
  Synthetic construct
YMGFFFY

SEQ ID NO: 20760 - protein, 7 aa, Artificial Sequence
  Synthetic construct
YMGFFRF

SEQ ID NO: 20761 - protein, 7 aa, Artificial Sequence
  Synthetic construct
YMGFFRY

SEQ ID NO: 20762 - protein, 7 aa, Artificial Sequence
  Synthetic construct
YMGFFCF

SEQ ID NO: 20763 - protein, 7 aa, Artificial Sequence
  Synthetic construct
YMGFFCY

SEQ ID NO: 20764 - protein, 7 aa, Artificial Sequence
  Synthetic construct
YMGFFLF

SEQ ID NO: 20765 - protein, 7 aa, Artificial Sequence
  Synthetic construct
YMGFFLY

SEQ ID NO: 20766 - protein, 7 aa, Artificial Sequence
  Synthetic construct
YMGFFAF

SEQ ID NO: 20767 - protein, 7 aa, Artificial Sequence
  Synthetic construct
YMGFFAY

SEQ ID NO: 20768 - protein, 7 aa, Artificial Sequence
  Synthetic construct
YMGFFQF

SEQ ID NO: 20769 - protein, 7 aa, Artificial Sequence
  Synthetic construct
YMGFFQY

SEQ ID NO: 20770 - protein, 7 aa, Artificial Sequence
  Synthetic construct
YMGFFDF

SEQ ID NO: 20771 - protein, 7 aa, Artificial Sequence
  Synthetic construct
YMGFFDY

SEQ ID NO: 20772 - protein, 7 aa, Artificial Sequence
  Synthetic construct
YMGFFVF

SEQ ID NO: 20773 - protein, 7 aa, Artificial Sequence
  Synthetic construct
YMGFFVY

SEQ ID NO: 20774 - protein, 7 aa, Artificial Sequence
  Synthetic construct
YMGFVFF

SEQ ID NO: 20775 - protein, 7 aa, Artificial Sequence
  Synthetic construct
YMGFVFY

SEQ ID NO: 20776 - protein, 7 aa, Artificial Sequence
  Synthetic construct
YMGFVRF

SEQ ID NO: 20777 - protein, 7 aa, Artificial Sequence
  Synthetic construct
YMGFVRY

SEQ ID NO: 20778 - protein, 7 aa, Artificial Sequence
  Synthetic construct
YMGFVCF

SEQ ID NO: 20779 - protein, 7 aa, Artificial Sequence
  Synthetic construct
YMGFVCY

SEQ ID NO: 20780 - protein, 7 aa, Artificial Sequence
  Synthetic construct
YMGFVLF

SEQ ID NO: 20781 - protein, 7 aa, Artificial Sequence
  Synthetic construct
YMGFVLY

SEQ ID NO: 20782 - protein, 7 aa, Artificial Sequence
  Synthetic construct
YMGFVAF

SEQ ID NO: 20783 - protein, 7 aa, Artificial Sequence
  Synthetic construct
YMGFVAY

SEQ ID NO: 20784 - protein, 7 aa, Artificial Sequence
  Synthetic construct
YMGFVQF

SEQ ID NO: 20785 - protein, 7 aa, Artificial Sequence
  Synthetic construct
YMGFVQY

SEQ ID NO: 20786 - protein, 7 aa, Artificial Sequence
  Synthetic construct
YMGFVDF

SEQ ID NO: 20787 - protein, 7 aa, Artificial Sequence
  Synthetic construct
YMGFVDY

SEQ ID NO: 20788 - protein, 7 aa, Artificial Sequence
  Synthetic construct
YMGFVVF

SEQ ID NO: 20789 - protein, 7 aa, Artificial Sequence
  Synthetic construct
YMGFVVY

SEQ ID NO: 20790 - protein, 7 aa, Artificial Sequence
  Synthetic construct
YMGFTFF

SEQ ID NO: 20791 - protein, 7 aa, Artificial Sequence
  Synthetic construct
YMGFTFY

SEQ ID NO: 20792 - protein, 7 aa, Artificial Sequence
  Synthetic construct
YMGFTRF

SEQ ID NO: 20793 - protein, 7 aa, Artificial Sequence
  Synthetic construct
YMGFTRY

SEQ ID NO: 20794 - protein, 7 aa, Artificial Sequence
  Synthetic construct
YMGFTCF

SEQ ID NO: 20795 - protein, 7 aa, Artificial Sequence
  Synthetic construct
YMGFTCY

SEQ ID NO: 20796 - protein, 7 aa, Artificial Sequence
  Synthetic construct
YMGFTLF

SEQ ID NO: 20797 - protein, 7 aa, Artificial Sequence
  Synthetic construct
YMGFTLY

SEQ ID NO: 20798 - protein, 7 aa, Artificial Sequence
  Synthetic construct
YMGFTAF

SEQ ID NO: 20799 - protein, 7 aa, Artificial Sequence
  Synthetic construct
YMGFTAY

SEQ ID NO: 20800 - protein, 7 aa, Artificial Sequence
  Synthetic construct
YMGFTQF

SEQ ID NO: 20801 - protein, 7 aa, Artificial Sequence
  Synthetic construct
YMGFTQY

SEQ ID NO: 20802 - protein, 7 aa, Artificial Sequence
  Synthetic construct
YMGFTDF

SEQ ID NO: 20803 - protein, 7 aa, Artificial Sequence
  Synthetic construct
YMGFTDY

SEQ ID NO: 20804 - protein, 7 aa, Artificial Sequence
  Synthetic construct
YMGFTVF

SEQ ID NO: 20805 - protein, 7 aa, Artificial Sequence
  Synthetic construct
YMGFTVY

SEQ ID NO: 20806 - protein, 7 aa, Artificial Sequence
  Synthetic construct
YMGFGFF

SEQ ID NO: 20807 - protein, 7 aa, Artificial Sequence
  Synthetic construct
YMGFGFY

SEQ ID NO: 20808 - protein, 7 aa, Artificial Sequence
  Synthetic construct
YMGFGRF

SEQ ID NO: 20809 - protein, 7 aa, Artificial Sequence
  Synthetic construct
YMGFGRY

SEQ ID NO: 20810 - protein, 7 aa, Artificial Sequence
  Synthetic construct
YMGFGCF

SEQ ID NO: 20811 - protein, 7 aa, Artificial Sequence
  Synthetic construct
YMGFGCY

SEQ ID NO: 20812 - protein, 7 aa, Artificial Sequence
  Synthetic construct
YMGFGLF

SEQ ID NO: 20813 - protein, 7 aa, Artificial Sequence
  Synthetic construct
YMGFGLY

SEQ ID NO: 20814 - protein, 7 aa, Artificial Sequence
  Synthetic construct
YMGFGAF

SEQ ID NO: 20815 - protein, 7 aa, Artificial Sequence
  Synthetic construct
YMGFGAY

SEQ ID NO: 20816 - protein, 7 aa, Artificial Sequence
  Synthetic construct
YMGFGQF

SEQ ID NO: 20817 - protein, 7 aa, Artificial Sequence
  Synthetic construct
YMGFGQY

SEQ ID NO: 20818 - protein, 7 aa, Artificial Sequence
  Synthetic construct
YMGFGDF

SEQ ID NO: 20819 - protein, 7 aa, Artificial Sequence
  Synthetic construct
YMGFGDY

SEQ ID NO: 20820 - protein, 7 aa, Artificial Sequence
  Synthetic construct
YMGFGVF

SEQ ID NO: 20821 - protein, 7 aa, Artificial Sequence
  Synthetic construct
YMGFGVY

SEQ ID NO: 20822 - protein, 7 aa, Artificial Sequence
  Synthetic construct
YMGFAFF

SEQ ID NO: 20823 - protein, 7 aa, Artificial Sequence
  Synthetic construct
YMGFAFY

SEQ ID NO: 20824 - protein, 7 aa, Artificial Sequence
  Synthetic construct
YMGFARF

SEQ ID NO: 20825 - protein, 7 aa, Artificial Sequence
  Synthetic construct
YMGFARY

SEQ ID NO: 20826 - protein, 7 aa, Artificial Sequence
  Synthetic construct
YMGFACF

SEQ ID NO: 20827 - protein, 7 aa, Artificial Sequence
  Synthetic construct
YMGFACY

SEQ ID NO: 20828 - protein, 7 aa, Artificial Sequence
  Synthetic construct
YMGFALF

SEQ ID NO: 20829 - protein, 7 aa, Artificial Sequence
  Synthetic construct
YMGFALY

SEQ ID NO: 20830 - protein, 7 aa, Artificial Sequence
  Synthetic construct
YMGFAAF

SEQ ID NO: 20831 - protein, 7 aa, Artificial Sequence
  Synthetic construct
YMGFAAY

SEQ ID NO: 20832 - protein, 7 aa, Artificial Sequence
  Synthetic construct
YMGFAQF

SEQ ID NO: 20833 - protein, 7 aa, Artificial Sequence
  Synthetic construct
YMGFAQY

SEQ ID NO: 20834 - protein, 7 aa, Artificial Sequence
  Synthetic construct
YMGFADF

SEQ ID NO: 20835 - protein, 7 aa, Artificial Sequence
  Synthetic construct
YMGFADY

SEQ ID NO: 20836 - protein, 7 aa, Artificial Sequence
  Synthetic construct
YMGFAVF

SEQ ID NO: 20837 - protein, 7 aa, Artificial Sequence
  Synthetic construct
YMGFAVY

SEQ ID NO: 20838 - protein, 7 aa, Artificial Sequence
  Synthetic construct
YMGFQFF

SEQ ID NO: 20839 - protein, 7 aa, Artificial Sequence
  Synthetic construct
YMGFQFY

SEQ ID NO: 20840 - protein, 7 aa, Artificial Sequence
  Synthetic construct
YMGFQRF

SEQ ID NO: 20841 - protein, 7 aa, Artificial Sequence
  Synthetic construct
YMGFQRY

SEQ ID NO: 20842 - protein, 7 aa, Artificial Sequence
  Synthetic construct
YMGFQCF

SEQ ID NO: 20843 - protein, 7 aa, Artificial Sequence
  Synthetic construct
YMGFQCY

SEQ ID NO: 20844 - protein, 7 aa, Artificial Sequence
  Synthetic construct
YMGFQLF

SEQ ID NO: 20845 - protein, 7 aa, Artificial Sequence
  Synthetic construct
YMGFQLY

SEQ ID NO: 20846 - protein, 7 aa, Artificial Sequence
  Synthetic construct
YMGFQAF

SEQ ID NO: 20847 - protein, 7 aa, Artificial Sequence
  Synthetic construct
YMGFQAY

SEQ ID NO: 20848 - protein, 7 aa, Artificial Sequence
  Synthetic construct
YMGFQQF

SEQ ID NO: 20849 - protein, 7 aa, Artificial Sequence
  Synthetic construct
YMGFQQY

SEQ ID NO: 20850 - protein, 7 aa, Artificial Sequence
  Synthetic construct
YMGFQDF

SEQ ID NO: 20851 - protein, 7 aa, Artificial Sequence
  Synthetic construct
YMGFQDY

SEQ ID NO: 20852 - protein, 7 aa, Artificial Sequence
  Synthetic construct
YMGFQVF

SEQ ID NO: 20853 - protein, 7 aa, Artificial Sequence
  Synthetic construct
YMGFQVY

SEQ ID NO: 20854 - protein, 7 aa, Artificial Sequence
  Synthetic construct
YSIYIFF

SEQ ID NO: 20855 - protein, 7 aa, Artificial Sequence
  Synthetic construct
YSIYIFY

SEQ ID NO: 20856 - protein, 7 aa, Artificial Sequence
  Synthetic construct
YSIYIRF

SEQ ID NO: 20857 - protein, 7 aa, Artificial Sequence
  Synthetic construct
YSIYIRY

SEQ ID NO: 20858 - protein, 7 aa, Artificial Sequence
  Synthetic construct
YSIYICF

SEQ ID NO: 20859 - protein, 7 aa, Artificial Sequence
  Synthetic construct
YSIYICY

SEQ ID NO: 20860 - protein, 7 aa, Artificial Sequence
  Synthetic construct
YSIYILF

SEQ ID NO: 20861 - protein, 7 aa, Artificial Sequence
  Synthetic construct
YSIYILY

SEQ ID NO: 20862 - protein, 7 aa, Artificial Sequence
  Synthetic construct
YSIYIAF

SEQ ID NO: 20863 - protein, 7 aa, Artificial Sequence
  Synthetic construct
YSIYIAY

SEQ ID NO: 20864 - protein, 7 aa, Artificial Sequence
  Synthetic construct
YSIYIQF

SEQ ID NO: 20865 - protein, 7 aa, Artificial Sequence
  Synthetic construct
YSIYIQY

SEQ ID NO: 20866 - protein, 7 aa, Artificial Sequence
  Synthetic construct
YSIYIDF

SEQ ID NO: 20867 - protein, 7 aa, Artificial Sequence
  Synthetic construct
YSIYIDY

SEQ ID NO: 20868 - protein, 7 aa, Artificial Sequence
  Synthetic construct
YSIYIVF

SEQ ID NO: 20869 - protein, 7 aa, Artificial Sequence
  Synthetic construct
YSIYIVY

SEQ ID NO: 20870 - protein, 7 aa, Artificial Sequence
  Synthetic construct
YSIYDFF

SEQ ID NO: 20871 - protein, 7 aa, Artificial Sequence
  Synthetic construct
YSIYDFY

SEQ ID NO: 20872 - protein, 7 aa, Artificial Sequence
  Synthetic construct
YSIYDRF

SEQ ID NO: 20873 - protein, 7 aa, Artificial Sequence
  Synthetic construct
YSIYDRY

SEQ ID NO: 20874 - protein, 7 aa, Artificial Sequence
  Synthetic construct
YSIYDCF

SEQ ID NO: 20875 - protein, 7 aa, Artificial Sequence
  Synthetic construct
YSIYDCY

SEQ ID NO: 20876 - protein, 7 aa, Artificial Sequence
  Synthetic construct
YSIYDLF

SEQ ID NO: 20877 - protein, 7 aa, Artificial Sequence
  Synthetic construct
YSIYDLY

SEQ ID NO: 20878 - protein, 7 aa, Artificial Sequence
  Synthetic construct
YSIYDAF

SEQ ID NO: 20879 - protein, 7 aa, Artificial Sequence
  Synthetic construct
YSIYDAY

SEQ ID NO: 20880 - protein, 7 aa, Artificial Sequence
  Synthetic construct
YSIYDQF

SEQ ID NO: 20881 - protein, 7 aa, Artificial Sequence
  Synthetic construct
YSIYDQY

SEQ ID NO: 20882 - protein, 7 aa, Artificial Sequence
  Synthetic construct
YSIYDDF

SEQ ID NO: 20883 - protein, 7 aa, Artificial Sequence
  Synthetic construct
YSIYDDY

SEQ ID NO: 20884 - protein, 7 aa, Artificial Sequence
  Synthetic construct
YSIYDVF

SEQ ID NO: 20885 - protein, 7 aa, Artificial Sequence
  Synthetic construct
YSIYDVY

SEQ ID NO: 20886 - protein, 7 aa, Artificial Sequence
  Synthetic construct
YSIYYFF

SEQ ID NO: 20887 - protein, 7 aa, Artificial Sequence
  Synthetic construct
YSIYYFY

SEQ ID NO: 20888 - protein, 7 aa, Artificial Sequence
  Synthetic construct
YSIYYRF

SEQ ID NO: 20889 - protein, 7 aa, Artificial Sequence
  Synthetic construct
YSIYYRY

SEQ ID NO: 20890 - protein, 7 aa, Artificial Sequence
  Synthetic construct
YSIYYCF

SEQ ID NO: 20891 - protein, 7 aa, Artificial Sequence
  Synthetic construct
YSIYYCY

SEQ ID NO: 20892 - protein, 7 aa, Artificial Sequence
  Synthetic construct
YSIYYLF

SEQ ID NO: 20893 - protein, 7 aa, Artificial Sequence
  Synthetic construct
YSIYYLY

SEQ ID NO: 20894 - protein, 7 aa, Artificial Sequence
  Synthetic construct
YSIYYAF

SEQ ID NO: 20895 - protein, 7 aa, Artificial Sequence
  Synthetic construct
YSIYYAY

SEQ ID NO: 20896 - protein, 7 aa, Artificial Sequence
  Synthetic construct
YSIYYQF

SEQ ID NO: 20897 - protein, 7 aa, Artificial Sequence
  Synthetic construct
YSIYYQY

SEQ ID NO: 20898 - protein, 7 aa, Artificial Sequence
  Synthetic construct
YSIYYDF

SEQ ID NO: 20899 - protein, 7 aa, Artificial Sequence
  Synthetic construct
YSIYYDY

SEQ ID NO: 20900 - protein, 7 aa, Artificial Sequence
  Synthetic construct
YSIYYVF

SEQ ID NO: 20901 - protein, 7 aa, Artificial Sequence
  Synthetic construct
YSIYYVY

SEQ ID NO: 20902 - protein, 7 aa, Artificial Sequence
  Synthetic construct
YSIYFFF

SEQ ID NO: 20903 - protein, 7 aa, Artificial Sequence
  Synthetic construct
YSIYFFY

SEQ ID NO: 20904 - protein, 7 aa, Artificial Sequence
  Synthetic construct
YSIYFRF

SEQ ID NO: 20905 - protein, 7 aa, Artificial Sequence
  Synthetic construct
YSIYFRY

SEQ ID NO: 20906 - protein, 7 aa, Artificial Sequence
  Synthetic construct
YSIYFCF

SEQ ID NO: 20907 - protein, 7 aa, Artificial Sequence
  Synthetic construct
YSIYFCY

SEQ ID NO: 20908 - protein, 7 aa, Artificial Sequence
  Synthetic construct
YSIYFLF

SEQ ID NO: 20909 - protein, 7 aa, Artificial Sequence
  Synthetic construct
YSIYFLY

SEQ ID NO: 20910 - protein, 7 aa, Artificial Sequence
  Synthetic construct
YSIYFAF

SEQ ID NO: 20911 - protein, 7 aa, Artificial Sequence
  Synthetic construct
YSIYFAY

SEQ ID NO: 20912 - protein, 7 aa, Artificial Sequence
  Synthetic construct
YSIYFQF

SEQ ID NO: 20913 - protein, 7 aa, Artificial Sequence
  Synthetic construct
YSIYFQY

SEQ ID NO: 20914 - protein, 7 aa, Artificial Sequence
  Synthetic construct
YSIYFDF

SEQ ID NO: 20915 - protein, 7 aa, Artificial Sequence
  Synthetic construct
YSIYFDY

SEQ ID NO: 20916 - protein, 7 aa, Artificial Sequence
  Synthetic construct
YSIYFVF

SEQ ID NO: 20917 - protein, 7 aa, Artificial Sequence
  Synthetic construct
YSIYFVY

SEQ ID NO: 20918 - protein, 7 aa, Artificial Sequence
  Synthetic construct
YSIYVFF

SEQ ID NO: 20919 - protein, 7 aa, Artificial Sequence
  Synthetic construct
YSIYVFY

SEQ ID NO: 20920 - protein, 7 aa, Artificial Sequence
  Synthetic construct
YSIYVRF

SEQ ID NO: 20921 - protein, 7 aa, Artificial Sequence
  Synthetic construct
YSIYVRY

SEQ ID NO: 20922 - protein, 7 aa, Artificial Sequence
  Synthetic construct
YSIYVCF

SEQ ID NO: 20923 - protein, 7 aa, Artificial Sequence
  Synthetic construct
YSIYVCY

SEQ ID NO: 20924 - protein, 7 aa, Artificial Sequence
  Synthetic construct
YSIYVLF

SEQ ID NO: 20925 - protein, 7 aa, Artificial Sequence
  Synthetic construct
YSIYVLY

SEQ ID NO: 20926 - protein, 7 aa, Artificial Sequence
  Synthetic construct
YSIYVAF

SEQ ID NO: 20927 - protein, 7 aa, Artificial Sequence
  Synthetic construct
YSIYVAY

SEQ ID NO: 20928 - protein, 7 aa, Artificial Sequence
  Synthetic construct
YSIYVQF

SEQ ID NO: 20929 - protein, 7 aa, Artificial Sequence
  Synthetic construct
YSIYVQY

SEQ ID NO: 20930 - protein, 7 aa, Artificial Sequence
  Synthetic construct
YSIYVDF

SEQ ID NO: 20931 - protein, 7 aa, Artificial Sequence
  Synthetic construct
YSIYVDY

SEQ ID NO: 20932 - protein, 7 aa, Artificial Sequence
  Synthetic construct
YSIYVVF

SEQ ID NO: 20933 - protein, 7 aa, Artificial Sequence
  Synthetic construct
YSIYVVY

SEQ ID NO: 20934 - protein, 7 aa, Artificial Sequence
  Synthetic construct
YSIYTFF

SEQ ID NO: 20935 - protein, 7 aa, Artificial Sequence
  Synthetic construct
YSIYTFY

SEQ ID NO: 20936 - protein, 7 aa, Artificial Sequence
  Synthetic construct
YSIYTRF

SEQ ID NO: 20937 - protein, 7 aa, Artificial Sequence
  Synthetic construct
YSIYTRY

SEQ ID NO: 20938 - protein, 7 aa, Artificial Sequence
  Synthetic construct
YSIYTCF

SEQ ID NO: 20939 - protein, 7 aa, Artificial Sequence
  Synthetic construct
YSIYTCY

SEQ ID NO: 20940 - protein, 7 aa, Artificial Sequence
  Synthetic construct
YSIYTLF

SEQ ID NO: 20941 - protein, 7 aa, Artificial Sequence
  Synthetic construct
YSIYTLY

SEQ ID NO: 20942 - protein, 7 aa, Artificial Sequence
  Synthetic construct
YSIYTAF

SEQ ID NO: 20943 - protein, 7 aa, Artificial Sequence
  Synthetic construct
YSIYTAY

SEQ ID NO: 20944 - protein, 7 aa, Artificial Sequence
  Synthetic construct
YSIYTQF

SEQ ID NO: 20945 - protein, 7 aa, Artificial Sequence
  Synthetic construct
YSIYTQY

SEQ ID NO: 20946 - protein, 7 aa, Artificial Sequence
  Synthetic construct
YSIYTDF

SEQ ID NO: 20947 - protein, 7 aa, Artificial Sequence
  Synthetic construct
YSIYTDY

SEQ ID NO: 20948 - protein, 7 aa, Artificial Sequence
  Synthetic construct
YSIYTVF

SEQ ID NO: 20949 - protein, 7 aa, Artificial Sequence
  Synthetic construct
YSIYTVY

SEQ ID NO: 20950 - protein, 7 aa, Artificial Sequence
  Synthetic construct
YSIYGFF

SEQ ID NO: 20951 - protein, 7 aa, Artificial Sequence
  Synthetic construct
YSIYGFY

SEQ ID NO: 20952 - protein, 7 aa, Artificial Sequence
  Synthetic construct
YSIYGRF

SEQ ID NO: 20953 - protein, 7 aa, Artificial Sequence
  Synthetic construct
YSIYGRY

SEQ ID NO: 20954 - protein, 7 aa, Artificial Sequence
  Synthetic construct
YSIYGCF

SEQ ID NO: 20955 - protein, 7 aa, Artificial Sequence
  Synthetic construct
YSIYGCY

SEQ ID NO: 20956 - protein, 7 aa, Artificial Sequence
  Synthetic construct
YSIYGLF

SEQ ID NO: 20957 - protein, 7 aa, Artificial Sequence
  Synthetic construct
YSIYGLY

SEQ ID NO: 20958 - protein, 7 aa, Artificial Sequence
  Synthetic construct
YSIYGAF

SEQ ID NO: 20959 - protein, 7 aa, Artificial Sequence
  Synthetic construct
YSIYGAY

SEQ ID NO: 20960 - protein, 7 aa, Artificial Sequence
  Synthetic construct
YSIYGQF

SEQ ID NO: 20961 - protein, 7 aa, Artificial Sequence
  Synthetic construct
YSIYGQY

SEQ ID NO: 20962 - protein, 7 aa, Artificial Sequence
  Synthetic construct
YSIYGDF

SEQ ID NO: 20963 - protein, 7 aa, Artificial Sequence
  Synthetic construct
YSIYGDY

SEQ ID NO: 20964 - protein, 7 aa, Artificial Sequence
  Synthetic construct
YSIYGVF

SEQ ID NO: 20965 - protein, 7 aa, Artificial Sequence
  Synthetic construct
YSIYGVY

SEQ ID NO: 20966 - protein, 7 aa, Artificial Sequence
  Synthetic construct
YSIYAFF

SEQ ID NO: 20967 - protein, 7 aa, Artificial Sequence
  Synthetic construct
YSIYAFY

SEQ ID NO: 20968 - protein, 7 aa, Artificial Sequence
  Synthetic construct
YSIYARF

SEQ ID NO: 20969 - protein, 7 aa, Artificial Sequence
  Synthetic construct
YSIYARY

SEQ ID NO: 20970 - protein, 7 aa, Artificial Sequence
  Synthetic construct
YSIYACF

SEQ ID NO: 20971 - protein, 7 aa, Artificial Sequence
  Synthetic construct
YSIYACY

SEQ ID NO: 20972 - protein, 7 aa, Artificial Sequence
  Synthetic construct
YSIYALF

SEQ ID NO: 20973 - protein, 7 aa, Artificial Sequence
  Synthetic construct
YSIYALY

SEQ ID NO: 20974 - protein, 7 aa, Artificial Sequence
  Synthetic construct
YSIYAAF

SEQ ID NO: 20975 - protein, 7 aa, Artificial Sequence
  Synthetic construct
YSIYAAY

SEQ ID NO: 20976 - protein, 7 aa, Artificial Sequence
  Synthetic construct
YSIYAQF

SEQ ID NO: 20977 - protein, 7 aa, Artificial Sequence
  Synthetic construct
YSIYAQY

SEQ ID NO: 20978 - protein, 7 aa, Artificial Sequence
  Synthetic construct
YSIYADF

SEQ ID NO: 20979 - protein, 7 aa, Artificial Sequence
  Synthetic construct
YSIYADY

SEQ ID NO: 20980 - protein, 7 aa, Artificial Sequence
  Synthetic construct
YSIYAVF

SEQ ID NO: 20981 - protein, 7 aa, Artificial Sequence
  Synthetic construct
YSIYAVY

SEQ ID NO: 20982 - protein, 7 aa, Artificial Sequence
  Synthetic construct
YSIYQFF

SEQ ID NO: 20983 - protein, 7 aa, Artificial Sequence
  Synthetic construct
YSIYQFY

SEQ ID NO: 20984 - protein, 7 aa, Artificial Sequence
  Synthetic construct
YSIYQRF

SEQ ID NO: 20985 - protein, 7 aa, Artificial Sequence
  Synthetic construct
YSIYQRY

SEQ ID NO: 20986 - protein, 7 aa, Artificial Sequence
  Synthetic construct
YSIYQCF

SEQ ID NO: 20987 - protein, 7 aa, Artificial Sequence
  Synthetic construct
YSIYQCY

SEQ ID NO: 20988 - protein, 7 aa, Artificial Sequence
  Synthetic construct
YSIYQLF

SEQ ID NO: 20989 - protein, 7 aa, Artificial Sequence
  Synthetic construct
YSIYQLY

SEQ ID NO: 20990 - protein, 7 aa, Artificial Sequence
  Synthetic construct
YSIYQAF

SEQ ID NO: 20991 - protein, 7 aa, Artificial Sequence
  Synthetic construct
YSIYQAY

SEQ ID NO: 20992 - protein, 7 aa, Artificial Sequence
  Synthetic construct
YSIYQQF

SEQ ID NO: 20993 - protein, 7 aa, Artificial Sequence
  Synthetic construct
YSIYQQY

SEQ ID NO: 20994 - protein, 7 aa, Artificial Sequence
  Synthetic construct
YSIYQDF

SEQ ID NO: 20995 - protein, 7 aa, Artificial Sequence
  Synthetic construct
YSIYQDY

SEQ ID NO: 20996 - protein, 7 aa, Artificial Sequence
  Synthetic construct
YSIYQVF

SEQ ID NO: 20997 - protein, 7 aa, Artificial Sequence
  Synthetic construct
YSIYQVY

SEQ ID NO: 20998 - protein, 7 aa, Artificial Sequence
  Synthetic construct
YSIPIFF

SEQ ID NO: 20999 - protein, 7 aa, Artificial Sequence
  Synthetic construct
YSIPIFY

SEQ ID NO: 21000 - protein, 7 aa, Artificial Sequence
  Synthetic construct
YSIPIRF

SEQ ID NO: 21001 - protein, 7 aa, Artificial Sequence
  Synthetic construct
YSIPIRY

SEQ ID NO: 21002 - protein, 7 aa, Artificial Sequence
  Synthetic construct
YSIPICF

SEQ ID NO: 21003 - protein, 7 aa, Artificial Sequence
  Synthetic construct
YSIPICY

SEQ ID NO: 21004 - protein, 7 aa, Artificial Sequence
  Synthetic construct
YSIPILF

SEQ ID NO: 21005 - protein, 7 aa, Artificial Sequence
  Synthetic construct
YSIPILY

SEQ ID NO: 21006 - protein, 7 aa, Artificial Sequence
  Synthetic construct
YSIPIAF

SEQ ID NO: 21007 - protein, 7 aa, Artificial Sequence
  Synthetic construct
YSIPIAY

SEQ ID NO: 21008 - protein, 7 aa, Artificial Sequence
  Synthetic construct
YSIPIQF

SEQ ID NO: 21009 - protein, 7 aa, Artificial Sequence
  Synthetic construct
YSIPIQY

SEQ ID NO: 21010 - protein, 7 aa, Artificial Sequence
  Synthetic construct
YSIPIDF

SEQ ID NO: 21011 - protein, 7 aa, Artificial Sequence
  Synthetic construct
YSIPIDY

SEQ ID NO: 21012 - protein, 7 aa, Artificial Sequence
  Synthetic construct
YSIPIVF

SEQ ID NO: 21013 - protein, 7 aa, Artificial Sequence
  Synthetic construct
YSIPIVY

SEQ ID NO: 21014 - protein, 7 aa, Artificial Sequence
  Synthetic construct
YSIPDFF

SEQ ID NO: 21015 - protein, 7 aa, Artificial Sequence
  Synthetic construct
YSIPDFY

SEQ ID NO: 21016 - protein, 7 aa, Artificial Sequence
  Synthetic construct
YSIPDRF

SEQ ID NO: 21017 - protein, 7 aa, Artificial Sequence
  Synthetic construct
YSIPDRY

SEQ ID NO: 21018 - protein, 7 aa, Artificial Sequence
  Synthetic construct
YSIPDCF

SEQ ID NO: 21019 - protein, 7 aa, Artificial Sequence
  Synthetic construct
YSIPDCY

SEQ ID NO: 21020 - protein, 7 aa, Artificial Sequence
  Synthetic construct
YSIPDLF

SEQ ID NO: 21021 - protein, 7 aa, Artificial Sequence
  Synthetic construct
YSIPDLY

SEQ ID NO: 21022 - protein, 7 aa, Artificial Sequence
  Synthetic construct
YSIPDAF

SEQ ID NO: 21023 - protein, 7 aa, Artificial Sequence
  Synthetic construct
YSIPDAY

SEQ ID NO: 21024 - protein, 7 aa, Artificial Sequence
  Synthetic construct
YSIPDQF

SEQ ID NO: 21025 - protein, 7 aa, Artificial Sequence
  Synthetic construct
YSIPDQY

SEQ ID NO: 21026 - protein, 7 aa, Artificial Sequence
  Synthetic construct
YSIPDDF

SEQ ID NO: 21027 - protein, 7 aa, Artificial Sequence
  Synthetic construct
YSIPDDY

SEQ ID NO: 21028 - protein, 7 aa, Artificial Sequence
  Synthetic construct
YSIPDVF

SEQ ID NO: 21029 - protein, 7 aa, Artificial Sequence
  Synthetic construct
YSIPDVY

SEQ ID NO: 21030 - protein, 7 aa, Artificial Sequence
  Synthetic construct
YSIPYFF

SEQ ID NO: 21031 - protein, 7 aa, Artificial Sequence
  Synthetic construct
YSIPYFY

SEQ ID NO: 21032 - protein, 7 aa, Artificial Sequence
  Synthetic construct
YSIPYRF

SEQ ID NO: 21033 - protein, 7 aa, Artificial Sequence
  Synthetic construct
YSIPYRY

SEQ ID NO: 21034 - protein, 7 aa, Artificial Sequence
  Synthetic construct
YSIPYCF

SEQ ID NO: 21035 - protein, 7 aa, Artificial Sequence
  Synthetic construct
YSIPYCY

SEQ ID NO: 21036 - protein, 7 aa, Artificial Sequence
  Synthetic construct
YSIPYLF

SEQ ID NO: 21037 - protein, 7 aa, Artificial Sequence
  Synthetic construct
YSIPYLY

SEQ ID NO: 21038 - protein, 7 aa, Artificial Sequence
  Synthetic construct
YSIPYAF

SEQ ID NO: 21039 - protein, 7 aa, Artificial Sequence
  Synthetic construct
YSIPYAY

SEQ ID NO: 21040 - protein, 7 aa, Artificial Sequence
  Synthetic construct
YSIPYQF

SEQ ID NO: 21041 - protein, 7 aa, Artificial Sequence
  Synthetic construct
YSIPYQY

SEQ ID NO: 21042 - protein, 7 aa, Artificial Sequence
  Synthetic construct
YSIPYDF

SEQ ID NO: 21043 - protein, 7 aa, Artificial Sequence
  Synthetic construct
YSIPYDY

SEQ ID NO: 21044 - protein, 7 aa, Artificial Sequence
  Synthetic construct
YSIPYVF

SEQ ID NO: 21045 - protein, 7 aa, Artificial Sequence
  Synthetic construct
YSIPYVY

SEQ ID NO: 21046 - protein, 7 aa, Artificial Sequence
  Synthetic construct
YSIPFFF

SEQ ID NO: 21047 - protein, 7 aa, Artificial Sequence
  Synthetic construct
YSIPFFY

SEQ ID NO: 21048 - protein, 7 aa, Artificial Sequence
  Synthetic construct
YSIPFRF

SEQ ID NO: 21049 - protein, 7 aa, Artificial Sequence
  Synthetic construct
YSIPFRY

SEQ ID NO: 21050 - protein, 7 aa, Artificial Sequence
  Synthetic construct
YSIPFCF

SEQ ID NO: 21051 - protein, 7 aa, Artificial Sequence
  Synthetic construct
YSIPFCY

SEQ ID NO: 21052 - protein, 7 aa, Artificial Sequence
  Synthetic construct
YSIPFLF

SEQ ID NO: 21053 - protein, 7 aa, Artificial Sequence
  Synthetic construct
YSIPFLY

SEQ ID NO: 21054 - protein, 7 aa, Artificial Sequence
  Synthetic construct
YSIPFAF

SEQ ID NO: 21055 - protein, 7 aa, Artificial Sequence
  Synthetic construct
YSIPFAY

SEQ ID NO: 21056 - protein, 7 aa, Artificial Sequence
  Synthetic construct
YSIPFQF

SEQ ID NO: 21057 - protein, 7 aa, Artificial Sequence
  Synthetic construct
YSIPFQY

SEQ ID NO: 21058 - protein, 7 aa, Artificial Sequence
  Synthetic construct
YSIPFDF

SEQ ID NO: 21059 - protein, 7 aa, Artificial Sequence
  Synthetic construct
YSIPFDY

SEQ ID NO: 21060 - protein, 7 aa, Artificial Sequence
  Synthetic construct
YSIPFVF

SEQ ID NO: 21061 - protein, 7 aa, Artificial Sequence
  Synthetic construct
YSIPFVY

SEQ ID NO: 21062 - protein, 7 aa, Artificial Sequence
  Synthetic construct
YSIPVFF

SEQ ID NO: 21063 - protein, 7 aa, Artificial Sequence
  Synthetic construct
YSIPVFY

SEQ ID NO: 21064 - protein, 7 aa, Artificial Sequence
  Synthetic construct
YSIPVRF

SEQ ID NO: 21065 - protein, 7 aa, Artificial Sequence
  Synthetic construct
YSIPVRY

SEQ ID NO: 21066 - protein, 7 aa, Artificial Sequence
  Synthetic construct
YSIPVCF

SEQ ID NO: 21067 - protein, 7 aa, Artificial Sequence
  Synthetic construct
YSIPVCY

SEQ ID NO: 21068 - protein, 7 aa, Artificial Sequence
  Synthetic construct
YSIPVLF

SEQ ID NO: 21069 - protein, 7 aa, Artificial Sequence
  Synthetic construct
YSIPVLY

SEQ ID NO: 21070 - protein, 7 aa, Artificial Sequence
  Synthetic construct
YSIPVAF

SEQ ID NO: 21071 - protein, 7 aa, Artificial Sequence
  Synthetic construct
YSIPVAY

SEQ ID NO: 21072 - protein, 7 aa, Artificial Sequence
  Synthetic construct
YSIPVQF

SEQ ID NO: 21073 - protein, 7 aa, Artificial Sequence
  Synthetic construct
YSIPVQY

SEQ ID NO: 21074 - protein, 7 aa, Artificial Sequence
  Synthetic construct
YSIPVDF

SEQ ID NO: 21075 - protein, 7 aa, Artificial Sequence
  Synthetic construct
YSIPVDY

SEQ ID NO: 21076 - protein, 7 aa, Artificial Sequence
  Synthetic construct
YSIPVVF

SEQ ID NO: 21077 - protein, 7 aa, Artificial Sequence
  Synthetic construct
YSIPVVY

SEQ ID NO: 21078 - protein, 7 aa, Artificial Sequence
  Synthetic construct
YSIPTFF

SEQ ID NO: 21079 - protein, 7 aa, Artificial Sequence
  Synthetic construct
YSIPTFY

SEQ ID NO: 21080 - protein, 7 aa, Artificial Sequence
  Synthetic construct
YSIPTRF

SEQ ID NO: 21081 - protein, 7 aa, Artificial Sequence
  Synthetic construct
YSIPTRY

SEQ ID NO: 21082 - protein, 7 aa, Artificial Sequence
  Synthetic construct
YSIPTCF

SEQ ID NO: 21083 - protein, 7 aa, Artificial Sequence
  Synthetic construct
YSIPTCY

SEQ ID NO: 21084 - protein, 7 aa, Artificial Sequence
  Synthetic construct
YSIPTLF

SEQ ID NO: 21085 - protein, 7 aa, Artificial Sequence
  Synthetic construct
YSIPTLY

SEQ ID NO: 21086 - protein, 7 aa, Artificial Sequence
  Synthetic construct
YSIPTAF

SEQ ID NO: 21087 - protein, 7 aa, Artificial Sequence
  Synthetic construct
YSIPTAY

SEQ ID NO: 21088 - protein, 7 aa, Artificial Sequence
  Synthetic construct
YSIPTQF

SEQ ID NO: 21089 - protein, 7 aa, Artificial Sequence
  Synthetic construct
YSIPTQY

SEQ ID NO: 21090 - protein, 7 aa, Artificial Sequence
  Synthetic construct
YSIPTDF

SEQ ID NO: 21091 - protein, 7 aa, Artificial Sequence
  Synthetic construct
YSIPTDY

SEQ ID NO: 21092 - protein, 7 aa, Artificial Sequence
  Synthetic construct
YSIPTVF

SEQ ID NO: 21093 - protein, 7 aa, Artificial Sequence
  Synthetic construct
YSIPTVY

SEQ ID NO: 21094 - protein, 7 aa, Artificial Sequence
  Synthetic construct
YSIPGFF

SEQ ID NO: 21095 - protein, 7 aa, Artificial Sequence
  Synthetic construct
YSIPGFY

SEQ ID NO: 21096 - protein, 7 aa, Artificial Sequence
  Synthetic construct
YSIPGRF

SEQ ID NO: 21097 - protein, 7 aa, Artificial Sequence
  Synthetic construct
YSIPGRY

SEQ ID NO: 21098 - protein, 7 aa, Artificial Sequence
  Synthetic construct
YSIPGCF

SEQ ID NO: 21099 - protein, 7 aa, Artificial Sequence
  Synthetic construct
YSIPGCY

SEQ ID NO: 21100 - protein, 7 aa, Artificial Sequence
  Synthetic construct
YSIPGLF

SEQ ID NO: 21101 - protein, 7 aa, Artificial Sequence
  Synthetic construct
YSIPGLY

SEQ ID NO: 21102 - protein, 7 aa, Artificial Sequence
  Synthetic construct
YSIPGAF

SEQ ID NO: 21103 - protein, 7 aa, Artificial Sequence
  Synthetic construct
YSIPGAY

SEQ ID NO: 21104 - protein, 7 aa, Artificial Sequence
  Synthetic construct
YSIPGQF

SEQ ID NO: 21105 - protein, 7 aa, Artificial Sequence
  Synthetic construct
YSIPGQY

SEQ ID NO: 21106 - protein, 7 aa, Artificial Sequence
  Synthetic construct
YSIPGDF

SEQ ID NO: 21107 - protein, 7 aa, Artificial Sequence
  Synthetic construct
YSIPGDY

SEQ ID NO: 21108 - protein, 7 aa, Artificial Sequence
  Synthetic construct
YSIPGVF

SEQ ID NO: 21109 - protein, 7 aa, Artificial Sequence
  Synthetic construct
YSIPGVY

SEQ ID NO: 21110 - protein, 7 aa, Artificial Sequence
  Synthetic construct
YSIPAFF

SEQ ID NO: 21111 - protein, 7 aa, Artificial Sequence
  Synthetic construct
YSIPAFY

SEQ ID NO: 21112 - protein, 7 aa, Artificial Sequence
  Synthetic construct
YSIPARF

SEQ ID NO: 21113 - protein, 7 aa, Artificial Sequence
  Synthetic construct
YSIPARY

SEQ ID NO: 21114 - protein, 7 aa, Artificial Sequence
  Synthetic construct
YSIPACF

SEQ ID NO: 21115 - protein, 7 aa, Artificial Sequence
  Synthetic construct
YSIPACY

SEQ ID NO: 21116 - protein, 7 aa, Artificial Sequence
  Synthetic construct
YSIPALF

SEQ ID NO: 21117 - protein, 7 aa, Artificial Sequence
  Synthetic construct
YSIPALY

SEQ ID NO: 21118 - protein, 7 aa, Artificial Sequence
  Synthetic construct
YSIPAAF

SEQ ID NO: 21119 - protein, 7 aa, Artificial Sequence
  Synthetic construct
YSIPAAY

SEQ ID NO: 21120 - protein, 7 aa, Artificial Sequence
  Synthetic construct
YSIPAQF

SEQ ID NO: 21121 - protein, 7 aa, Artificial Sequence
  Synthetic construct
YSIPAQY

SEQ ID NO: 21122 - protein, 7 aa, Artificial Sequence
  Synthetic construct
YSIPADF

SEQ ID NO: 21123 - protein, 7 aa, Artificial Sequence
  Synthetic construct
YSIPADY

SEQ ID NO: 21124 - protein, 7 aa, Artificial Sequence
  Synthetic construct
YSIPAVF

SEQ ID NO: 21125 - protein, 7 aa, Artificial Sequence
  Synthetic construct
YSIPAVY

SEQ ID NO: 21126 - protein, 7 aa, Artificial Sequence
  Synthetic construct
YSIPQFF

SEQ ID NO: 21127 - protein, 7 aa, Artificial Sequence
  Synthetic construct
YSIPQFY

SEQ ID NO: 21128 - protein, 7 aa, Artificial Sequence
  Synthetic construct
YSIPQRF

SEQ ID NO: 21129 - protein, 7 aa, Artificial Sequence
  Synthetic construct
YSIPQRY

SEQ ID NO: 21130 - protein, 7 aa, Artificial Sequence
  Synthetic construct
YSIPQCF

SEQ ID NO: 21131 - protein, 7 aa, Artificial Sequence
  Synthetic construct
YSIPQCY

SEQ ID NO: 21132 - protein, 7 aa, Artificial Sequence
  Synthetic construct
YSIPQLF

SEQ ID NO: 21133 - protein, 7 aa, Artificial Sequence
  Synthetic construct
YSIPQLY

SEQ ID NO: 21134 - protein, 7 aa, Artificial Sequence
  Synthetic construct
YSIPQAF

SEQ ID NO: 21135 - protein, 7 aa, Artificial Sequence
  Synthetic construct
YSIPQAY

SEQ ID NO: 21136 - protein, 7 aa, Artificial Sequence
  Synthetic construct
YSIPQQF

SEQ ID NO: 21137 - protein, 7 aa, Artificial Sequence
  Synthetic construct
YSIPQQY

SEQ ID NO: 21138 - protein, 7 aa, Artificial Sequence
  Synthetic construct
YSIPQDF

SEQ ID NO: 21139 - protein, 7 aa, Artificial Sequence
  Synthetic construct
YSIPQDY

SEQ ID NO: 21140 - protein, 7 aa, Artificial Sequence
  Synthetic construct
YSIPQVF

SEQ ID NO: 21141 - protein, 7 aa, Artificial Sequence
  Synthetic construct
YSIPQVY

SEQ ID NO: 21142 - protein, 7 aa, Artificial Sequence
  Synthetic construct
YSIHIFF

SEQ ID NO: 21143 - protein, 7 aa, Artificial Sequence
  Synthetic construct
YSIHIFY

SEQ ID NO: 21144 - protein, 7 aa, Artificial Sequence
  Synthetic construct
YSIHIRF

SEQ ID NO: 21145 - protein, 7 aa, Artificial Sequence
  Synthetic construct
YSIHIRY

SEQ ID NO: 21146 - protein, 7 aa, Artificial Sequence
  Synthetic construct
YSIHICF

SEQ ID NO: 21147 - protein, 7 aa, Artificial Sequence
  Synthetic construct
YSIHICY

SEQ ID NO: 21148 - protein, 7 aa, Artificial Sequence
  Synthetic construct
YSIHILF

SEQ ID NO: 21149 - protein, 7 aa, Artificial Sequence
  Synthetic construct
YSIHILY

SEQ ID NO: 21150 - protein, 7 aa, Artificial Sequence
  Synthetic construct
YSIHIAF

SEQ ID NO: 21151 - protein, 7 aa, Artificial Sequence
  Synthetic construct
YSIHIAY

SEQ ID NO: 21152 - protein, 7 aa, Artificial Sequence
  Synthetic construct
YSIHIQF

SEQ ID NO: 21153 - protein, 7 aa, Artificial Sequence
  Synthetic construct
YSIHIQY

SEQ ID NO: 21154 - protein, 7 aa, Artificial Sequence
  Synthetic construct
YSIHIDF

SEQ ID NO: 21155 - protein, 7 aa, Artificial Sequence
  Synthetic construct
YSIHIDY

SEQ ID NO: 21156 - protein, 7 aa, Artificial Sequence
  Synthetic construct
YSIHIVF

SEQ ID NO: 21157 - protein, 7 aa, Artificial Sequence
  Synthetic construct
YSIHIVY

SEQ ID NO: 21158 - protein, 7 aa, Artificial Sequence
  Synthetic construct
YSIHDFF

SEQ ID NO: 21159 - protein, 7 aa, Artificial Sequence
  Synthetic construct
YSIHDFY

SEQ ID NO: 21160 - protein, 7 aa, Artificial Sequence
  Synthetic construct
YSIHDRF

SEQ ID NO: 21161 - protein, 7 aa, Artificial Sequence
  Synthetic construct
YSIHDRY

SEQ ID NO: 21162 - protein, 7 aa, Artificial Sequence
  Synthetic construct
YSIHDCF

SEQ ID NO: 21163 - protein, 7 aa, Artificial Sequence
  Synthetic construct
YSIHDCY

SEQ ID NO: 21164 - protein, 7 aa, Artificial Sequence
  Synthetic construct
YSIHDLF

SEQ ID NO: 21165 - protein, 7 aa, Artificial Sequence
  Synthetic construct
YSIHDLY

SEQ ID NO: 21166 - protein, 7 aa, Artificial Sequence
  Synthetic construct
YSIHDAF

SEQ ID NO: 21167 - protein, 7 aa, Artificial Sequence
  Synthetic construct
YSIHDAY

SEQ ID NO: 21168 - protein, 7 aa, Artificial Sequence
  Synthetic construct
YSIHDQF

SEQ ID NO: 21169 - protein, 7 aa, Artificial Sequence
  Synthetic construct
YSIHDQY

SEQ ID NO: 21170 - protein, 7 aa, Artificial Sequence
  Synthetic construct
YSIHDDF

SEQ ID NO: 21171 - protein, 7 aa, Artificial Sequence
  Synthetic construct
YSIHDDY

SEQ ID NO: 21172 - protein, 7 aa, Artificial Sequence
  Synthetic construct
YSIHDVF

SEQ ID NO: 21173 - protein, 7 aa, Artificial Sequence
  Synthetic construct
YSIHDVY

SEQ ID NO: 21174 - protein, 7 aa, Artificial Sequence
  Synthetic construct
YSIHYFF

SEQ ID NO: 21175 - protein, 7 aa, Artificial Sequence
  Synthetic construct
YSIHYFY

SEQ ID NO: 21176 - protein, 7 aa, Artificial Sequence
  Synthetic construct
YSIHYRF

SEQ ID NO: 21177 - protein, 7 aa, Artificial Sequence
  Synthetic construct
YSIHYRY

SEQ ID NO: 21178 - protein, 7 aa, Artificial Sequence
  Synthetic construct
YSIHYCF

SEQ ID NO: 21179 - protein, 7 aa, Artificial Sequence
  Synthetic construct
YSIHYCY

SEQ ID NO: 21180 - protein, 7 aa, Artificial Sequence
  Synthetic construct
YSIHYLF

SEQ ID NO: 21181 - protein, 7 aa, Artificial Sequence
  Synthetic construct
YSIHYLY

SEQ ID NO: 21182 - protein, 7 aa, Artificial Sequence
  Synthetic construct
YSIHYAF

SEQ ID NO: 21183 - protein, 7 aa, Artificial Sequence
  Synthetic construct
YSIHYAY

SEQ ID NO: 21184 - protein, 7 aa, Artificial Sequence
  Synthetic construct
YSIHYQF

SEQ ID NO: 21185 - protein, 7 aa, Artificial Sequence
  Synthetic construct
YSIHYQY

SEQ ID NO: 21186 - protein, 7 aa, Artificial Sequence
  Synthetic construct
YSIHYDF

SEQ ID NO: 21187 - protein, 7 aa, Artificial Sequence
  Synthetic construct
YSIHYDY

SEQ ID NO: 21188 - protein, 7 aa, Artificial Sequence
  Synthetic construct
YSIHYVF

SEQ ID NO: 21189 - protein, 7 aa, Artificial Sequence
  Synthetic construct
YSIHYVY

SEQ ID NO: 21190 - protein, 7 aa, Artificial Sequence
  Synthetic construct
YSIHFFF

SEQ ID NO: 21191 - protein, 7 aa, Artificial Sequence
  Synthetic construct
YSIHFFY

SEQ ID NO: 21192 - protein, 7 aa, Artificial Sequence
  Synthetic construct
YSIHFRF

SEQ ID NO: 21193 - protein, 7 aa, Artificial Sequence
  Synthetic construct
YSIHFRY

SEQ ID NO: 21194 - protein, 7 aa, Artificial Sequence
  Synthetic construct
YSIHFCF

SEQ ID NO: 21195 - protein, 7 aa, Artificial Sequence
  Synthetic construct
YSIHFCY

SEQ ID NO: 21196 - protein, 7 aa, Artificial Sequence
  Synthetic construct
YSIHFLF

SEQ ID NO: 21197 - protein, 7 aa, Artificial Sequence
  Synthetic construct
YSIHFLY

SEQ ID NO: 21198 - protein, 7 aa, Artificial Sequence
  Synthetic construct
YSIHFAF

SEQ ID NO: 21199 - protein, 7 aa, Artificial Sequence
  Synthetic construct
YSIHFAY

SEQ ID NO: 21200 - protein, 7 aa, Artificial Sequence
  Synthetic construct
YSIHFQF

SEQ ID NO: 21201 - protein, 7 aa, Artificial Sequence
  Synthetic construct
YSIHFQY

SEQ ID NO: 21202 - protein, 7 aa, Artificial Sequence
  Synthetic construct
YSIHFDF

SEQ ID NO: 21203 - protein, 7 aa, Artificial Sequence
  Synthetic construct
YSIHFDY

SEQ ID NO: 21204 - protein, 7 aa, Artificial Sequence
  Synthetic construct
YSIHFVF

SEQ ID NO: 21205 - protein, 7 aa, Artificial Sequence
  Synthetic construct
YSIHFVY

SEQ ID NO: 21206 - protein, 7 aa, Artificial Sequence
  Synthetic construct
YSIHVFF

SEQ ID NO: 21207 - protein, 7 aa, Artificial Sequence
  Synthetic construct
YSIHVFY

SEQ ID NO: 21208 - protein, 7 aa, Artificial Sequence
  Synthetic construct
YSIHVRF

SEQ ID NO: 21209 - protein, 7 aa, Artificial Sequence
  Synthetic construct
YSIHVRY

SEQ ID NO: 21210 - protein, 7 aa, Artificial Sequence
  Synthetic construct
YSIHVCF

SEQ ID NO: 21211 - protein, 7 aa, Artificial Sequence
  Synthetic construct
YSIHVCY

SEQ ID NO: 21212 - protein, 7 aa, Artificial Sequence
  Synthetic construct
YSIHVLF

SEQ ID NO: 21213 - protein, 7 aa, Artificial Sequence
  Synthetic construct
YSIHVLY

SEQ ID NO: 21214 - protein, 7 aa, Artificial Sequence
  Synthetic construct
YSIHVAF

SEQ ID NO: 21215 - protein, 7 aa, Artificial Sequence
  Synthetic construct
YSIHVAY

SEQ ID NO: 21216 - protein, 7 aa, Artificial Sequence
  Synthetic construct
YSIHVQF

SEQ ID NO: 21217 - protein, 7 aa, Artificial Sequence
  Synthetic construct
YSIHVQY

SEQ ID NO: 21218 - protein, 7 aa, Artificial Sequence
  Synthetic construct
YSIHVDF

SEQ ID NO: 21219 - protein, 7 aa, Artificial Sequence
  Synthetic construct
YSIHVDY

SEQ ID NO: 21220 - protein, 7 aa, Artificial Sequence
  Synthetic construct
YSIHVVF

SEQ ID NO: 21221 - protein, 7 aa, Artificial Sequence
  Synthetic construct
YSIHVVY

SEQ ID NO: 21222 - protein, 7 aa, Artificial Sequence
  Synthetic construct
YSIHTFF

SEQ ID NO: 21223 - protein, 7 aa, Artificial Sequence
  Synthetic construct
YSIHTFY

SEQ ID NO: 21224 - protein, 7 aa, Artificial Sequence
  Synthetic construct
YSIHTRF

SEQ ID NO: 21225 - protein, 7 aa, Artificial Sequence
  Synthetic construct
YSIHTRY

SEQ ID NO: 21226 - protein, 7 aa, Artificial Sequence
  Synthetic construct
YSIHTCF

SEQ ID NO: 21227 - protein, 7 aa, Artificial Sequence
  Synthetic construct
YSIHTCY

SEQ ID NO: 21228 - protein, 7 aa, Artificial Sequence
  Synthetic construct
YSIHTLF

SEQ ID NO: 21229 - protein, 7 aa, Artificial Sequence
  Synthetic construct
YSIHTLY

SEQ ID NO: 21230 - protein, 7 aa, Artificial Sequence
  Synthetic construct
YSIHTAF

SEQ ID NO: 21231 - protein, 7 aa, Artificial Sequence
  Synthetic construct
YSIHTAY

SEQ ID NO: 21232 - protein, 7 aa, Artificial Sequence
  Synthetic construct
YSIHTQF

SEQ ID NO: 21233 - protein, 7 aa, Artificial Sequence
  Synthetic construct
YSIHTQY

SEQ ID NO: 21234 - protein, 7 aa, Artificial Sequence
  Synthetic construct
YSIHTDF

SEQ ID NO: 21235 - protein, 7 aa, Artificial Sequence
  Synthetic construct
YSIHTDY

SEQ ID NO: 21236 - protein, 7 aa, Artificial Sequence
  Synthetic construct
YSIHTVF

SEQ ID NO: 21237 - protein, 7 aa, Artificial Sequence
  Synthetic construct
YSIHTVY

SEQ ID NO: 21238 - protein, 7 aa, Artificial Sequence
  Synthetic construct
YSIHGFF

SEQ ID NO: 21239 - protein, 7 aa, Artificial Sequence
  Synthetic construct
YSIHGFY

SEQ ID NO: 21240 - protein, 7 aa, Artificial Sequence
  Synthetic construct
YSIHGRF

SEQ ID NO: 21241 - protein, 7 aa, Artificial Sequence
  Synthetic construct
YSIHGRY

SEQ ID NO: 21242 - protein, 7 aa, Artificial Sequence
  Synthetic construct
YSIHGCF

SEQ ID NO: 21243 - protein, 7 aa, Artificial Sequence
  Synthetic construct
YSIHGCY

SEQ ID NO: 21244 - protein, 7 aa, Artificial Sequence
  Synthetic construct
YSIHGLF

SEQ ID NO: 21245 - protein, 7 aa, Artificial Sequence
  Synthetic construct
YSIHGLY

SEQ ID NO: 21246 - protein, 7 aa, Artificial Sequence
  Synthetic construct
YSIHGAF

SEQ ID NO: 21247 - protein, 7 aa, Artificial Sequence
  Synthetic construct
YSIHGAY

SEQ ID NO: 21248 - protein, 7 aa, Artificial Sequence
  Synthetic construct
YSIHGQF

SEQ ID NO: 21249 - protein, 7 aa, Artificial Sequence
  Synthetic construct
YSIHGQY

SEQ ID NO: 21250 - protein, 7 aa, Artificial Sequence
  Synthetic construct
YSIHGDF

SEQ ID NO: 21251 - protein, 7 aa, Artificial Sequence
  Synthetic construct
YSIHGDY

SEQ ID NO: 21252 - protein, 7 aa, Artificial Sequence
  Synthetic construct
YSIHGVF

SEQ ID NO: 21253 - protein, 7 aa, Artificial Sequence
  Synthetic construct
YSIHGVY

SEQ ID NO: 21254 - protein, 7 aa, Artificial Sequence
  Synthetic construct
YSIHAFF

SEQ ID NO: 21255 - protein, 7 aa, Artificial Sequence
  Synthetic construct
YSIHAFY

SEQ ID NO: 21256 - protein, 7 aa, Artificial Sequence
  Synthetic construct
YSIHARF

SEQ ID NO: 21257 - protein, 7 aa, Artificial Sequence
  Synthetic construct
YSIHARY

SEQ ID NO: 21258 - protein, 7 aa, Artificial Sequence
  Synthetic construct
YSIHACF

SEQ ID NO: 21259 - protein, 7 aa, Artificial Sequence
  Synthetic construct
YSIHACY

SEQ ID NO: 21260 - protein, 7 aa, Artificial Sequence
  Synthetic construct
YSIHALF

SEQ ID NO: 21261 - protein, 7 aa, Artificial Sequence
  Synthetic construct
YSIHALY

SEQ ID NO: 21262 - protein, 7 aa, Artificial Sequence
  Synthetic construct
YSIHAAF

SEQ ID NO: 21263 - protein, 7 aa, Artificial Sequence
  Synthetic construct
YSIHAAY

SEQ ID NO: 21264 - protein, 7 aa, Artificial Sequence
  Synthetic construct
YSIHAQF

SEQ ID NO: 21265 - protein, 7 aa, Artificial Sequence
  Synthetic construct
YSIHAQY

SEQ ID NO: 21266 - protein, 7 aa, Artificial Sequence
  Synthetic construct
YSIHADF

SEQ ID NO: 21267 - protein, 7 aa, Artificial Sequence
  Synthetic construct
YSIHADY

SEQ ID NO: 21268 - protein, 7 aa, Artificial Sequence
  Synthetic construct
YSIHAVF

SEQ ID NO: 21269 - protein, 7 aa, Artificial Sequence
  Synthetic construct
YSIHAVY

SEQ ID NO: 21270 - protein, 7 aa, Artificial Sequence
  Synthetic construct
YSIHQFF

SEQ ID NO: 21271 - protein, 7 aa, Artificial Sequence
  Synthetic construct
YSIHQFY

SEQ ID NO: 21272 - protein, 7 aa, Artificial Sequence
  Synthetic construct
YSIHQRF

SEQ ID NO: 21273 - protein, 7 aa, Artificial Sequence
  Synthetic construct
YSIHQRY

SEQ ID NO: 21274 - protein, 7 aa, Artificial Sequence
  Synthetic construct
YSIHQCF

SEQ ID NO: 21275 - protein, 7 aa, Artificial Sequence
  Synthetic construct
YSIHQCY

SEQ ID NO: 21276 - protein, 7 aa, Artificial Sequence
  Synthetic construct
YSIHQLF

SEQ ID NO: 21277 - protein, 7 aa, Artificial Sequence
  Synthetic construct
YSIHQLY

SEQ ID NO: 21278 - protein, 7 aa, Artificial Sequence
  Synthetic construct
YSIHQAF

SEQ ID NO: 21279 - protein, 7 aa, Artificial Sequence
  Synthetic construct
YSIHQAY

SEQ ID NO: 21280 - protein, 7 aa, Artificial Sequence
  Synthetic construct
YSIHQQF

SEQ ID NO: 21281 - protein, 7 aa, Artificial Sequence
  Synthetic construct
YSIHQQY

SEQ ID NO: 21282 - protein, 7 aa, Artificial Sequence
  Synthetic construct
YSIHQDF

SEQ ID NO: 21283 - protein, 7 aa, Artificial Sequence
  Synthetic construct
YSIHQDY

SEQ ID NO: 21284 - protein, 7 aa, Artificial Sequence
  Synthetic construct
YSIHQVF

SEQ ID NO: 21285 - protein, 7 aa, Artificial Sequence
  Synthetic construct
YSIHQVY

SEQ ID NO: 21286 - protein, 7 aa, Artificial Sequence
  Synthetic construct
YSILIFF

SEQ ID NO: 21287 - protein, 7 aa, Artificial Sequence
  Synthetic construct
YSILIFY

SEQ ID NO: 21288 - protein, 7 aa, Artificial Sequence
  Synthetic construct
YSILIRF

SEQ ID NO: 21289 - protein, 7 aa, Artificial Sequence
  Synthetic construct
YSILIRY

SEQ ID NO: 21290 - protein, 7 aa, Artificial Sequence
  Synthetic construct
YSILICF

SEQ ID NO: 21291 - protein, 7 aa, Artificial Sequence
  Synthetic construct
YSILICY

SEQ ID NO: 21292 - protein, 7 aa, Artificial Sequence
  Synthetic construct
YSILILF

SEQ ID NO: 21293 - protein, 7 aa, Artificial Sequence
  Synthetic construct
YSILILY

SEQ ID NO: 21294 - protein, 7 aa, Artificial Sequence
  Synthetic construct
YSILIAF

SEQ ID NO: 21295 - protein, 7 aa, Artificial Sequence
  Synthetic construct
YSILIAY

SEQ ID NO: 21296 - protein, 7 aa, Artificial Sequence
  Synthetic construct
YSILIQF

SEQ ID NO: 21297 - protein, 7 aa, Artificial Sequence
  Synthetic construct
YSILIQY

SEQ ID NO: 21298 - protein, 7 aa, Artificial Sequence
  Synthetic construct
YSILIDF

SEQ ID NO: 21299 - protein, 7 aa, Artificial Sequence
  Synthetic construct
YSILIDY

SEQ ID NO: 21300 - protein, 7 aa, Artificial Sequence
  Synthetic construct
YSILIVF

SEQ ID NO: 21301 - protein, 7 aa, Artificial Sequence
  Synthetic construct
YSILIVY

SEQ ID NO: 21302 - protein, 7 aa, Artificial Sequence
  Synthetic construct
YSILDFF

SEQ ID NO: 21303 - protein, 7 aa, Artificial Sequence
  Synthetic construct
YSILDFY

SEQ ID NO: 21304 - protein, 7 aa, Artificial Sequence
  Synthetic construct
YSILDRF

SEQ ID NO: 21305 - protein, 7 aa, Artificial Sequence
  Synthetic construct
YSILDRY

SEQ ID NO: 21306 - protein, 7 aa, Artificial Sequence
  Synthetic construct
YSILDCF

SEQ ID NO: 21307 - protein, 7 aa, Artificial Sequence
  Synthetic construct
YSILDCY

SEQ ID NO: 21308 - protein, 7 aa, Artificial Sequence
  Synthetic construct
YSILDLF

SEQ ID NO: 21309 - protein, 7 aa, Artificial Sequence
  Synthetic construct
YSILDLY

SEQ ID NO: 21310 - protein, 7 aa, Artificial Sequence
  Synthetic construct
YSILDAF

SEQ ID NO: 21311 - protein, 7 aa, Artificial Sequence
  Synthetic construct
YSILDAY

SEQ ID NO: 21312 - protein, 7 aa, Artificial Sequence
  Synthetic construct
YSILDQF

SEQ ID NO: 21313 - protein, 7 aa, Artificial Sequence
  Synthetic construct
YSILDQY

SEQ ID NO: 21314 - protein, 7 aa, Artificial Sequence
  Synthetic construct
YSILDDF

SEQ ID NO: 21315 - protein, 7 aa, Artificial Sequence
  Synthetic construct
YSILDDY

SEQ ID NO: 21316 - protein, 7 aa, Artificial Sequence
  Synthetic construct
YSILDVF

SEQ ID NO: 21317 - protein, 7 aa, Artificial Sequence
  Synthetic construct
YSILDVY

SEQ ID NO: 21318 - protein, 7 aa, Artificial Sequence
  Synthetic construct
YSILYFF

SEQ ID NO: 21319 - protein, 7 aa, Artificial Sequence
  Synthetic construct
YSILYFY

SEQ ID NO: 21320 - protein, 7 aa, Artificial Sequence
  Synthetic construct
YSILYRF

SEQ ID NO: 21321 - protein, 7 aa, Artificial Sequence
  Synthetic construct
YSILYRY

SEQ ID NO: 21322 - protein, 7 aa, Artificial Sequence
  Synthetic construct
YSILYCF

SEQ ID NO: 21323 - protein, 7 aa, Artificial Sequence
  Synthetic construct
YSILYCY

SEQ ID NO: 21324 - protein, 7 aa, Artificial Sequence
  Synthetic construct
YSILYLF

SEQ ID NO: 21325 - protein, 7 aa, Artificial Sequence
  Synthetic construct
YSILYLY

SEQ ID NO: 21326 - protein, 7 aa, Artificial Sequence
  Synthetic construct
YSILYAF

SEQ ID NO: 21327 - protein, 7 aa, Artificial Sequence
  Synthetic construct
YSILYAY

SEQ ID NO: 21328 - protein, 7 aa, Artificial Sequence
  Synthetic construct
YSILYQF

SEQ ID NO: 21329 - protein, 7 aa, Artificial Sequence
  Synthetic construct
YSILYQY

SEQ ID NO: 21330 - protein, 7 aa, Artificial Sequence
  Synthetic construct
YSILYDF

SEQ ID NO: 21331 - protein, 7 aa, Artificial Sequence
  Synthetic construct
YSILYDY

SEQ ID NO: 21332 - protein, 7 aa, Artificial Sequence
  Synthetic construct
YSILYVF

SEQ ID NO: 21333 - protein, 7 aa, Artificial Sequence
  Synthetic construct
YSILYVY

SEQ ID NO: 21334 - protein, 7 aa, Artificial Sequence
  Synthetic construct
YSILFFF

SEQ ID NO: 21335 - protein, 7 aa, Artificial Sequence
  Synthetic construct
YSILFFY

SEQ ID NO: 21336 - protein, 7 aa, Artificial Sequence
  Synthetic construct
YSILFRF

SEQ ID NO: 21337 - protein, 7 aa, Artificial Sequence
  Synthetic construct
YSILFRY

SEQ ID NO: 21338 - protein, 7 aa, Artificial Sequence
  Synthetic construct
YSILFCF

SEQ ID NO: 21339 - protein, 7 aa, Artificial Sequence
  Synthetic construct
YSILFCY

SEQ ID NO: 21340 - protein, 7 aa, Artificial Sequence
  Synthetic construct
YSILFLF

SEQ ID NO: 21341 - protein, 7 aa, Artificial Sequence
  Synthetic construct
YSILFLY

SEQ ID NO: 21342 - protein, 7 aa, Artificial Sequence
  Synthetic construct
YSILFAF

SEQ ID NO: 21343 - protein, 7 aa, Artificial Sequence
  Synthetic construct
YSILFAY

SEQ ID NO: 21344 - protein, 7 aa, Artificial Sequence
  Synthetic construct
YSILFQF

SEQ ID NO: 21345 - protein, 7 aa, Artificial Sequence
  Synthetic construct
YSILFQY

SEQ ID NO: 21346 - protein, 7 aa, Artificial Sequence
  Synthetic construct
YSILFDF

SEQ ID NO: 21347 - protein, 7 aa, Artificial Sequence
  Synthetic construct
YSILFDY

SEQ ID NO: 21348 - protein, 7 aa, Artificial Sequence
  Synthetic construct
YSILFVF

SEQ ID NO: 21349 - protein, 7 aa, Artificial Sequence
  Synthetic construct
YSILFVY

SEQ ID NO: 21350 - protein, 7 aa, Artificial Sequence
  Synthetic construct
YSILVFF

SEQ ID NO: 21351 - protein, 7 aa, Artificial Sequence
  Synthetic construct
YSILVFY

SEQ ID NO: 21352 - protein, 7 aa, Artificial Sequence
  Synthetic construct
YSILVRF

SEQ ID NO: 21353 - protein, 7 aa, Artificial Sequence
  Synthetic construct
YSILVRY

SEQ ID NO: 21354 - protein, 7 aa, Artificial Sequence
  Synthetic construct
YSILVCF

SEQ ID NO: 21355 - protein, 7 aa, Artificial Sequence
  Synthetic construct
YSILVCY

SEQ ID NO: 21356 - protein, 7 aa, Artificial Sequence
  Synthetic construct
YSILVLF

SEQ ID NO: 21357 - protein, 7 aa, Artificial Sequence
  Synthetic construct
YSILVLY

SEQ ID NO: 21358 - protein, 7 aa, Artificial Sequence
  Synthetic construct
YSILVAF

SEQ ID NO: 21359 - protein, 7 aa, Artificial Sequence
  Synthetic construct
YSILVAY

SEQ ID NO: 21360 - protein, 7 aa, Artificial Sequence
  Synthetic construct
YSILVQF

SEQ ID NO: 21361 - protein, 7 aa, Artificial Sequence
  Synthetic construct
YSILVQY

SEQ ID NO: 21362 - protein, 7 aa, Artificial Sequence
  Synthetic construct
YSILVDF

SEQ ID NO: 21363 - protein, 7 aa, Artificial Sequence
  Synthetic construct
YSILVDY

SEQ ID NO: 21364 - protein, 7 aa, Artificial Sequence
  Synthetic construct
YSILVVF

SEQ ID NO: 21365 - protein, 7 aa, Artificial Sequence
  Synthetic construct
YSILVVY

SEQ ID NO: 21366 - protein, 7 aa, Artificial Sequence
  Synthetic construct
YSILTFF

SEQ ID NO: 21367 - protein, 7 aa, Artificial Sequence
  Synthetic construct
YSILTFY

SEQ ID NO: 21368 - protein, 7 aa, Artificial Sequence
  Synthetic construct
YSILTRF

SEQ ID NO: 21369 - protein, 7 aa, Artificial Sequence
  Synthetic construct
YSILTRY

SEQ ID NO: 21370 - protein, 7 aa, Artificial Sequence
  Synthetic construct
YSILTCF

SEQ ID NO: 21371 - protein, 7 aa, Artificial Sequence
  Synthetic construct
YSILTCY

SEQ ID NO: 21372 - protein, 7 aa, Artificial Sequence
  Synthetic construct
YSILTLF

SEQ ID NO: 21373 - protein, 7 aa, Artificial Sequence
  Synthetic construct
YSILTLY

SEQ ID NO: 21374 - protein, 7 aa, Artificial Sequence
  Synthetic construct
YSILTAF

SEQ ID NO: 21375 - protein, 7 aa, Artificial Sequence
  Synthetic construct
YSILTAY

SEQ ID NO: 21376 - protein, 7 aa, Artificial Sequence
  Synthetic construct
YSILTQF

SEQ ID NO: 21377 - protein, 7 aa, Artificial Sequence
  Synthetic construct
YSILTQY

SEQ ID NO: 21378 - protein, 7 aa, Artificial Sequence
  Synthetic construct
YSILTDF

SEQ ID NO: 21379 - protein, 7 aa, Artificial Sequence
  Synthetic construct
YSILTDY

SEQ ID NO: 21380 - protein, 7 aa, Artificial Sequence
  Synthetic construct
YSILTVF

SEQ ID NO: 21381 - protein, 7 aa, Artificial Sequence
  Synthetic construct
YSILTVY

SEQ ID NO: 21382 - protein, 7 aa, Artificial Sequence
  Synthetic construct
YSILGFF

SEQ ID NO: 21383 - protein, 7 aa, Artificial Sequence
  Synthetic construct
YSILGFY

SEQ ID NO: 21384 - protein, 7 aa, Artificial Sequence
  Synthetic construct
YSILGRF

SEQ ID NO: 21385 - protein, 7 aa, Artificial Sequence
  Synthetic construct
YSILGRY

SEQ ID NO: 21386 - protein, 7 aa, Artificial Sequence
  Synthetic construct
YSILGCF

SEQ ID NO: 21387 - protein, 7 aa, Artificial Sequence
  Synthetic construct
YSILGCY

SEQ ID NO: 21388 - protein, 7 aa, Artificial Sequence
  Synthetic construct
YSILGLF

SEQ ID NO: 21389 - protein, 7 aa, Artificial Sequence
  Synthetic construct
YSILGLY

SEQ ID NO: 21390 - protein, 7 aa, Artificial Sequence
  Synthetic construct
YSILGAF

SEQ ID NO: 21391 - protein, 7 aa, Artificial Sequence
  Synthetic construct
YSILGAY

SEQ ID NO: 21392 - protein, 7 aa, Artificial Sequence
  Synthetic construct
YSILGQF

SEQ ID NO: 21393 - protein, 7 aa, Artificial Sequence
  Synthetic construct
YSILGQY

SEQ ID NO: 21394 - protein, 7 aa, Artificial Sequence
  Synthetic construct
YSILGDF

SEQ ID NO: 21395 - protein, 7 aa, Artificial Sequence
  Synthetic construct
YSILGDY

SEQ ID NO: 21396 - protein, 7 aa, Artificial Sequence
  Synthetic construct
YSILGVF

SEQ ID NO: 21397 - protein, 7 aa, Artificial Sequence
  Synthetic construct
YSILGVY

SEQ ID NO: 21398 - protein, 7 aa, Artificial Sequence
  Synthetic construct
YSILAFF

SEQ ID NO: 21399 - protein, 7 aa, Artificial Sequence
  Synthetic construct
YSILAFY

SEQ ID NO: 21400 - protein, 7 aa, Artificial Sequence
  Synthetic construct
YSILARF

SEQ ID NO: 21401 - protein, 7 aa, Artificial Sequence
  Synthetic construct
YSILARY

SEQ ID NO: 21402 - protein, 7 aa, Artificial Sequence
  Synthetic construct
YSILACF

SEQ ID NO: 21403 - protein, 7 aa, Artificial Sequence
  Synthetic construct
YSILACY

SEQ ID NO: 21404 - protein, 7 aa, Artificial Sequence
  Synthetic construct
YSILALF

SEQ ID NO: 21405 - protein, 7 aa, Artificial Sequence
  Synthetic construct
YSILALY

SEQ ID NO: 21406 - protein, 7 aa, Artificial Sequence
  Synthetic construct
YSILAAF

SEQ ID NO: 21407 - protein, 7 aa, Artificial Sequence
  Synthetic construct
YSILAAY

SEQ ID NO: 21408 - protein, 7 aa, Artificial Sequence
  Synthetic construct
YSILAQF

SEQ ID NO: 21409 - protein, 7 aa, Artificial Sequence
  Synthetic construct
YSILAQY

SEQ ID NO: 21410 - protein, 7 aa, Artificial Sequence
  Synthetic construct
YSILADF

SEQ ID NO: 21411 - protein, 7 aa, Artificial Sequence
  Synthetic construct
YSILADY

SEQ ID NO: 21412 - protein, 7 aa, Artificial Sequence
  Synthetic construct
YSILAVF

SEQ ID NO: 21413 - protein, 7 aa, Artificial Sequence
  Synthetic construct
YSILAVY

SEQ ID NO: 21414 - protein, 7 aa, Artificial Sequence
  Synthetic construct
YSILQFF

SEQ ID NO: 21415 - protein, 7 aa, Artificial Sequence
  Synthetic construct
YSILQFY

SEQ ID NO: 21416 - protein, 7 aa, Artificial Sequence
  Synthetic construct
YSILQRF

SEQ ID NO: 21417 - protein, 7 aa, Artificial Sequence
  Synthetic construct
YSILQRY

SEQ ID NO: 21418 - protein, 7 aa, Artificial Sequence
  Synthetic construct
YSILQCF

SEQ ID NO: 21419 - protein, 7 aa, Artificial Sequence
  Synthetic construct
YSILQCY

SEQ ID NO: 21420 - protein, 7 aa, Artificial Sequence
  Synthetic construct
YSILQLF

SEQ ID NO: 21421 - protein, 7 aa, Artificial Sequence
  Synthetic construct
YSILQLY

SEQ ID NO: 21422 - protein, 7 aa, Artificial Sequence
  Synthetic construct
YSILQAF

SEQ ID NO: 21423 - protein, 7 aa, Artificial Sequence
  Synthetic construct
YSILQAY

SEQ ID NO: 21424 - protein, 7 aa, Artificial Sequence
  Synthetic construct
YSILQQF

SEQ ID NO: 21425 - protein, 7 aa, Artificial Sequence
  Synthetic construct
YSILQQY

SEQ ID NO: 21426 - protein, 7 aa, Artificial Sequence
  Synthetic construct
YSILQDF

SEQ ID NO: 21427 - protein, 7 aa, Artificial Sequence
  Synthetic construct
YSILQDY

SEQ ID NO: 21428 - protein, 7 aa, Artificial Sequence
  Synthetic construct
YSILQVF

SEQ ID NO: 21429 - protein, 7 aa, Artificial Sequence
  Synthetic construct
YSILQVY

SEQ ID NO: 21430 - protein, 7 aa, Artificial Sequence
  Synthetic construct
YSIFIFF

SEQ ID NO: 21431 - protein, 7 aa, Artificial Sequence
  Synthetic construct
YSIFIFY

SEQ ID NO: 21432 - protein, 7 aa, Artificial Sequence
  Synthetic construct
YSIFIRF

SEQ ID NO: 21433 - protein, 7 aa, Artificial Sequence
  Synthetic construct
YSIFIRY

SEQ ID NO: 21434 - protein, 7 aa, Artificial Sequence
  Synthetic construct
YSIFICF

SEQ ID NO: 21435 - protein, 7 aa, Artificial Sequence
  Synthetic construct
YSIFICY

SEQ ID NO: 21436 - protein, 7 aa, Artificial Sequence
  Synthetic construct
YSIFILF

SEQ ID NO: 21437 - protein, 7 aa, Artificial Sequence
  Synthetic construct
YSIFILY

SEQ ID NO: 21438 - protein, 7 aa, Artificial Sequence
  Synthetic construct
YSIFIAF

SEQ ID NO: 21439 - protein, 7 aa, Artificial Sequence
  Synthetic construct
YSIFIAY

SEQ ID NO: 21440 - protein, 7 aa, Artificial Sequence
  Synthetic construct
YSIFIQF

SEQ ID NO: 21441 - protein, 7 aa, Artificial Sequence
  Synthetic construct
YSIFIQY

SEQ ID NO: 21442 - protein, 7 aa, Artificial Sequence
  Synthetic construct
YSIFIDF

SEQ ID NO: 21443 - protein, 7 aa, Artificial Sequence
  Synthetic construct
YSIFIDY

SEQ ID NO: 21444 - protein, 7 aa, Artificial Sequence
  Synthetic construct
YSIFIVF

SEQ ID NO: 21445 - protein, 7 aa, Artificial Sequence
  Synthetic construct
YSIFIVY

SEQ ID NO: 21446 - protein, 7 aa, Artificial Sequence
  Synthetic construct
YSIFDFF

SEQ ID NO: 21447 - protein, 7 aa, Artificial Sequence
  Synthetic construct
YSIFDFY

SEQ ID NO: 21448 - protein, 7 aa, Artificial Sequence
  Synthetic construct
YSIFDRF

SEQ ID NO: 21449 - protein, 7 aa, Artificial Sequence
  Synthetic construct
YSIFDRY

SEQ ID NO: 21450 - protein, 7 aa, Artificial Sequence
  Synthetic construct
YSIFDCF

SEQ ID NO: 21451 - protein, 7 aa, Artificial Sequence
  Synthetic construct
YSIFDCY

SEQ ID NO: 21452 - protein, 7 aa, Artificial Sequence
  Synthetic construct
YSIFDLF

SEQ ID NO: 21453 - protein, 7 aa, Artificial Sequence
  Synthetic construct
YSIFDLY

SEQ ID NO: 21454 - protein, 7 aa, Artificial Sequence
  Synthetic construct
YSIFDAF

SEQ ID NO: 21455 - protein, 7 aa, Artificial Sequence
  Synthetic construct
YSIFDAY

SEQ ID NO: 21456 - protein, 7 aa, Artificial Sequence
  Synthetic construct
YSIFDQF

SEQ ID NO: 21457 - protein, 7 aa, Artificial Sequence
  Synthetic construct
YSIFDQY

SEQ ID NO: 21458 - protein, 7 aa, Artificial Sequence
  Synthetic construct
YSIFDDF

SEQ ID NO: 21459 - protein, 7 aa, Artificial Sequence
  Synthetic construct
YSIFDDY

SEQ ID NO: 21460 - protein, 7 aa, Artificial Sequence
  Synthetic construct
YSIFDVF

SEQ ID NO: 21461 - protein, 7 aa, Artificial Sequence
  Synthetic construct
YSIFDVY

SEQ ID NO: 21462 - protein, 7 aa, Artificial Sequence
  Synthetic construct
YSIFYFF

SEQ ID NO: 21463 - protein, 7 aa, Artificial Sequence
  Synthetic construct
YSIFYFY

SEQ ID NO: 21464 - protein, 7 aa, Artificial Sequence
  Synthetic construct
YSIFYRF

SEQ ID NO: 21465 - protein, 7 aa, Artificial Sequence
  Synthetic construct
YSIFYRY

SEQ ID NO: 21466 - protein, 7 aa, Artificial Sequence
  Synthetic construct
YSIFYCF

SEQ ID NO: 21467 - protein, 7 aa, Artificial Sequence
  Synthetic construct
YSIFYCY

SEQ ID NO: 21468 - protein, 7 aa, Artificial Sequence
  Synthetic construct
YSIFYLF

SEQ ID NO: 21469 - protein, 7 aa, Artificial Sequence
  Synthetic construct
YSIFYLY

SEQ ID NO: 21470 - protein, 7 aa, Artificial Sequence
  Synthetic construct
YSIFYAF

SEQ ID NO: 21471 - protein, 7 aa, Artificial Sequence
  Synthetic construct
YSIFYAY

SEQ ID NO: 21472 - protein, 7 aa, Artificial Sequence
  Synthetic construct
YSIFYQF

SEQ ID NO: 21473 - protein, 7 aa, Artificial Sequence
  Synthetic construct
YSIFYQY

SEQ ID NO: 21474 - protein, 7 aa, Artificial Sequence
  Synthetic construct
YSIFYDF

SEQ ID NO: 21475 - protein, 7 aa, Artificial Sequence
  Synthetic construct
YSIFYDY

SEQ ID NO: 21476 - protein, 7 aa, Artificial Sequence
  Synthetic construct
YSIFYVF

SEQ ID NO: 21477 - protein, 7 aa, Artificial Sequence
  Synthetic construct
YSIFYVY

SEQ ID NO: 21478 - protein, 7 aa, Artificial Sequence
  Synthetic construct
YSIFFFF

SEQ ID NO: 21479 - protein, 7 aa, Artificial Sequence
  Synthetic construct
YSIFFFY

SEQ ID NO: 21480 - protein, 7 aa, Artificial Sequence
  Synthetic construct
YSIFFRF

SEQ ID NO: 21481 - protein, 7 aa, Artificial Sequence
  Synthetic construct
YSIFFRY

SEQ ID NO: 21482 - protein, 7 aa, Artificial Sequence
  Synthetic construct
YSIFFCF

SEQ ID NO: 21483 - protein, 7 aa, Artificial Sequence
  Synthetic construct
YSIFFCY

SEQ ID NO: 21484 - protein, 7 aa, Artificial Sequence
  Synthetic construct
YSIFFLF

SEQ ID NO: 21485 - protein, 7 aa, Artificial Sequence
  Synthetic construct
YSIFFLY

SEQ ID NO: 21486 - protein, 7 aa, Artificial Sequence
  Synthetic construct
YSIFFAF

SEQ ID NO: 21487 - protein, 7 aa, Artificial Sequence
  Synthetic construct
YSIFFAY

SEQ ID NO: 21488 - protein, 7 aa, Artificial Sequence
  Synthetic construct
YSIFFQF

SEQ ID NO: 21489 - protein, 7 aa, Artificial Sequence
  Synthetic construct
YSIFFQY

SEQ ID NO: 21490 - protein, 7 aa, Artificial Sequence
  Synthetic construct
YSIFFDF

SEQ ID NO: 21491 - protein, 7 aa, Artificial Sequence
  Synthetic construct
YSIFFDY

SEQ ID NO: 21492 - protein, 7 aa, Artificial Sequence
  Synthetic construct
YSIFFVF

SEQ ID NO: 21493 - protein, 7 aa, Artificial Sequence
  Synthetic construct
YSIFFVY

SEQ ID NO: 21494 - protein, 7 aa, Artificial Sequence
  Synthetic construct
YSIFVFF

SEQ ID NO: 21495 - protein, 7 aa, Artificial Sequence
  Synthetic construct
YSIFVFY

SEQ ID NO: 21496 - protein, 7 aa, Artificial Sequence
  Synthetic construct
YSIFVRF

SEQ ID NO: 21497 - protein, 7 aa, Artificial Sequence
  Synthetic construct
YSIFVRY

SEQ ID NO: 21498 - protein, 7 aa, Artificial Sequence
  Synthetic construct
YSIFVCF

SEQ ID NO: 21499 - protein, 7 aa, Artificial Sequence
  Synthetic construct
YSIFVCY

SEQ ID NO: 21500 - protein, 7 aa, Artificial Sequence
  Synthetic construct
YSIFVLF

SEQ ID NO: 21501 - protein, 7 aa, Artificial Sequence
  Synthetic construct
YSIFVLY

SEQ ID NO: 21502 - protein, 7 aa, Artificial Sequence
  Synthetic construct
YSIFVAF

SEQ ID NO: 21503 - protein, 7 aa, Artificial Sequence
  Synthetic construct
YSIFVAY

SEQ ID NO: 21504 - protein, 7 aa, Artificial Sequence
  Synthetic construct
YSIFVQF

SEQ ID NO: 21505 - protein, 7 aa, Artificial Sequence
  Synthetic construct
YSIFVQY

SEQ ID NO: 21506 - protein, 7 aa, Artificial Sequence
  Synthetic construct
YSIFVDF

SEQ ID NO: 21507 - protein, 7 aa, Artificial Sequence
  Synthetic construct
YSIFVDY

SEQ ID NO: 21508 - protein, 7 aa, Artificial Sequence
  Synthetic construct
YSIFVVF

SEQ ID NO: 21509 - protein, 7 aa, Artificial Sequence
  Synthetic construct
YSIFVVY

SEQ ID NO: 21510 - protein, 7 aa, Artificial Sequence
  Synthetic construct
YSIFTFF

SEQ ID NO: 21511 - protein, 7 aa, Artificial Sequence
  Synthetic construct
YSIFTFY

SEQ ID NO: 21512 - protein, 7 aa, Artificial Sequence
  Synthetic construct
YSIFTRF

SEQ ID NO: 21513 - protein, 7 aa, Artificial Sequence
  Synthetic construct
YSIFTRY

SEQ ID NO: 21514 - protein, 7 aa, Artificial Sequence
  Synthetic construct
YSIFTCF

SEQ ID NO: 21515 - protein, 7 aa, Artificial Sequence
  Synthetic construct
YSIFTCY

SEQ ID NO: 21516 - protein, 7 aa, Artificial Sequence
  Synthetic construct
YSIFTLF

SEQ ID NO: 21517 - protein, 7 aa, Artificial Sequence
  Synthetic construct
YSIFTLY

SEQ ID NO: 21518 - protein, 7 aa, Artificial Sequence
  Synthetic construct
YSIFTAF

SEQ ID NO: 21519 - protein, 7 aa, Artificial Sequence
  Synthetic construct
YSIFTAY

SEQ ID NO: 21520 - protein, 7 aa, Artificial Sequence
  Synthetic construct
YSIFTQF

SEQ ID NO: 21521 - protein, 7 aa, Artificial Sequence
  Synthetic construct
YSIFTQY

SEQ ID NO: 21522 - protein, 7 aa, Artificial Sequence
  Synthetic construct
YSIFTDF

SEQ ID NO: 21523 - protein, 7 aa, Artificial Sequence
  Synthetic construct
YSIFTDY

SEQ ID NO: 21524 - protein, 7 aa, Artificial Sequence
  Synthetic construct
YSIFTVF

SEQ ID NO: 21525 - protein, 7 aa, Artificial Sequence
  Synthetic construct
YSIFTVY

SEQ ID NO: 21526 - protein, 7 aa, Artificial Sequence
  Synthetic construct
YSIFGFF

SEQ ID NO: 21527 - protein, 7 aa, Artificial Sequence
  Synthetic construct
YSIFGFY

SEQ ID NO: 21528 - protein, 7 aa, Artificial Sequence
  Synthetic construct
YSIFGRF

SEQ ID NO: 21529 - protein, 7 aa, Artificial Sequence
  Synthetic construct
YSIFGRY

SEQ ID NO: 21530 - protein, 7 aa, Artificial Sequence
  Synthetic construct
YSIFGCF

SEQ ID NO: 21531 - protein, 7 aa, Artificial Sequence
  Synthetic construct
YSIFGCY

SEQ ID NO: 21532 - protein, 7 aa, Artificial Sequence
  Synthetic construct
YSIFGLF

SEQ ID NO: 21533 - protein, 7 aa, Artificial Sequence
  Synthetic construct
YSIFGLY

SEQ ID NO: 21534 - protein, 7 aa, Artificial Sequence
  Synthetic construct
YSIFGAF

SEQ ID NO: 21535 - protein, 7 aa, Artificial Sequence
  Synthetic construct
YSIFGAY

SEQ ID NO: 21536 - protein, 7 aa, Artificial Sequence
  Synthetic construct
YSIFGQF

SEQ ID NO: 21537 - protein, 7 aa, Artificial Sequence
  Synthetic construct
YSIFGQY

SEQ ID NO: 21538 - protein, 7 aa, Artificial Sequence
  Synthetic construct
YSIFGDF

SEQ ID NO: 21539 - protein, 7 aa, Artificial Sequence
  Synthetic construct
YSIFGDY

SEQ ID NO: 21540 - protein, 7 aa, Artificial Sequence
  Synthetic construct
YSIFGVF

SEQ ID NO: 21541 - protein, 7 aa, Artificial Sequence
  Synthetic construct
YSIFGVY

SEQ ID NO: 21542 - protein, 7 aa, Artificial Sequence
  Synthetic construct
YSIFAFF

SEQ ID NO: 21543 - protein, 7 aa, Artificial Sequence
  Synthetic construct
YSIFAFY

SEQ ID NO: 21544 - protein, 7 aa, Artificial Sequence
  Synthetic construct
YSIFARF

SEQ ID NO: 21545 - protein, 7 aa, Artificial Sequence
  Synthetic construct
YSIFARY

SEQ ID NO: 21546 - protein, 7 aa, Artificial Sequence
  Synthetic construct
YSIFACF

SEQ ID NO: 21547 - protein, 7 aa, Artificial Sequence
  Synthetic construct
YSIFACY

SEQ ID NO: 21548 - protein, 7 aa, Artificial Sequence
  Synthetic construct
YSIFALF

SEQ ID NO: 21549 - protein, 7 aa, Artificial Sequence
  Synthetic construct
YSIFALY

SEQ ID NO: 21550 - protein, 7 aa, Artificial Sequence
  Synthetic construct
YSIFAAF

SEQ ID NO: 21551 - protein, 7 aa, Artificial Sequence
  Synthetic construct
YSIFAAY

SEQ ID NO: 21552 - protein, 7 aa, Artificial Sequence
  Synthetic construct
YSIFAQF

SEQ ID NO: 21553 - protein, 7 aa, Artificial Sequence
  Synthetic construct
YSIFAQY

SEQ ID NO: 21554 - protein, 7 aa, Artificial Sequence
  Synthetic construct
YSIFADF

SEQ ID NO: 21555 - protein, 7 aa, Artificial Sequence
  Synthetic construct
YSIFADY

SEQ ID NO: 21556 - protein, 7 aa, Artificial Sequence
  Synthetic construct
YSIFAVF

SEQ ID NO: 21557 - protein, 7 aa, Artificial Sequence
  Synthetic construct
YSIFAVY

SEQ ID NO: 21558 - protein, 7 aa, Artificial Sequence
  Synthetic construct
YSIFQFF

SEQ ID NO: 21559 - protein, 7 aa, Artificial Sequence
  Synthetic construct
YSIFQFY

SEQ ID NO: 21560 - protein, 7 aa, Artificial Sequence
  Synthetic construct
YSIFQRF

SEQ ID NO: 21561 - protein, 7 aa, Artificial Sequence
  Synthetic construct
YSIFQRY

SEQ ID NO: 21562 - protein, 7 aa, Artificial Sequence
  Synthetic construct
YSIFQCF

SEQ ID NO: 21563 - protein, 7 aa, Artificial Sequence
  Synthetic construct
YSIFQCY

SEQ ID NO: 21564 - protein, 7 aa, Artificial Sequence
  Synthetic construct
YSIFQLF

SEQ ID NO: 21565 - protein, 7 aa, Artificial Sequence
  Synthetic construct
YSIFQLY

SEQ ID NO: 21566 - protein, 7 aa, Artificial Sequence
  Synthetic construct
YSIFQAF

SEQ ID NO: 21567 - protein, 7 aa, Artificial Sequence
  Synthetic construct
YSIFQAY

SEQ ID NO: 21568 - protein, 7 aa, Artificial Sequence
  Synthetic construct
YSIFQQF

SEQ ID NO: 21569 - protein, 7 aa, Artificial Sequence
  Synthetic construct
YSIFQQY

SEQ ID NO: 21570 - protein, 7 aa, Artificial Sequence
  Synthetic construct
YSIFQDF

SEQ ID NO: 21571 - protein, 7 aa, Artificial Sequence
  Synthetic construct
YSIFQDY

SEQ ID NO: 21572 - protein, 7 aa, Artificial Sequence
  Synthetic construct
YSIFQVF

SEQ ID NO: 21573 - protein, 7 aa, Artificial Sequence
  Synthetic construct
YSIFQVY

SEQ ID NO: 21574 - protein, 7 aa, Artificial Sequence
  Synthetic construct
YSGYIFF

SEQ ID NO: 21575 - protein, 7 aa, Artificial Sequence
  Synthetic construct
YSGYIFY

SEQ ID NO: 21576 - protein, 7 aa, Artificial Sequence
  Synthetic construct
YSGYIRF

SEQ ID NO: 21577 - protein, 7 aa, Artificial Sequence
  Synthetic construct
YSGYIRY

SEQ ID NO: 21578 - protein, 7 aa, Artificial Sequence
  Synthetic construct
YSGYICF

SEQ ID NO: 21579 - protein, 7 aa, Artificial Sequence
  Synthetic construct
YSGYICY

SEQ ID NO: 21580 - protein, 7 aa, Artificial Sequence
  Synthetic construct
YSGYILF

SEQ ID NO: 21581 - protein, 7 aa, Artificial Sequence
  Synthetic construct
YSGYILY

SEQ ID NO: 21582 - protein, 7 aa, Artificial Sequence
  Synthetic construct
YSGYIAF

SEQ ID NO: 21583 - protein, 7 aa, Artificial Sequence
  Synthetic construct
YSGYIAY

SEQ ID NO: 21584 - protein, 7 aa, Artificial Sequence
  Synthetic construct
YSGYIQF

SEQ ID NO: 21585 - protein, 7 aa, Artificial Sequence
  Synthetic construct
YSGYIQY

SEQ ID NO: 21586 - protein, 7 aa, Artificial Sequence
  Synthetic construct
YSGYIDF

SEQ ID NO: 21587 - protein, 7 aa, Artificial Sequence
  Synthetic construct
YSGYIDY

SEQ ID NO: 21588 - protein, 7 aa, Artificial Sequence
  Synthetic construct
YSGYIVF

SEQ ID NO: 21589 - protein, 7 aa, Artificial Sequence
  Synthetic construct
YSGYIVY

SEQ ID NO: 21590 - protein, 7 aa, Artificial Sequence
  Synthetic construct
YSGYDFF

SEQ ID NO: 21591 - protein, 7 aa, Artificial Sequence
  Synthetic construct
YSGYDFY

SEQ ID NO: 21592 - protein, 7 aa, Artificial Sequence
  Synthetic construct
YSGYDRF

SEQ ID NO: 21593 - protein, 7 aa, Artificial Sequence
  Synthetic construct
YSGYDRY

SEQ ID NO: 21594 - protein, 7 aa, Artificial Sequence
  Synthetic construct
YSGYDCF

SEQ ID NO: 21595 - protein, 7 aa, Artificial Sequence
  Synthetic construct
YSGYDCY

SEQ ID NO: 21596 - protein, 7 aa, Artificial Sequence
  Synthetic construct
YSGYDLF

SEQ ID NO: 21597 - protein, 7 aa, Artificial Sequence
  Synthetic construct
YSGYDLY

SEQ ID NO: 21598 - protein, 7 aa, Artificial Sequence
  Synthetic construct
YSGYDAF

SEQ ID NO: 21599 - protein, 7 aa, Artificial Sequence
  Synthetic construct
YSGYDAY

SEQ ID NO: 21600 - protein, 7 aa, Artificial Sequence
  Synthetic construct
YSGYDQF

SEQ ID NO: 21601 - protein, 7 aa, Artificial Sequence
  Synthetic construct
YSGYDQY

SEQ ID NO: 21602 - protein, 7 aa, Artificial Sequence
  Synthetic construct
YSGYDDF

SEQ ID NO: 21603 - protein, 7 aa, Artificial Sequence
  Synthetic construct
YSGYDDY

SEQ ID NO: 21604 - protein, 7 aa, Artificial Sequence
  Synthetic construct
YSGYDVF

SEQ ID NO: 21605 - protein, 7 aa, Artificial Sequence
  Synthetic construct
YSGYDVY

SEQ ID NO: 21606 - protein, 7 aa, Artificial Sequence
  Synthetic construct
YSGYYFF

SEQ ID NO: 21607 - protein, 7 aa, Artificial Sequence
  Synthetic construct
YSGYYFY

SEQ ID NO: 21608 - protein, 7 aa, Artificial Sequence
  Synthetic construct
YSGYYRF

SEQ ID NO: 21609 - protein, 7 aa, Artificial Sequence
  Synthetic construct
YSGYYRY

SEQ ID NO: 21610 - protein, 7 aa, Artificial Sequence
  Synthetic construct
YSGYYCF

SEQ ID NO: 21611 - protein, 7 aa, Artificial Sequence
  Synthetic construct
YSGYYCY

SEQ ID NO: 21612 - protein, 7 aa, Artificial Sequence
  Synthetic construct
YSGYYLF

SEQ ID NO: 21613 - protein, 7 aa, Artificial Sequence
  Synthetic construct
YSGYYLY

SEQ ID NO: 21614 - protein, 7 aa, Artificial Sequence
  Synthetic construct
YSGYYAF

SEQ ID NO: 21615 - protein, 7 aa, Artificial Sequence
  Synthetic construct
YSGYYAY

SEQ ID NO: 21616 - protein, 7 aa, Artificial Sequence
  Synthetic construct
YSGYYQF

SEQ ID NO: 21617 - protein, 7 aa, Artificial Sequence
  Synthetic construct
YSGYYQY

SEQ ID NO: 21618 - protein, 7 aa, Artificial Sequence
  Synthetic construct
YSGYYDF

SEQ ID NO: 21619 - protein, 7 aa, Artificial Sequence
  Synthetic construct
YSGYYDY

SEQ ID NO: 21620 - protein, 7 aa, Artificial Sequence
  Synthetic construct
YSGYYVF

SEQ ID NO: 21621 - protein, 7 aa, Artificial Sequence
  Synthetic construct
YSGYYVY

SEQ ID NO: 21622 - protein, 7 aa, Artificial Sequence
  Synthetic construct
YSGYFFF

SEQ ID NO: 21623 - protein, 7 aa, Artificial Sequence
  Synthetic construct
YSGYFFY

SEQ ID NO: 21624 - protein, 7 aa, Artificial Sequence
  Synthetic construct
YSGYFRF

SEQ ID NO: 21625 - protein, 7 aa, Artificial Sequence
  Synthetic construct
YSGYFRY

SEQ ID NO: 21626 - protein, 7 aa, Artificial Sequence
  Synthetic construct
YSGYFCF

SEQ ID NO: 21627 - protein, 7 aa, Artificial Sequence
  Synthetic construct
YSGYFCY

SEQ ID NO: 21628 - protein, 7 aa, Artificial Sequence
  Synthetic construct
YSGYFLF

SEQ ID NO: 21629 - protein, 7 aa, Artificial Sequence
  Synthetic construct
YSGYFLY

SEQ ID NO: 21630 - protein, 7 aa, Artificial Sequence
  Synthetic construct
YSGYFAF

SEQ ID NO: 21631 - protein, 7 aa, Artificial Sequence
  Synthetic construct
YSGYFAY

SEQ ID NO: 21632 - protein, 7 aa, Artificial Sequence
  Synthetic construct
YSGYFQF

SEQ ID NO: 21633 - protein, 7 aa, Artificial Sequence
  Synthetic construct
YSGYFQY

SEQ ID NO: 21634 - protein, 7 aa, Artificial Sequence
  Synthetic construct
YSGYFDF

SEQ ID NO: 21635 - protein, 7 aa, Artificial Sequence
  Synthetic construct
YSGYFDY

SEQ ID NO: 21636 - protein, 7 aa, Artificial Sequence
  Synthetic construct
YSGYFVF

SEQ ID NO: 21637 - protein, 7 aa, Artificial Sequence
  Synthetic construct
YSGYFVY

SEQ ID NO: 21638 - protein, 7 aa, Artificial Sequence
  Synthetic construct
YSGYVFF

SEQ ID NO: 21639 - protein, 7 aa, Artificial Sequence
  Synthetic construct
YSGYVFY

SEQ ID NO: 21640 - protein, 7 aa, Artificial Sequence
  Synthetic construct
YSGYVRF

SEQ ID NO: 21641 - protein, 7 aa, Artificial Sequence
  Synthetic construct
YSGYVRY

SEQ ID NO: 21642 - protein, 7 aa, Artificial Sequence
  Synthetic construct
YSGYVCF

SEQ ID NO: 21643 - protein, 7 aa, Artificial Sequence
  Synthetic construct
YSGYVCY

SEQ ID NO: 21644 - protein, 7 aa, Artificial Sequence
  Synthetic construct
YSGYVLF

SEQ ID NO: 21645 - protein, 7 aa, Artificial Sequence
  Synthetic construct
YSGYVLY

SEQ ID NO: 21646 - protein, 7 aa, Artificial Sequence
  Synthetic construct
YSGYVAF

SEQ ID NO: 21647 - protein, 7 aa, Artificial Sequence
  Synthetic construct
YSGYVAY

SEQ ID NO: 21648 - protein, 7 aa, Artificial Sequence
  Synthetic construct
YSGYVQF

SEQ ID NO: 21649 - protein, 7 aa, Artificial Sequence
  Synthetic construct
YSGYVQY

SEQ ID NO: 21650 - protein, 7 aa, Artificial Sequence
  Synthetic construct
YSGYVDF

SEQ ID NO: 21651 - protein, 7 aa, Artificial Sequence
  Synthetic construct
YSGYVDY

SEQ ID NO: 21652 - protein, 7 aa, Artificial Sequence
  Synthetic construct
YSGYVVF

SEQ ID NO: 21653 - protein, 7 aa, Artificial Sequence
  Synthetic construct
YSGYVVY

SEQ ID NO: 21654 - protein, 7 aa, Artificial Sequence
  Synthetic construct
YSGYTFF

SEQ ID NO: 21655 - protein, 7 aa, Artificial Sequence
  Synthetic construct
YSGYTFY

SEQ ID NO: 21656 - protein, 7 aa, Artificial Sequence
  Synthetic construct
YSGYTRF

SEQ ID NO: 21657 - protein, 7 aa, Artificial Sequence
  Synthetic construct
YSGYTRY

SEQ ID NO: 21658 - protein, 7 aa, Artificial Sequence
  Synthetic construct
YSGYTCF

SEQ ID NO: 21659 - protein, 7 aa, Artificial Sequence
  Synthetic construct
YSGYTCY

SEQ ID NO: 21660 - protein, 7 aa, Artificial Sequence
  Synthetic construct
YSGYTLF

SEQ ID NO: 21661 - protein, 7 aa, Artificial Sequence
  Synthetic construct
YSGYTLY

SEQ ID NO: 21662 - protein, 7 aa, Artificial Sequence
  Synthetic construct
YSGYTAF

SEQ ID NO: 21663 - protein, 7 aa, Artificial Sequence
  Synthetic construct
YSGYTAY

SEQ ID NO: 21664 - protein, 7 aa, Artificial Sequence
  Synthetic construct
YSGYTQF

SEQ ID NO: 21665 - protein, 7 aa, Artificial Sequence
  Synthetic construct
YSGYTQY

SEQ ID NO: 21666 - protein, 7 aa, Artificial Sequence
  Synthetic construct
YSGYTDF

SEQ ID NO: 21667 - protein, 7 aa, Artificial Sequence
  Synthetic construct
YSGYTDY

SEQ ID NO: 21668 - protein, 7 aa, Artificial Sequence
  Synthetic construct
YSGYTVF

SEQ ID NO: 21669 - protein, 7 aa, Artificial Sequence
  Synthetic construct
YSGYTVY

SEQ ID NO: 21670 - protein, 7 aa, Artificial Sequence
  Synthetic construct
YSGYGFF

SEQ ID NO: 21671 - protein, 7 aa, Artificial Sequence
  Synthetic construct
YSGYGFY

SEQ ID NO: 21672 - protein, 7 aa, Artificial Sequence
  Synthetic construct
YSGYGRF

SEQ ID NO: 21673 - protein, 7 aa, Artificial Sequence
  Synthetic construct
YSGYGRY

SEQ ID NO: 21674 - protein, 7 aa, Artificial Sequence
  Synthetic construct
YSGYGCF

SEQ ID NO: 21675 - protein, 7 aa, Artificial Sequence
  Synthetic construct
YSGYGCY

SEQ ID NO: 21676 - protein, 7 aa, Artificial Sequence
  Synthetic construct
YSGYGLF

SEQ ID NO: 21677 - protein, 7 aa, Artificial Sequence
  Synthetic construct
YSGYGLY

SEQ ID NO: 21678 - protein, 7 aa, Artificial Sequence
  Synthetic construct
YSGYGAF

SEQ ID NO: 21679 - protein, 7 aa, Artificial Sequence
  Synthetic construct
YSGYGAY

SEQ ID NO: 21680 - protein, 7 aa, Artificial Sequence
  Synthetic construct
YSGYGQF

SEQ ID NO: 21681 - protein, 7 aa, Artificial Sequence
  Synthetic construct
YSGYGQY

SEQ ID NO: 21682 - protein, 7 aa, Artificial Sequence
  Synthetic construct
YSGYGDF

SEQ ID NO: 21683 - protein, 7 aa, Artificial Sequence
  Synthetic construct
YSGYGDY

SEQ ID NO: 21684 - protein, 7 aa, Artificial Sequence
  Synthetic construct
YSGYGVF

SEQ ID NO: 21685 - protein, 7 aa, Artificial Sequence
  Synthetic construct
YSGYGVY

SEQ ID NO: 21686 - protein, 7 aa, Artificial Sequence
  Synthetic construct
YSGYAFF

SEQ ID NO: 21687 - protein, 7 aa, Artificial Sequence
  Synthetic construct
YSGYAFY

SEQ ID NO: 21688 - protein, 7 aa, Artificial Sequence
  Synthetic construct
YSGYARF

SEQ ID NO: 21689 - protein, 7 aa, Artificial Sequence
  Synthetic construct
YSGYARY

SEQ ID NO: 21690 - protein, 7 aa, Artificial Sequence
  Synthetic construct
YSGYACF

SEQ ID NO: 21691 - protein, 7 aa, Artificial Sequence
  Synthetic construct
YSGYACY

SEQ ID NO: 21692 - protein, 7 aa, Artificial Sequence
  Synthetic construct
YSGYALF

SEQ ID NO: 21693 - protein, 7 aa, Artificial Sequence
  Synthetic construct
YSGYALY

SEQ ID NO: 21694 - protein, 7 aa, Artificial Sequence
  Synthetic construct
YSGYAAF

SEQ ID NO: 21695 - protein, 7 aa, Artificial Sequence
  Synthetic construct
YSGYAAY

SEQ ID NO: 21696 - protein, 7 aa, Artificial Sequence
  Synthetic construct
YSGYAQF

SEQ ID NO: 21697 - protein, 7 aa, Artificial Sequence
  Synthetic construct
YSGYAQY

SEQ ID NO: 21698 - protein, 7 aa, Artificial Sequence
  Synthetic construct
YSGYADF

SEQ ID NO: 21699 - protein, 7 aa, Artificial Sequence
  Synthetic construct
YSGYADY

SEQ ID NO: 21700 - protein, 7 aa, Artificial Sequence
  Synthetic construct
YSGYAVF

SEQ ID NO: 21701 - protein, 7 aa, Artificial Sequence
  Synthetic construct
YSGYAVY

SEQ ID NO: 21702 - protein, 7 aa, Artificial Sequence
  Synthetic construct
YSGYQFF

SEQ ID NO: 21703 - protein, 7 aa, Artificial Sequence
  Synthetic construct
YSGYQFY

SEQ ID NO: 21704 - protein, 7 aa, Artificial Sequence
  Synthetic construct
YSGYQRF

SEQ ID NO: 21705 - protein, 7 aa, Artificial Sequence
  Synthetic construct
YSGYQRY

SEQ ID NO: 21706 - protein, 7 aa, Artificial Sequence
  Synthetic construct
YSGYQCF

SEQ ID NO: 21707 - protein, 7 aa, Artificial Sequence
  Synthetic construct
YSGYQCY

SEQ ID NO: 21708 - protein, 7 aa, Artificial Sequence
  Synthetic construct
YSGYQLF

SEQ ID NO: 21709 - protein, 7 aa, Artificial Sequence
  Synthetic construct
YSGYQLY

SEQ ID NO: 21710 - protein, 7 aa, Artificial Sequence
  Synthetic construct
YSGYQAF

SEQ ID NO: 21711 - protein, 7 aa, Artificial Sequence
  Synthetic construct
YSGYQAY

SEQ ID NO: 21712 - protein, 7 aa, Artificial Sequence
  Synthetic construct
YSGYQQF

SEQ ID NO: 21713 - protein, 7 aa, Artificial Sequence
  Synthetic construct
YSGYQQY

SEQ ID NO: 21714 - protein, 7 aa, Artificial Sequence
  Synthetic construct
YSGYQDF

SEQ ID NO: 21715 - protein, 7 aa, Artificial Sequence
  Synthetic construct
YSGYQDY

SEQ ID NO: 21716 - protein, 7 aa, Artificial Sequence
  Synthetic construct
YSGYQVF

SEQ ID NO: 21717 - protein, 7 aa, Artificial Sequence
  Synthetic construct
YSGYQVY

SEQ ID NO: 21718 - protein, 7 aa, Artificial Sequence
  Synthetic construct
YSGPIFF

SEQ ID NO: 21719 - protein, 7 aa, Artificial Sequence
  Synthetic construct
YSGPIFY

SEQ ID NO: 21720 - protein, 7 aa, Artificial Sequence
  Synthetic construct
YSGPIRF

SEQ ID NO: 21721 - protein, 7 aa, Artificial Sequence
  Synthetic construct
YSGPIRY

SEQ ID NO: 21722 - protein, 7 aa, Artificial Sequence
  Synthetic construct
YSGPICF

SEQ ID NO: 21723 - protein, 7 aa, Artificial Sequence
  Synthetic construct
YSGPICY

SEQ ID NO: 21724 - protein, 7 aa, Artificial Sequence
  Synthetic construct
YSGPILF

SEQ ID NO: 21725 - protein, 7 aa, Artificial Sequence
  Synthetic construct
YSGPILY

SEQ ID NO: 21726 - protein, 7 aa, Artificial Sequence
  Synthetic construct
YSGPIAF

SEQ ID NO: 21727 - protein, 7 aa, Artificial Sequence
  Synthetic construct
YSGPIAY

SEQ ID NO: 21728 - protein, 7 aa, Artificial Sequence
  Synthetic construct
YSGPIQF

SEQ ID NO: 21729 - protein, 7 aa, Artificial Sequence
  Synthetic construct
YSGPIQY

SEQ ID NO: 21730 - protein, 7 aa, Artificial Sequence
  Synthetic construct
YSGPIDF

SEQ ID NO: 21731 - protein, 7 aa, Artificial Sequence
  Synthetic construct
YSGPIDY

SEQ ID NO: 21732 - protein, 7 aa, Artificial Sequence
  Synthetic construct
YSGPIVF

SEQ ID NO: 21733 - protein, 7 aa, Artificial Sequence
  Synthetic construct
YSGPIVY

SEQ ID NO: 21734 - protein, 7 aa, Artificial Sequence
  Synthetic construct
YSGPDFF

SEQ ID NO: 21735 - protein, 7 aa, Artificial Sequence
  Synthetic construct
YSGPDFY

SEQ ID NO: 21736 - protein, 7 aa, Artificial Sequence
  Synthetic construct
YSGPDRF

SEQ ID NO: 21737 - protein, 7 aa, Artificial Sequence
  Synthetic construct
YSGPDRY

SEQ ID NO: 21738 - protein, 7 aa, Artificial Sequence
  Synthetic construct
YSGPDCF

SEQ ID NO: 21739 - protein, 7 aa, Artificial Sequence
  Synthetic construct
YSGPDCY

SEQ ID NO: 21740 - protein, 7 aa, Artificial Sequence
  Synthetic construct
YSGPDLF

SEQ ID NO: 21741 - protein, 7 aa, Artificial Sequence
  Synthetic construct
YSGPDLY

SEQ ID NO: 21742 - protein, 7 aa, Artificial Sequence
  Synthetic construct
YSGPDAF

SEQ ID NO: 21743 - protein, 7 aa, Artificial Sequence
  Synthetic construct
YSGPDAY

SEQ ID NO: 21744 - protein, 7 aa, Artificial Sequence
  Synthetic construct
YSGPDQF

SEQ ID NO: 21745 - protein, 7 aa, Artificial Sequence
  Synthetic construct
YSGPDQY

SEQ ID NO: 21746 - protein, 7 aa, Artificial Sequence
  Synthetic construct
YSGPDDF

SEQ ID NO: 21747 - protein, 7 aa, Artificial Sequence
  Synthetic construct
YSGPDDY

SEQ ID NO: 21748 - protein, 7 aa, Artificial Sequence
  Synthetic construct
YSGPDVF

SEQ ID NO: 21749 - protein, 7 aa, Artificial Sequence
  Synthetic construct
YSGPDVY

SEQ ID NO: 21750 - protein, 7 aa, Artificial Sequence
  Synthetic construct
YSGPYFF

SEQ ID NO: 21751 - protein, 7 aa, Artificial Sequence
  Synthetic construct
YSGPYFY

SEQ ID NO: 21752 - protein, 7 aa, Artificial Sequence
  Synthetic construct
YSGPYRF

SEQ ID NO: 21753 - protein, 7 aa, Artificial Sequence
  Synthetic construct
YSGPYRY

SEQ ID NO: 21754 - protein, 7 aa, Artificial Sequence
  Synthetic construct
YSGPYCF

SEQ ID NO: 21755 - protein, 7 aa, Artificial Sequence
  Synthetic construct
YSGPYCY

SEQ ID NO: 21756 - protein, 7 aa, Artificial Sequence
  Synthetic construct
YSGPYLF

SEQ ID NO: 21757 - protein, 7 aa, Artificial Sequence
  Synthetic construct
YSGPYLY

SEQ ID NO: 21758 - protein, 7 aa, Artificial Sequence
  Synthetic construct
YSGPYAF

SEQ ID NO: 21759 - protein, 7 aa, Artificial Sequence
  Synthetic construct
YSGPYAY

SEQ ID NO: 21760 - protein, 7 aa, Artificial Sequence
  Synthetic construct
YSGPYQF

SEQ ID NO: 21761 - protein, 7 aa, Artificial Sequence
  Synthetic construct
YSGPYQY

SEQ ID NO: 21762 - protein, 7 aa, Artificial Sequence
  Synthetic construct
YSGPYDF

SEQ ID NO: 21763 - protein, 7 aa, Artificial Sequence
  Synthetic construct
YSGPYDY

SEQ ID NO: 21764 - protein, 7 aa, Artificial Sequence
  Synthetic construct
YSGPYVF

SEQ ID NO: 21765 - protein, 7 aa, Artificial Sequence
  Synthetic construct
YSGPYVY

SEQ ID NO: 21766 - protein, 7 aa, Artificial Sequence
  Synthetic construct
YSGPFFF

SEQ ID NO: 21767 - protein, 7 aa, Artificial Sequence
  Synthetic construct
YSGPFFY

SEQ ID NO: 21768 - protein, 7 aa, Artificial Sequence
  Synthetic construct
YSGPFRF

SEQ ID NO: 21769 - protein, 7 aa, Artificial Sequence
  Synthetic construct
YSGPFRY

SEQ ID NO: 21770 - protein, 7 aa, Artificial Sequence
  Synthetic construct
YSGPFCF

SEQ ID NO: 21771 - protein, 7 aa, Artificial Sequence
  Synthetic construct
YSGPFCY

SEQ ID NO: 21772 - protein, 7 aa, Artificial Sequence
  Synthetic construct
YSGPFLF

SEQ ID NO: 21773 - protein, 7 aa, Artificial Sequence
  Synthetic construct
YSGPFLY

SEQ ID NO: 21774 - protein, 7 aa, Artificial Sequence
  Synthetic construct
YSGPFAF

SEQ ID NO: 21775 - protein, 7 aa, Artificial Sequence
  Synthetic construct
YSGPFAY

SEQ ID NO: 21776 - protein, 7 aa, Artificial Sequence
  Synthetic construct
YSGPFQF

SEQ ID NO: 21777 - protein, 7 aa, Artificial Sequence
  Synthetic construct
YSGPFQY

SEQ ID NO: 21778 - protein, 7 aa, Artificial Sequence
  Synthetic construct
YSGPFDF

SEQ ID NO: 21779 - protein, 7 aa, Artificial Sequence
  Synthetic construct
YSGPFDY

SEQ ID NO: 21780 - protein, 7 aa, Artificial Sequence
  Synthetic construct
YSGPFVF

SEQ ID NO: 21781 - protein, 7 aa, Artificial Sequence
  Synthetic construct
YSGPFVY

SEQ ID NO: 21782 - protein, 7 aa, Artificial Sequence
  Synthetic construct
YSGPVFF

SEQ ID NO: 21783 - protein, 7 aa, Artificial Sequence
  Synthetic construct
YSGPVFY

SEQ ID NO: 21784 - protein, 7 aa, Artificial Sequence
  Synthetic construct
YSGPVRF

SEQ ID NO: 21785 - protein, 7 aa, Artificial Sequence
  Synthetic construct
YSGPVRY

SEQ ID NO: 21786 - protein, 7 aa, Artificial Sequence
  Synthetic construct
YSGPVCF

SEQ ID NO: 21787 - protein, 7 aa, Artificial Sequence
  Synthetic construct
YSGPVCY

SEQ ID NO: 21788 - protein, 7 aa, Artificial Sequence
  Synthetic construct
YSGPVLF

SEQ ID NO: 21789 - protein, 7 aa, Artificial Sequence
  Synthetic construct
YSGPVLY

SEQ ID NO: 21790 - protein, 7 aa, Artificial Sequence
  Synthetic construct
YSGPVAF

SEQ ID NO: 21791 - protein, 7 aa, Artificial Sequence
  Synthetic construct
YSGPVAY

SEQ ID NO: 21792 - protein, 7 aa, Artificial Sequence
  Synthetic construct
YSGPVQF

SEQ ID NO: 21793 - protein, 7 aa, Artificial Sequence
  Synthetic construct
YSGPVQY

SEQ ID NO: 21794 - protein, 7 aa, Artificial Sequence
  Synthetic construct
YSGPVDF

SEQ ID NO: 21795 - protein, 7 aa, Artificial Sequence
  Synthetic construct
YSGPVDY

SEQ ID NO: 21796 - protein, 7 aa, Artificial Sequence
  Synthetic construct
YSGPVVF

SEQ ID NO: 21797 - protein, 7 aa, Artificial Sequence
  Synthetic construct
YSGPVVY

SEQ ID NO: 21798 - protein, 7 aa, Artificial Sequence
  Synthetic construct
YSGPTFF

SEQ ID NO: 21799 - protein, 7 aa, Artificial Sequence
  Synthetic construct
YSGPTFY

SEQ ID NO: 21800 - protein, 7 aa, Artificial Sequence
  Synthetic construct
YSGPTRF

SEQ ID NO: 21801 - protein, 7 aa, Artificial Sequence
  Synthetic construct
YSGPTRY

SEQ ID NO: 21802 - protein, 7 aa, Artificial Sequence
  Synthetic construct
YSGPTCF

SEQ ID NO: 21803 - protein, 7 aa, Artificial Sequence
  Synthetic construct
YSGPTCY

SEQ ID NO: 21804 - protein, 7 aa, Artificial Sequence
  Synthetic construct
YSGPTLF

SEQ ID NO: 21805 - protein, 7 aa, Artificial Sequence
  Synthetic construct
YSGPTLY

SEQ ID NO: 21806 - protein, 7 aa, Artificial Sequence
  Synthetic construct
YSGPTAF

SEQ ID NO: 21807 - protein, 7 aa, Artificial Sequence
  Synthetic construct
YSGPTAY

SEQ ID NO: 21808 - protein, 7 aa, Artificial Sequence
  Synthetic construct
YSGPTQF

SEQ ID NO: 21809 - protein, 7 aa, Artificial Sequence
  Synthetic construct
YSGPTQY

SEQ ID NO: 21810 - protein, 7 aa, Artificial Sequence
  Synthetic construct
YSGPTDF

SEQ ID NO: 21811 - protein, 7 aa, Artificial Sequence
  Synthetic construct
YSGPTDY

SEQ ID NO: 21812 - protein, 7 aa, Artificial Sequence
  Synthetic construct
YSGPTVF

SEQ ID NO: 21813 - protein, 7 aa, Artificial Sequence
  Synthetic construct
YSGPTVY

SEQ ID NO: 21814 - protein, 7 aa, Artificial Sequence
  Synthetic construct
YSGPGFF

SEQ ID NO: 21815 - protein, 7 aa, Artificial Sequence
  Synthetic construct
YSGPGFY

SEQ ID NO: 21816 - protein, 7 aa, Artificial Sequence
  Synthetic construct
YSGPGRF

SEQ ID NO: 21817 - protein, 7 aa, Artificial Sequence
  Synthetic construct
YSGPGRY

SEQ ID NO: 21818 - protein, 7 aa, Artificial Sequence
  Synthetic construct
YSGPGCF

SEQ ID NO: 21819 - protein, 7 aa, Artificial Sequence
  Synthetic construct
YSGPGCY

SEQ ID NO: 21820 - protein, 7 aa, Artificial Sequence
  Synthetic construct
YSGPGLF

SEQ ID NO: 21821 - protein, 7 aa, Artificial Sequence
  Synthetic construct
YSGPGLY

SEQ ID NO: 21822 - protein, 7 aa, Artificial Sequence
  Synthetic construct
YSGPGAF

SEQ ID NO: 21823 - protein, 7 aa, Artificial Sequence
  Synthetic construct
YSGPGAY

SEQ ID NO: 21824 - protein, 7 aa, Artificial Sequence
  Synthetic construct
YSGPGQF

SEQ ID NO: 21825 - protein, 7 aa, Artificial Sequence
  Synthetic construct
YSGPGQY

SEQ ID NO: 21826 - protein, 7 aa, Artificial Sequence
  Synthetic construct
YSGPGDF

SEQ ID NO: 21827 - protein, 7 aa, Artificial Sequence
  Synthetic construct
YSGPGDY

SEQ ID NO: 21828 - protein, 7 aa, Artificial Sequence
  Synthetic construct
YSGPGVF

SEQ ID NO: 21829 - protein, 7 aa, Artificial Sequence
  Synthetic construct
YSGPGVY

SEQ ID NO: 21830 - protein, 7 aa, Artificial Sequence
  Synthetic construct
YSGPAFF

SEQ ID NO: 21831 - protein, 7 aa, Artificial Sequence
  Synthetic construct
YSGPAFY

SEQ ID NO: 21832 - protein, 7 aa, Artificial Sequence
  Synthetic construct
YSGPARF

SEQ ID NO: 21833 - protein, 7 aa, Artificial Sequence
  Synthetic construct
YSGPARY

SEQ ID NO: 21834 - protein, 7 aa, Artificial Sequence
  Synthetic construct
YSGPACF

SEQ ID NO: 21835 - protein, 7 aa, Artificial Sequence
  Synthetic construct
YSGPACY

SEQ ID NO: 21836 - protein, 7 aa, Artificial Sequence
  Synthetic construct
YSGPALF

SEQ ID NO: 21837 - protein, 7 aa, Artificial Sequence
  Synthetic construct
YSGPALY

SEQ ID NO: 21838 - protein, 7 aa, Artificial Sequence
  Synthetic construct
YSGPAAF

SEQ ID NO: 21839 - protein, 7 aa, Artificial Sequence
  Synthetic construct
YSGPAAY

SEQ ID NO: 21840 - protein, 7 aa, Artificial Sequence
  Synthetic construct
YSGPAQF

SEQ ID NO: 21841 - protein, 7 aa, Artificial Sequence
  Synthetic construct
YSGPAQY

SEQ ID NO: 21842 - protein, 7 aa, Artificial Sequence
  Synthetic construct
YSGPADF

SEQ ID NO: 21843 - protein, 7 aa, Artificial Sequence
  Synthetic construct
YSGPADY

SEQ ID NO: 21844 - protein, 7 aa, Artificial Sequence
  Synthetic construct
YSGPAVF

SEQ ID NO: 21845 - protein, 7 aa, Artificial Sequence
  Synthetic construct
YSGPAVY

SEQ ID NO: 21846 - protein, 7 aa, Artificial Sequence
  Synthetic construct
YSGPQFF

SEQ ID NO: 21847 - protein, 7 aa, Artificial Sequence
  Synthetic construct
YSGPQFY

SEQ ID NO: 21848 - protein, 7 aa, Artificial Sequence
  Synthetic construct
YSGPQRF

SEQ ID NO: 21849 - protein, 7 aa, Artificial Sequence
  Synthetic construct
YSGPQRY

SEQ ID NO: 21850 - protein, 7 aa, Artificial Sequence
  Synthetic construct
YSGPQCF

SEQ ID NO: 21851 - protein, 7 aa, Artificial Sequence
  Synthetic construct
YSGPQCY

SEQ ID NO: 21852 - protein, 7 aa, Artificial Sequence
  Synthetic construct
YSGPQLF

SEQ ID NO: 21853 - protein, 7 aa, Artificial Sequence
  Synthetic construct
YSGPQLY

SEQ ID NO: 21854 - protein, 7 aa, Artificial Sequence
  Synthetic construct
YSGPQAF

SEQ ID NO: 21855 - protein, 7 aa, Artificial Sequence
  Synthetic construct
YSGPQAY

SEQ ID NO: 21856 - protein, 7 aa, Artificial Sequence
  Synthetic construct
YSGPQQF

SEQ ID NO: 21857 - protein, 7 aa, Artificial Sequence
  Synthetic construct
YSGPQQY

SEQ ID NO: 21858 - protein, 7 aa, Artificial Sequence
  Synthetic construct
YSGPQDF

SEQ ID NO: 21859 - protein, 7 aa, Artificial Sequence
  Synthetic construct
YSGPQDY

SEQ ID NO: 21860 - protein, 7 aa, Artificial Sequence
  Synthetic construct
YSGPQVF

SEQ ID NO: 21861 - protein, 7 aa, Artificial Sequence
  Synthetic construct
YSGPQVY

SEQ ID NO: 21862 - protein, 7 aa, Artificial Sequence
  Synthetic construct
YSGHIFF

SEQ ID NO: 21863 - protein, 7 aa, Artificial Sequence
  Synthetic construct
YSGHIFY

SEQ ID NO: 21864 - protein, 7 aa, Artificial Sequence
  Synthetic construct
YSGHIRF

SEQ ID NO: 21865 - protein, 7 aa, Artificial Sequence
  Synthetic construct
YSGHIRY

SEQ ID NO: 21866 - protein, 7 aa, Artificial Sequence
  Synthetic construct
YSGHICF

SEQ ID NO: 21867 - protein, 7 aa, Artificial Sequence
  Synthetic construct
YSGHICY

SEQ ID NO: 21868 - protein, 7 aa, Artificial Sequence
  Synthetic construct
YSGHILF

SEQ ID NO: 21869 - protein, 7 aa, Artificial Sequence
  Synthetic construct
YSGHILY

SEQ ID NO: 21870 - protein, 7 aa, Artificial Sequence
  Synthetic construct
YSGHIAF

SEQ ID NO: 21871 - protein, 7 aa, Artificial Sequence
  Synthetic construct
YSGHIAY

SEQ ID NO: 21872 - protein, 7 aa, Artificial Sequence
  Synthetic construct
YSGHIQF

SEQ ID NO: 21873 - protein, 7 aa, Artificial Sequence
  Synthetic construct
YSGHIQY

SEQ ID NO: 21874 - protein, 7 aa, Artificial Sequence
  Synthetic construct
YSGHIDF

SEQ ID NO: 21875 - protein, 7 aa, Artificial Sequence
  Synthetic construct
YSGHIDY

SEQ ID NO: 21876 - protein, 7 aa, Artificial Sequence
  Synthetic construct
YSGHIVF

SEQ ID NO: 21877 - protein, 7 aa, Artificial Sequence
  Synthetic construct
YSGHIVY

SEQ ID NO: 21878 - protein, 7 aa, Artificial Sequence
  Synthetic construct
YSGHDFF

SEQ ID NO: 21879 - protein, 7 aa, Artificial Sequence
  Synthetic construct
YSGHDFY

SEQ ID NO: 21880 - protein, 7 aa, Artificial Sequence
  Synthetic construct
YSGHDRF

SEQ ID NO: 21881 - protein, 7 aa, Artificial Sequence
  Synthetic construct
YSGHDRY

SEQ ID NO: 21882 - protein, 7 aa, Artificial Sequence
  Synthetic construct
YSGHDCF

SEQ ID NO: 21883 - protein, 7 aa, Artificial Sequence
  Synthetic construct
YSGHDCY

SEQ ID NO: 21884 - protein, 7 aa, Artificial Sequence
  Synthetic construct
YSGHDLF

SEQ ID NO: 21885 - protein, 7 aa, Artificial Sequence
  Synthetic construct
YSGHDLY

SEQ ID NO: 21886 - protein, 7 aa, Artificial Sequence
  Synthetic construct
YSGHDAF

SEQ ID NO: 21887 - protein, 7 aa, Artificial Sequence
  Synthetic construct
YSGHDAY

SEQ ID NO: 21888 - protein, 7 aa, Artificial Sequence
  Synthetic construct
YSGHDQF

SEQ ID NO: 21889 - protein, 7 aa, Artificial Sequence
  Synthetic construct
YSGHDQY

SEQ ID NO: 21890 - protein, 7 aa, Artificial Sequence
  Synthetic construct
YSGHDDF

SEQ ID NO: 21891 - protein, 7 aa, Artificial Sequence
  Synthetic construct
YSGHDDY

SEQ ID NO: 21892 - protein, 7 aa, Artificial Sequence
  Synthetic construct
YSGHDVF

SEQ ID NO: 21893 - protein, 7 aa, Artificial Sequence
  Synthetic construct
YSGHDVY

SEQ ID NO: 21894 - protein, 7 aa, Artificial Sequence
  Synthetic construct
YSGHYFF

SEQ ID NO: 21895 - protein, 7 aa, Artificial Sequence
  Synthetic construct
YSGHYFY

SEQ ID NO: 21896 - protein, 7 aa, Artificial Sequence
  Synthetic construct
YSGHYRF

SEQ ID NO: 21897 - protein, 7 aa, Artificial Sequence
  Synthetic construct
YSGHYRY

SEQ ID NO: 21898 - protein, 7 aa, Artificial Sequence
  Synthetic construct
YSGHYCF

SEQ ID NO: 21899 - protein, 7 aa, Artificial Sequence
  Synthetic construct
YSGHYCY

SEQ ID NO: 21900 - protein, 7 aa, Artificial Sequence
  Synthetic construct
YSGHYLF

SEQ ID NO: 21901 - protein, 7 aa, Artificial Sequence
  Synthetic construct
YSGHYLY

SEQ ID NO: 21902 - protein, 7 aa, Artificial Sequence
  Synthetic construct
YSGHYAF

SEQ ID NO: 21903 - protein, 7 aa, Artificial Sequence
  Synthetic construct
YSGHYAY

SEQ ID NO: 21904 - protein, 7 aa, Artificial Sequence
  Synthetic construct
YSGHYQF

SEQ ID NO: 21905 - protein, 7 aa, Artificial Sequence
  Synthetic construct
YSGHYQY

SEQ ID NO: 21906 - protein, 7 aa, Artificial Sequence
  Synthetic construct
YSGHYDF

SEQ ID NO: 21907 - protein, 7 aa, Artificial Sequence
  Synthetic construct
YSGHYDY

SEQ ID NO: 21908 - protein, 7 aa, Artificial Sequence
  Synthetic construct
YSGHYVF

SEQ ID NO: 21909 - protein, 7 aa, Artificial Sequence
  Synthetic construct
YSGHYVY

SEQ ID NO: 21910 - protein, 7 aa, Artificial Sequence
  Synthetic construct
YSGHFFF

SEQ ID NO: 21911 - protein, 7 aa, Artificial Sequence
  Synthetic construct
YSGHFFY

SEQ ID NO: 21912 - protein, 7 aa, Artificial Sequence
  Synthetic construct
YSGHFRF

SEQ ID NO: 21913 - protein, 7 aa, Artificial Sequence
  Synthetic construct
YSGHFRY

SEQ ID NO: 21914 - protein, 7 aa, Artificial Sequence
  Synthetic construct
YSGHFCF

SEQ ID NO: 21915 - protein, 7 aa, Artificial Sequence
  Synthetic construct
YSGHFCY

SEQ ID NO: 21916 - protein, 7 aa, Artificial Sequence
  Synthetic construct
YSGHFLF

SEQ ID NO: 21917 - protein, 7 aa, Artificial Sequence
  Synthetic construct
YSGHFLY

SEQ ID NO: 21918 - protein, 7 aa, Artificial Sequence
  Synthetic construct
YSGHFAF

SEQ ID NO: 21919 - protein, 7 aa, Artificial Sequence
  Synthetic construct
YSGHFAY

SEQ ID NO: 21920 - protein, 7 aa, Artificial Sequence
  Synthetic construct
YSGHFQF

SEQ ID NO: 21921 - protein, 7 aa, Artificial Sequence
  Synthetic construct
YSGHFQY

SEQ ID NO: 21922 - protein, 7 aa, Artificial Sequence
  Synthetic construct
YSGHFDF

SEQ ID NO: 21923 - protein, 7 aa, Artificial Sequence
  Synthetic construct
YSGHFDY

SEQ ID NO: 21924 - protein, 7 aa, Artificial Sequence
  Synthetic construct
YSGHFVF

SEQ ID NO: 21925 - protein, 7 aa, Artificial Sequence
  Synthetic construct
YSGHFVY

SEQ ID NO: 21926 - protein, 7 aa, Artificial Sequence
  Synthetic construct
YSGHVFF

SEQ ID NO: 21927 - protein, 7 aa, Artificial Sequence
  Synthetic construct
YSGHVFY

SEQ ID NO: 21928 - protein, 7 aa, Artificial Sequence
  Synthetic construct
YSGHVRF

SEQ ID NO: 21929 - protein, 7 aa, Artificial Sequence
  Synthetic construct
YSGHVRY

SEQ ID NO: 21930 - protein, 7 aa, Artificial Sequence
  Synthetic construct
YSGHVCF

SEQ ID NO: 21931 - protein, 7 aa, Artificial Sequence
  Synthetic construct
YSGHVCY

SEQ ID NO: 21932 - protein, 7 aa, Artificial Sequence
  Synthetic construct
YSGHVLF

SEQ ID NO: 21933 - protein, 7 aa, Artificial Sequence
  Synthetic construct
YSGHVLY

SEQ ID NO: 21934 - protein, 7 aa, Artificial Sequence
  Synthetic construct
YSGHVAF

SEQ ID NO: 21935 - protein, 7 aa, Artificial Sequence
  Synthetic construct
YSGHVAY

SEQ ID NO: 21936 - protein, 7 aa, Artificial Sequence
  Synthetic construct
YSGHVQF

SEQ ID NO: 21937 - protein, 7 aa, Artificial Sequence
  Synthetic construct
YSGHVQY

SEQ ID NO: 21938 - protein, 7 aa, Artificial Sequence
  Synthetic construct
YSGHVDF

SEQ ID NO: 21939 - protein, 7 aa, Artificial Sequence
  Synthetic construct
YSGHVDY

SEQ ID NO: 21940 - protein, 7 aa, Artificial Sequence
  Synthetic construct
YSGHVVF

SEQ ID NO: 21941 - protein, 7 aa, Artificial Sequence
  Synthetic construct
YSGHVVY

SEQ ID NO: 21942 - protein, 7 aa, Artificial Sequence
  Synthetic construct
YSGHTFF

SEQ ID NO: 21943 - protein, 7 aa, Artificial Sequence
  Synthetic construct
YSGHTFY

SEQ ID NO: 21944 - protein, 7 aa, Artificial Sequence
  Synthetic construct
YSGHTRF

SEQ ID NO: 21945 - protein, 7 aa, Artificial Sequence
  Synthetic construct
YSGHTRY

SEQ ID NO: 21946 - protein, 7 aa, Artificial Sequence
  Synthetic construct
YSGHTCF

SEQ ID NO: 21947 - protein, 7 aa, Artificial Sequence
  Synthetic construct
YSGHTCY

SEQ ID NO: 21948 - protein, 7 aa, Artificial Sequence
  Synthetic construct
YSGHTLF

SEQ ID NO: 21949 - protein, 7 aa, Artificial Sequence
  Synthetic construct
YSGHTLY

SEQ ID NO: 21950 - protein, 7 aa, Artificial Sequence
  Synthetic construct
YSGHTAF

SEQ ID NO: 21951 - protein, 7 aa, Artificial Sequence
  Synthetic construct
YSGHTAY

SEQ ID NO: 21952 - protein, 7 aa, Artificial Sequence
  Synthetic construct
YSGHTQF

SEQ ID NO: 21953 - protein, 7 aa, Artificial Sequence
  Synthetic construct
YSGHTQY

SEQ ID NO: 21954 - protein, 7 aa, Artificial Sequence
  Synthetic construct
YSGHTDF

SEQ ID NO: 21955 - protein, 7 aa, Artificial Sequence
  Synthetic construct
YSGHTDY

SEQ ID NO: 21956 - protein, 7 aa, Artificial Sequence
  Synthetic construct
YSGHTVF

SEQ ID NO: 21957 - protein, 7 aa, Artificial Sequence
  Synthetic construct
YSGHTVY

SEQ ID NO: 21958 - protein, 7 aa, Artificial Sequence
  Synthetic construct
YSGHGFF

SEQ ID NO: 21959 - protein, 7 aa, Artificial Sequence
  Synthetic construct
YSGHGFY

SEQ ID NO: 21960 - protein, 7 aa, Artificial Sequence
  Synthetic construct
YSGHGRF

SEQ ID NO: 21961 - protein, 7 aa, Artificial Sequence
  Synthetic construct
YSGHGRY

SEQ ID NO: 21962 - protein, 7 aa, Artificial Sequence
  Synthetic construct
YSGHGCF

SEQ ID NO: 21963 - protein, 7 aa, Artificial Sequence
  Synthetic construct
YSGHGCY

SEQ ID NO: 21964 - protein, 7 aa, Artificial Sequence
  Synthetic construct
YSGHGLF

SEQ ID NO: 21965 - protein, 7 aa, Artificial Sequence
  Synthetic construct
YSGHGLY

SEQ ID NO: 21966 - protein, 7 aa, Artificial Sequence
  Synthetic construct
YSGHGAF

SEQ ID NO: 21967 - protein, 7 aa, Artificial Sequence
  Synthetic construct
YSGHGAY

SEQ ID NO: 21968 - protein, 7 aa, Artificial Sequence
  Synthetic construct
YSGHGQF

SEQ ID NO: 21969 - protein, 7 aa, Artificial Sequence
  Synthetic construct
YSGHGQY

SEQ ID NO: 21970 - protein, 7 aa, Artificial Sequence
  Synthetic construct
YSGHGDF

SEQ ID NO: 21971 - protein, 7 aa, Artificial Sequence
  Synthetic construct
YSGHGDY

SEQ ID NO: 21972 - protein, 7 aa, Artificial Sequence
  Synthetic construct
YSGHGVF

SEQ ID NO: 21973 - protein, 7 aa, Artificial Sequence
  Synthetic construct
YSGHGVY

SEQ ID NO: 21974 - protein, 7 aa, Artificial Sequence
  Synthetic construct
YSGHAFF

SEQ ID NO: 21975 - protein, 7 aa, Artificial Sequence
  Synthetic construct
YSGHAFY

SEQ ID NO: 21976 - protein, 7 aa, Artificial Sequence
  Synthetic construct
YSGHARF

SEQ ID NO: 21977 - protein, 7 aa, Artificial Sequence
  Synthetic construct
YSGHARY

SEQ ID NO: 21978 - protein, 7 aa, Artificial Sequence
  Synthetic construct
YSGHACF

SEQ ID NO: 21979 - protein, 7 aa, Artificial Sequence
  Synthetic construct
YSGHACY

SEQ ID NO: 21980 - protein, 7 aa, Artificial Sequence
  Synthetic construct
YSGHALF

SEQ ID NO: 21981 - protein, 7 aa, Artificial Sequence
  Synthetic construct
YSGHALY

SEQ ID NO: 21982 - protein, 7 aa, Artificial Sequence
  Synthetic construct
YSGHAAF

SEQ ID NO: 21983 - protein, 7 aa, Artificial Sequence
  Synthetic construct
YSGHAAY

SEQ ID NO: 21984 - protein, 7 aa, Artificial Sequence
  Synthetic construct
YSGHAQF

SEQ ID NO: 21985 - protein, 7 aa, Artificial Sequence
  Synthetic construct
YSGHAQY

SEQ ID NO: 21986 - protein, 7 aa, Artificial Sequence
  Synthetic construct
YSGHADF

SEQ ID NO: 21987 - protein, 7 aa, Artificial Sequence
  Synthetic construct
YSGHADY

SEQ ID NO: 21988 - protein, 7 aa, Artificial Sequence
  Synthetic construct
YSGHAVF

SEQ ID NO: 21989 - protein, 7 aa, Artificial Sequence
  Synthetic construct
YSGHAVY

SEQ ID NO: 21990 - protein, 7 aa, Artificial Sequence
  Synthetic construct
YSGHQFF

SEQ ID NO: 21991 - protein, 7 aa, Artificial Sequence
  Synthetic construct
YSGHQFY

SEQ ID NO: 21992 - protein, 7 aa, Artificial Sequence
  Synthetic construct
YSGHQRF

SEQ ID NO: 21993 - protein, 7 aa, Artificial Sequence
  Synthetic construct
YSGHQRY

SEQ ID NO: 21994 - protein, 7 aa, Artificial Sequence
  Synthetic construct
YSGHQCF

SEQ ID NO: 21995 - protein, 7 aa, Artificial Sequence
  Synthetic construct
YSGHQCY

SEQ ID NO: 21996 - protein, 7 aa, Artificial Sequence
  Synthetic construct
YSGHQLF

SEQ ID NO: 21997 - protein, 7 aa, Artificial Sequence
  Synthetic construct
YSGHQLY

SEQ ID NO: 21998 - protein, 7 aa, Artificial Sequence
  Synthetic construct
YSGHQAF

SEQ ID NO: 21999 - protein, 7 aa, Artificial Sequence
  Synthetic construct
YSGHQAY

SEQ ID NO: 22000 - protein, 7 aa, Artificial Sequence
  Synthetic construct
YSGHQQF

SEQ ID NO: 22001 - protein, 7 aa, Artificial Sequence
  Synthetic construct
YSGHQQY

SEQ ID NO: 22002 - protein, 7 aa, Artificial Sequence
  Synthetic construct
YSGHQDF

SEQ ID NO: 22003 - protein, 7 aa, Artificial Sequence
  Synthetic construct
YSGHQDY

SEQ ID NO: 22004 - protein, 7 aa, Artificial Sequence
  Synthetic construct
YSGHQVF

SEQ ID NO: 22005 - protein, 7 aa, Artificial Sequence
  Synthetic construct
YSGHQVY

SEQ ID NO: 22006 - protein, 7 aa, Artificial Sequence
  Synthetic construct
YSGLIFF

SEQ ID NO: 22007 - protein, 7 aa, Artificial Sequence
  Synthetic construct
YSGLIFY

SEQ ID NO: 22008 - protein, 7 aa, Artificial Sequence
  Synthetic construct
YSGLIRF

SEQ ID NO: 22009 - protein, 7 aa, Artificial Sequence
  Synthetic construct
YSGLIRY

SEQ ID NO: 22010 - protein, 7 aa, Artificial Sequence
  Synthetic construct
YSGLICF

SEQ ID NO: 22011 - protein, 7 aa, Artificial Sequence
  Synthetic construct
YSGLICY

SEQ ID NO: 22012 - protein, 7 aa, Artificial Sequence
  Synthetic construct
YSGLILF

SEQ ID NO: 22013 - protein, 7 aa, Artificial Sequence
  Synthetic construct
YSGLILY

SEQ ID NO: 22014 - protein, 7 aa, Artificial Sequence
  Synthetic construct
YSGLIAF

SEQ ID NO: 22015 - protein, 7 aa, Artificial Sequence
  Synthetic construct
YSGLIAY

SEQ ID NO: 22016 - protein, 7 aa, Artificial Sequence
  Synthetic construct
YSGLIQF

SEQ ID NO: 22017 - protein, 7 aa, Artificial Sequence
  Synthetic construct
YSGLIQY

SEQ ID NO: 22018 - protein, 7 aa, Artificial Sequence
  Synthetic construct
YSGLIDF

SEQ ID NO: 22019 - protein, 7 aa, Artificial Sequence
  Synthetic construct
YSGLIDY

SEQ ID NO: 22020 - protein, 7 aa, Artificial Sequence
  Synthetic construct
YSGLIVF

SEQ ID NO: 22021 - protein, 7 aa, Artificial Sequence
  Synthetic construct
YSGLIVY

SEQ ID NO: 22022 - protein, 7 aa, Artificial Sequence
  Synthetic construct
YSGLDFF

SEQ ID NO: 22023 - protein, 7 aa, Artificial Sequence
  Synthetic construct
YSGLDFY

SEQ ID NO: 22024 - protein, 7 aa, Artificial Sequence
  Synthetic construct
YSGLDRF

SEQ ID NO: 22025 - protein, 7 aa, Artificial Sequence
  Synthetic construct
YSGLDRY

SEQ ID NO: 22026 - protein, 7 aa, Artificial Sequence
  Synthetic construct
YSGLDCF

SEQ ID NO: 22027 - protein, 7 aa, Artificial Sequence
  Synthetic construct
YSGLDCY

SEQ ID NO: 22028 - protein, 7 aa, Artificial Sequence
  Synthetic construct
YSGLDLF

SEQ ID NO: 22029 - protein, 7 aa, Artificial Sequence
  Synthetic construct
YSGLDLY

SEQ ID NO: 22030 - protein, 7 aa, Artificial Sequence
  Synthetic construct
YSGLDAF

SEQ ID NO: 22031 - protein, 7 aa, Artificial Sequence
  Synthetic construct
YSGLDAY

SEQ ID NO: 22032 - protein, 7 aa, Artificial Sequence
  Synthetic construct
YSGLDQF

SEQ ID NO: 22033 - protein, 7 aa, Artificial Sequence
  Synthetic construct
YSGLDQY

SEQ ID NO: 22034 - protein, 7 aa, Artificial Sequence
  Synthetic construct
YSGLDDF

SEQ ID NO: 22035 - protein, 7 aa, Artificial Sequence
  Synthetic construct
YSGLDDY

SEQ ID NO: 22036 - protein, 7 aa, Artificial Sequence
  Synthetic construct
YSGLDVF

SEQ ID NO: 22037 - protein, 7 aa, Artificial Sequence
  Synthetic construct
YSGLDVY

SEQ ID NO: 22038 - protein, 7 aa, Artificial Sequence
  Synthetic construct
YSGLYFF

SEQ ID NO: 22039 - protein, 7 aa, Artificial Sequence
  Synthetic construct
YSGLYFY

SEQ ID NO: 22040 - protein, 7 aa, Artificial Sequence
  Synthetic construct
YSGLYRF

SEQ ID NO: 22041 - protein, 7 aa, Artificial Sequence
  Synthetic construct
YSGLYRY

SEQ ID NO: 22042 - protein, 7 aa, Artificial Sequence
  Synthetic construct
YSGLYCF

SEQ ID NO: 22043 - protein, 7 aa, Artificial Sequence
  Synthetic construct
YSGLYCY

SEQ ID NO: 22044 - protein, 7 aa, Artificial Sequence
  Synthetic construct
YSGLYLF

SEQ ID NO: 22045 - protein, 7 aa, Artificial Sequence
  Synthetic construct
YSGLYLY

SEQ ID NO: 22046 - protein, 7 aa, Artificial Sequence
  Synthetic construct
YSGLYAF

SEQ ID NO: 22047 - protein, 7 aa, Artificial Sequence
  Synthetic construct
YSGLYAY

SEQ ID NO: 22048 - protein, 7 aa, Artificial Sequence
  Synthetic construct
YSGLYQF

SEQ ID NO: 22049 - protein, 7 aa, Artificial Sequence
  Synthetic construct
YSGLYQY

SEQ ID NO: 22050 - protein, 7 aa, Artificial Sequence
  Synthetic construct
YSGLYDF

SEQ ID NO: 22051 - protein, 7 aa, Artificial Sequence
  Synthetic construct
YSGLYDY

SEQ ID NO: 22052 - protein, 7 aa, Artificial Sequence
  Synthetic construct
YSGLYVF

SEQ ID NO: 22053 - protein, 7 aa, Artificial Sequence
  Synthetic construct
YSGLYVY

SEQ ID NO: 22054 - protein, 7 aa, Artificial Sequence
  Synthetic construct
YSGLFFF

SEQ ID NO: 22055 - protein, 7 aa, Artificial Sequence
  Synthetic construct
YSGLFFY

SEQ ID NO: 22056 - protein, 7 aa, Artificial Sequence
  Synthetic construct
YSGLFRF

SEQ ID NO: 22057 - protein, 7 aa, Artificial Sequence
  Synthetic construct
YSGLFRY

SEQ ID NO: 22058 - protein, 7 aa, Artificial Sequence
  Synthetic construct
YSGLFCF

SEQ ID NO: 22059 - protein, 7 aa, Artificial Sequence
  Synthetic construct
YSGLFCY

SEQ ID NO: 22060 - protein, 7 aa, Artificial Sequence
  Synthetic construct
YSGLFLF

SEQ ID NO: 22061 - protein, 7 aa, Artificial Sequence
  Synthetic construct
YSGLFLY

SEQ ID NO: 22062 - protein, 7 aa, Artificial Sequence
  Synthetic construct
YSGLFAF

SEQ ID NO: 22063 - protein, 7 aa, Artificial Sequence
  Synthetic construct
YSGLFAY

SEQ ID NO: 22064 - protein, 7 aa, Artificial Sequence
  Synthetic construct
YSGLFQF

SEQ ID NO: 22065 - protein, 7 aa, Artificial Sequence
  Synthetic construct
YSGLFQY

SEQ ID NO: 22066 - protein, 7 aa, Artificial Sequence
  Synthetic construct
YSGLFDF

SEQ ID NO: 22067 - protein, 7 aa, Artificial Sequence
  Synthetic construct
YSGLFDY

SEQ ID NO: 22068 - protein, 7 aa, Artificial Sequence
  Synthetic construct
YSGLFVF

SEQ ID NO: 22069 - protein, 7 aa, Artificial Sequence
  Synthetic construct
YSGLFVY

SEQ ID NO: 22070 - protein, 7 aa, Artificial Sequence
  Synthetic construct
YSGLVFF

SEQ ID NO: 22071 - protein, 7 aa, Artificial Sequence
  Synthetic construct
YSGLVFY

SEQ ID NO: 22072 - protein, 7 aa, Artificial Sequence
  Synthetic construct
YSGLVRF

SEQ ID NO: 22073 - protein, 7 aa, Artificial Sequence
  Synthetic construct
YSGLVRY

SEQ ID NO: 22074 - protein, 7 aa, Artificial Sequence
  Synthetic construct
YSGLVCF

SEQ ID NO: 22075 - protein, 7 aa, Artificial Sequence
  Synthetic construct
YSGLVCY

SEQ ID NO: 22076 - protein, 7 aa, Artificial Sequence
  Synthetic construct
YSGLVLF

SEQ ID NO: 22077 - protein, 7 aa, Artificial Sequence
  Synthetic construct
YSGLVLY

SEQ ID NO: 22078 - protein, 7 aa, Artificial Sequence
  Synthetic construct
YSGLVAF

SEQ ID NO: 22079 - protein, 7 aa, Artificial Sequence
  Synthetic construct
YSGLVAY

SEQ ID NO: 22080 - protein, 7 aa, Artificial Sequence
  Synthetic construct
YSGLVQF

SEQ ID NO: 22081 - protein, 7 aa, Artificial Sequence
  Synthetic construct
YSGLVQY

SEQ ID NO: 22082 - protein, 7 aa, Artificial Sequence
  Synthetic construct
YSGLVDF

SEQ ID NO: 22083 - protein, 7 aa, Artificial Sequence
  Synthetic construct
YSGLVDY

SEQ ID NO: 22084 - protein, 7 aa, Artificial Sequence
  Synthetic construct
YSGLVVF

SEQ ID NO: 22085 - protein, 7 aa, Artificial Sequence
  Synthetic construct
YSGLVVY

SEQ ID NO: 22086 - protein, 7 aa, Artificial Sequence
  Synthetic construct
YSGLTFF

SEQ ID NO: 22087 - protein, 7 aa, Artificial Sequence
  Synthetic construct
YSGLTFY

SEQ ID NO: 22088 - protein, 7 aa, Artificial Sequence
  Synthetic construct
YSGLTRF

SEQ ID NO: 22089 - protein, 7 aa, Artificial Sequence
  Synthetic construct
YSGLTRY

SEQ ID NO: 22090 - protein, 7 aa, Artificial Sequence
  Synthetic construct
YSGLTCF

SEQ ID NO: 22091 - protein, 7 aa, Artificial Sequence
  Synthetic construct
YSGLTCY

SEQ ID NO: 22092 - protein, 7 aa, Artificial Sequence
  Synthetic construct
YSGLTLF

SEQ ID NO: 22093 - protein, 7 aa, Artificial Sequence
  Synthetic construct
YSGLTLY

SEQ ID NO: 22094 - protein, 7 aa, Artificial Sequence
  Synthetic construct
YSGLTAF

SEQ ID NO: 22095 - protein, 7 aa, Artificial Sequence
  Synthetic construct
YSGLTAY

SEQ ID NO: 22096 - protein, 7 aa, Artificial Sequence
  Synthetic construct
YSGLTQF

SEQ ID NO: 22097 - protein, 7 aa, Artificial Sequence
  Synthetic construct
YSGLTQY

SEQ ID NO: 22098 - protein, 7 aa, Artificial Sequence
  Synthetic construct
YSGLTDF

SEQ ID NO: 22099 - protein, 7 aa, Artificial Sequence
  Synthetic construct
YSGLTDY

SEQ ID NO: 22100 - protein, 7 aa, Artificial Sequence
  Synthetic construct
YSGLTVF

SEQ ID NO: 22101 - protein, 7 aa, Artificial Sequence
  Synthetic construct
YSGLTVY

SEQ ID NO: 22102 - protein, 7 aa, Artificial Sequence
  Synthetic construct
YSGLGFF

SEQ ID NO: 22103 - protein, 7 aa, Artificial Sequence
  Synthetic construct
YSGLGFY

SEQ ID NO: 22104 - protein, 7 aa, Artificial Sequence
  Synthetic construct
YSGLGRF

SEQ ID NO: 22105 - protein, 7 aa, Artificial Sequence
  Synthetic construct
YSGLGRY

SEQ ID NO: 22106 - protein, 7 aa, Artificial Sequence
  Synthetic construct
YSGLGCF

SEQ ID NO: 22107 - protein, 7 aa, Artificial Sequence
  Synthetic construct
YSGLGCY

SEQ ID NO: 22108 - protein, 7 aa, Artificial Sequence
  Synthetic construct
YSGLGLF

SEQ ID NO: 22109 - protein, 7 aa, Artificial Sequence
  Synthetic construct
YSGLGLY

SEQ ID NO: 22110 - protein, 7 aa, Artificial Sequence
  Synthetic construct
YSGLGAF

SEQ ID NO: 22111 - protein, 7 aa, Artificial Sequence
  Synthetic construct
YSGLGAY

SEQ ID NO: 22112 - protein, 7 aa, Artificial Sequence
  Synthetic construct
YSGLGQF

SEQ ID NO: 22113 - protein, 7 aa, Artificial Sequence
  Synthetic construct
YSGLGQY

SEQ ID NO: 22114 - protein, 7 aa, Artificial Sequence
  Synthetic construct
YSGLGDF

SEQ ID NO: 22115 - protein, 7 aa, Artificial Sequence
  Synthetic construct
YSGLGDY

SEQ ID NO: 22116 - protein, 7 aa, Artificial Sequence
  Synthetic construct
YSGLGVF

SEQ ID NO: 22117 - protein, 7 aa, Artificial Sequence
  Synthetic construct
YSGLGVY

SEQ ID NO: 22118 - protein, 7 aa, Artificial Sequence
  Synthetic construct
YSGLAFF

SEQ ID NO: 22119 - protein, 7 aa, Artificial Sequence
  Synthetic construct
YSGLAFY

SEQ ID NO: 22120 - protein, 7 aa, Artificial Sequence
  Synthetic construct
YSGLARF

SEQ ID NO: 22121 - protein, 7 aa, Artificial Sequence
  Synthetic construct
YSGLARY

SEQ ID NO: 22122 - protein, 7 aa, Artificial Sequence
  Synthetic construct
YSGLACF

SEQ ID NO: 22123 - protein, 7 aa, Artificial Sequence
  Synthetic construct
YSGLACY

SEQ ID NO: 22124 - protein, 7 aa, Artificial Sequence
  Synthetic construct
YSGLALF

SEQ ID NO: 22125 - protein, 7 aa, Artificial Sequence
  Synthetic construct
YSGLALY

SEQ ID NO: 22126 - protein, 7 aa, Artificial Sequence
  Synthetic construct
YSGLAAF

SEQ ID NO: 22127 - protein, 7 aa, Artificial Sequence
  Synthetic construct
YSGLAAY

SEQ ID NO: 22128 - protein, 7 aa, Artificial Sequence
  Synthetic construct
YSGLAQF

SEQ ID NO: 22129 - protein, 7 aa, Artificial Sequence
  Synthetic construct
YSGLAQY

SEQ ID NO: 22130 - protein, 7 aa, Artificial Sequence
  Synthetic construct
YSGLADF

SEQ ID NO: 22131 - protein, 7 aa, Artificial Sequence
  Synthetic construct
YSGLADY

SEQ ID NO: 22132 - protein, 7 aa, Artificial Sequence
  Synthetic construct
YSGLAVF

SEQ ID NO: 22133 - protein, 7 aa, Artificial Sequence
  Synthetic construct
YSGLAVY

SEQ ID NO: 22134 - protein, 7 aa, Artificial Sequence
  Synthetic construct
YSGLQFF

SEQ ID NO: 22135 - protein, 7 aa, Artificial Sequence
  Synthetic construct
YSGLQFY

SEQ ID NO: 22136 - protein, 7 aa, Artificial Sequence
  Synthetic construct
YSGLQRF

SEQ ID NO: 22137 - protein, 7 aa, Artificial Sequence
  Synthetic construct
YSGLQRY

SEQ ID NO: 22138 - protein, 7 aa, Artificial Sequence
  Synthetic construct
YSGLQCF

SEQ ID NO: 22139 - protein, 7 aa, Artificial Sequence
  Synthetic construct
YSGLQCY

SEQ ID NO: 22140 - protein, 7 aa, Artificial Sequence
  Synthetic construct
YSGLQLF

SEQ ID NO: 22141 - protein, 7 aa, Artificial Sequence
  Synthetic construct
YSGLQLY

SEQ ID NO: 22142 - protein, 7 aa, Artificial Sequence
  Synthetic construct
YSGLQAF

SEQ ID NO: 22143 - protein, 7 aa, Artificial Sequence
  Synthetic construct
YSGLQAY

SEQ ID NO: 22144 - protein, 7 aa, Artificial Sequence
  Synthetic construct
YSGLQQF

SEQ ID NO: 22145 - protein, 7 aa, Artificial Sequence
  Synthetic construct
YSGLQQY

SEQ ID NO: 22146 - protein, 7 aa, Artificial Sequence
  Synthetic construct
YSGLQDF

SEQ ID NO: 22147 - protein, 7 aa, Artificial Sequence
  Synthetic construct
YSGLQDY

SEQ ID NO: 22148 - protein, 7 aa, Artificial Sequence
  Synthetic construct
YSGLQVF

SEQ ID NO: 22149 - protein, 7 aa, Artificial Sequence
  Synthetic construct
YSGLQVY

SEQ ID NO: 22150 - protein, 7 aa, Artificial Sequence
  Synthetic construct
YSGFIFF

SEQ ID NO: 22151 - protein, 7 aa, Artificial Sequence
  Synthetic construct
YSGFIFY

SEQ ID NO: 22152 - protein, 7 aa, Artificial Sequence
  Synthetic construct
YSGFIRF

SEQ ID NO: 22153 - protein, 7 aa, Artificial Sequence
  Synthetic construct
YSGFIRY

SEQ ID NO: 22154 - protein, 7 aa, Artificial Sequence
  Synthetic construct
YSGFICF

SEQ ID NO: 22155 - protein, 7 aa, Artificial Sequence
  Synthetic construct
YSGFICY

SEQ ID NO: 22156 - protein, 7 aa, Artificial Sequence
  Synthetic construct
YSGFILF

SEQ ID NO: 22157 - protein, 7 aa, Artificial Sequence
  Synthetic construct
YSGFILY

SEQ ID NO: 22158 - protein, 7 aa, Artificial Sequence
  Synthetic construct
YSGFIAF

SEQ ID NO: 22159 - protein, 7 aa, Artificial Sequence
  Synthetic construct
YSGFIAY

SEQ ID NO: 22160 - protein, 7 aa, Artificial Sequence
  Synthetic construct
YSGFIQF

SEQ ID NO: 22161 - protein, 7 aa, Artificial Sequence
  Synthetic construct
YSGFIQY

SEQ ID NO: 22162 - protein, 7 aa, Artificial Sequence
  Synthetic construct
YSGFIDF

SEQ ID NO: 22163 - protein, 7 aa, Artificial Sequence
  Synthetic construct
YSGFIDY

SEQ ID NO: 22164 - protein, 7 aa, Artificial Sequence
  Synthetic construct
YSGFIVF

SEQ ID NO: 22165 - protein, 7 aa, Artificial Sequence
  Synthetic construct
YSGFIVY

SEQ ID NO: 22166 - protein, 7 aa, Artificial Sequence
  Synthetic construct
YSGFDFF

SEQ ID NO: 22167 - protein, 7 aa, Artificial Sequence
  Synthetic construct
YSGFDFY

SEQ ID NO: 22168 - protein, 7 aa, Artificial Sequence
  Synthetic construct
YSGFDRF

SEQ ID NO: 22169 - protein, 7 aa, Artificial Sequence
  Synthetic construct
YSGFDRY

SEQ ID NO: 22170 - protein, 7 aa, Artificial Sequence
  Synthetic construct
YSGFDCF

SEQ ID NO: 22171 - protein, 7 aa, Artificial Sequence
  Synthetic construct
YSGFDCY

SEQ ID NO: 22172 - protein, 7 aa, Artificial Sequence
  Synthetic construct
YSGFDLF

SEQ ID NO: 22173 - protein, 7 aa, Artificial Sequence
  Synthetic construct
YSGFDLY

SEQ ID NO: 22174 - protein, 7 aa, Artificial Sequence
  Synthetic construct
YSGFDAF

SEQ ID NO: 22175 - protein, 7 aa, Artificial Sequence
  Synthetic construct
YSGFDAY

SEQ ID NO: 22176 - protein, 7 aa, Artificial Sequence
  Synthetic construct
YSGFDQF

SEQ ID NO: 22177 - protein, 7 aa, Artificial Sequence
  Synthetic construct
YSGFDQY

SEQ ID NO: 22178 - protein, 7 aa, Artificial Sequence
  Synthetic construct
YSGFDDF

SEQ ID NO: 22179 - protein, 7 aa, Artificial Sequence
  Synthetic construct
YSGFDDY

SEQ ID NO: 22180 - protein, 7 aa, Artificial Sequence
  Synthetic construct
YSGFDVF

SEQ ID NO: 22181 - protein, 7 aa, Artificial Sequence
  Synthetic construct
YSGFDVY

SEQ ID NO: 22182 - protein, 7 aa, Artificial Sequence
  Synthetic construct
YSGFYFF

SEQ ID NO: 22183 - protein, 7 aa, Artificial Sequence
  Synthetic construct
YSGFYFY

SEQ ID NO: 22184 - protein, 7 aa, Artificial Sequence
  Synthetic construct
YSGFYRF

SEQ ID NO: 22185 - protein, 7 aa, Artificial Sequence
  Synthetic construct
YSGFYRY

SEQ ID NO: 22186 - protein, 7 aa, Artificial Sequence
  Synthetic construct
YSGFYCF

SEQ ID NO: 22187 - protein, 7 aa, Artificial Sequence
  Synthetic construct
YSGFYCY

SEQ ID NO: 22188 - protein, 7 aa, Artificial Sequence
  Synthetic construct
YSGFYLF

SEQ ID NO: 22189 - protein, 7 aa, Artificial Sequence
  Synthetic construct
YSGFYLY

SEQ ID NO: 22190 - protein, 7 aa, Artificial Sequence
  Synthetic construct
YSGFYAF

SEQ ID NO: 22191 - protein, 7 aa, Artificial Sequence
  Synthetic construct
YSGFYAY

SEQ ID NO: 22192 - protein, 7 aa, Artificial Sequence
  Synthetic construct
YSGFYQF

SEQ ID NO: 22193 - protein, 7 aa, Artificial Sequence
  Synthetic construct
YSGFYQY

SEQ ID NO: 22194 - protein, 7 aa, Artificial Sequence
  Synthetic construct
YSGFYDF

SEQ ID NO: 22195 - protein, 7 aa, Artificial Sequence
  Synthetic construct
YSGFYDY

SEQ ID NO: 22196 - protein, 7 aa, Artificial Sequence
  Synthetic construct
YSGFYVF

SEQ ID NO: 22197 - protein, 7 aa, Artificial Sequence
  Synthetic construct
YSGFYVY

SEQ ID NO: 22198 - protein, 7 aa, Artificial Sequence
  Synthetic construct
YSGFFFF

SEQ ID NO: 22199 - protein, 7 aa, Artificial Sequence
  Synthetic construct
YSGFFFY

SEQ ID NO: 22200 - protein, 7 aa, Artificial Sequence
  Synthetic construct
YSGFFRF

SEQ ID NO: 22201 - protein, 7 aa, Artificial Sequence
  Synthetic construct
YSGFFRY

SEQ ID NO: 22202 - protein, 7 aa, Artificial Sequence
  Synthetic construct
YSGFFCF

SEQ ID NO: 22203 - protein, 7 aa, Artificial Sequence
  Synthetic construct
YSGFFCY

SEQ ID NO: 22204 - protein, 7 aa, Artificial Sequence
  Synthetic construct
YSGFFLF

SEQ ID NO: 22205 - protein, 7 aa, Artificial Sequence
  Synthetic construct
YSGFFLY

SEQ ID NO: 22206 - protein, 7 aa, Artificial Sequence
  Synthetic construct
YSGFFAF

SEQ ID NO: 22207 - protein, 7 aa, Artificial Sequence
  Synthetic construct
YSGFFAY

SEQ ID NO: 22208 - protein, 7 aa, Artificial Sequence
  Synthetic construct
YSGFFQF

SEQ ID NO: 22209 - protein, 7 aa, Artificial Sequence
  Synthetic construct
YSGFFQY

SEQ ID NO: 22210 - protein, 7 aa, Artificial Sequence
  Synthetic construct
YSGFFDF

SEQ ID NO: 22211 - protein, 7 aa, Artificial Sequence
  Synthetic construct
YSGFFDY

SEQ ID NO: 22212 - protein, 7 aa, Artificial Sequence
  Synthetic construct
YSGFFVF

SEQ ID NO: 22213 - protein, 7 aa, Artificial Sequence
  Synthetic construct
YSGFFVY

SEQ ID NO: 22214 - protein, 7 aa, Artificial Sequence
  Synthetic construct
YSGFVFF

SEQ ID NO: 22215 - protein, 7 aa, Artificial Sequence
  Synthetic construct
YSGFVFY

SEQ ID NO: 22216 - protein, 7 aa, Artificial Sequence
  Synthetic construct
YSGFVRF

SEQ ID NO: 22217 - protein, 7 aa, Artificial Sequence
  Synthetic construct
YSGFVRY

SEQ ID NO: 22218 - protein, 7 aa, Artificial Sequence
  Synthetic construct
YSGFVCF

SEQ ID NO: 22219 - protein, 7 aa, Artificial Sequence
  Synthetic construct
YSGFVCY

SEQ ID NO: 22220 - protein, 7 aa, Artificial Sequence
  Synthetic construct
YSGFVLF

SEQ ID NO: 22221 - protein, 7 aa, Artificial Sequence
  Synthetic construct
YSGFVLY

SEQ ID NO: 22222 - protein, 7 aa, Artificial Sequence
  Synthetic construct
YSGFVAF

SEQ ID NO: 22223 - protein, 7 aa, Artificial Sequence
  Synthetic construct
YSGFVAY

SEQ ID NO: 22224 - protein, 7 aa, Artificial Sequence
  Synthetic construct
YSGFVQF

SEQ ID NO: 22225 - protein, 7 aa, Artificial Sequence
  Synthetic construct
YSGFVQY

SEQ ID NO: 22226 - protein, 7 aa, Artificial Sequence
  Synthetic construct
YSGFVDF

SEQ ID NO: 22227 - protein, 7 aa, Artificial Sequence
  Synthetic construct
YSGFVDY

SEQ ID NO: 22228 - protein, 7 aa, Artificial Sequence
  Synthetic construct
YSGFVVF

SEQ ID NO: 22229 - protein, 7 aa, Artificial Sequence
  Synthetic construct
YSGFVVY

SEQ ID NO: 22230 - protein, 7 aa, Artificial Sequence
  Synthetic construct
YSGFTFF

SEQ ID NO: 22231 - protein, 7 aa, Artificial Sequence
  Synthetic construct
YSGFTFY

SEQ ID NO: 22232 - protein, 7 aa, Artificial Sequence
  Synthetic construct
YSGFTRF

SEQ ID NO: 22233 - protein, 7 aa, Artificial Sequence
  Synthetic construct
YSGFTRY

SEQ ID NO: 22234 - protein, 7 aa, Artificial Sequence
  Synthetic construct
YSGFTCF

SEQ ID NO: 22235 - protein, 7 aa, Artificial Sequence
  Synthetic construct
YSGFTCY

SEQ ID NO: 22236 - protein, 7 aa, Artificial Sequence
  Synthetic construct
YSGFTLF

SEQ ID NO: 22237 - protein, 7 aa, Artificial Sequence
  Synthetic construct
YSGFTLY

SEQ ID NO: 22238 - protein, 7 aa, Artificial Sequence
  Synthetic construct
YSGFTAF

SEQ ID NO: 22239 - protein, 7 aa, Artificial Sequence
  Synthetic construct
YSGFTAY

SEQ ID NO: 22240 - protein, 7 aa, Artificial Sequence
  Synthetic construct
YSGFTQF

SEQ ID NO: 22241 - protein, 7 aa, Artificial Sequence
  Synthetic construct
YSGFTQY

SEQ ID NO: 22242 - protein, 7 aa, Artificial Sequence
  Synthetic construct
YSGFTDF

SEQ ID NO: 22243 - protein, 7 aa, Artificial Sequence
  Synthetic construct
YSGFTDY

SEQ ID NO: 22244 - protein, 7 aa, Artificial Sequence
  Synthetic construct
YSGFTVF

SEQ ID NO: 22245 - protein, 7 aa, Artificial Sequence
  Synthetic construct
YSGFTVY

SEQ ID NO: 22246 - protein, 7 aa, Artificial Sequence
  Synthetic construct
YSGFGFF

SEQ ID NO: 22247 - protein, 7 aa, Artificial Sequence
  Synthetic construct
YSGFGFY

SEQ ID NO: 22248 - protein, 7 aa, Artificial Sequence
  Synthetic construct
YSGFGRF

SEQ ID NO: 22249 - protein, 7 aa, Artificial Sequence
  Synthetic construct
YSGFGRY

SEQ ID NO: 22250 - protein, 7 aa, Artificial Sequence
  Synthetic construct
YSGFGCF

SEQ ID NO: 22251 - protein, 7 aa, Artificial Sequence
  Synthetic construct
YSGFGCY

SEQ ID NO: 22252 - protein, 7 aa, Artificial Sequence
  Synthetic construct
YSGFGLF

SEQ ID NO: 22253 - protein, 7 aa, Artificial Sequence
  Synthetic construct
YSGFGLY

SEQ ID NO: 22254 - protein, 7 aa, Artificial Sequence
  Synthetic construct
YSGFGAF

SEQ ID NO: 22255 - protein, 7 aa, Artificial Sequence
  Synthetic construct
YSGFGAY

SEQ ID NO: 22256 - protein, 7 aa, Artificial Sequence
  Synthetic construct
YSGFGQF

SEQ ID NO: 22257 - protein, 7 aa, Artificial Sequence
  Synthetic construct
YSGFGQY

SEQ ID NO: 22258 - protein, 7 aa, Artificial Sequence
  Synthetic construct
YSGFGDF

SEQ ID NO: 22259 - protein, 7 aa, Artificial Sequence
  Synthetic construct
YSGFGDY

SEQ ID NO: 22260 - protein, 7 aa, Artificial Sequence
  Synthetic construct
YSGFGVF

SEQ ID NO: 22261 - protein, 7 aa, Artificial Sequence
  Synthetic construct
YSGFGVY

SEQ ID NO: 22262 - protein, 7 aa, Artificial Sequence
  Synthetic construct
YSGFAFF

SEQ ID NO: 22263 - protein, 7 aa, Artificial Sequence
  Synthetic construct
YSGFAFY

SEQ ID NO: 22264 - protein, 7 aa, Artificial Sequence
  Synthetic construct
YSGFARF

SEQ ID NO: 22265 - protein, 7 aa, Artificial Sequence
  Synthetic construct
YSGFARY

SEQ ID NO: 22266 - protein, 7 aa, Artificial Sequence
  Synthetic construct
YSGFACF

SEQ ID NO: 22267 - protein, 7 aa, Artificial Sequence
  Synthetic construct
YSGFACY

SEQ ID NO: 22268 - protein, 7 aa, Artificial Sequence
  Synthetic construct
YSGFALF

SEQ ID NO: 22269 - protein, 7 aa, Artificial Sequence
  Synthetic construct
YSGFALY

SEQ ID NO: 22270 - protein, 7 aa, Artificial Sequence
  Synthetic construct
YSGFAAF

SEQ ID NO: 22271 - protein, 7 aa, Artificial Sequence
  Synthetic construct
YSGFAAY

SEQ ID NO: 22272 - protein, 7 aa, Artificial Sequence
  Synthetic construct
YSGFAQF

SEQ ID NO: 22273 - protein, 7 aa, Artificial Sequence
  Synthetic construct
YSGFAQY

SEQ ID NO: 22274 - protein, 7 aa, Artificial Sequence
  Synthetic construct
YSGFADF

SEQ ID NO: 22275 - protein, 7 aa, Artificial Sequence
  Synthetic construct
YSGFADY

SEQ ID NO: 22276 - protein, 7 aa, Artificial Sequence
  Synthetic construct
YSGFAVF

SEQ ID NO: 22277 - protein, 7 aa, Artificial Sequence
  Synthetic construct
YSGFAVY

SEQ ID NO: 22278 - protein, 7 aa, Artificial Sequence
  Synthetic construct
YSGFQFF

SEQ ID NO: 22279 - protein, 7 aa, Artificial Sequence
  Synthetic construct
YSGFQFY

SEQ ID NO: 22280 - protein, 7 aa, Artificial Sequence
  Synthetic construct
YSGFQRF

SEQ ID NO: 22281 - protein, 7 aa, Artificial Sequence
  Synthetic construct
YSGFQRY

SEQ ID NO: 22282 - protein, 7 aa, Artificial Sequence
  Synthetic construct
YSGFQCF

SEQ ID NO: 22283 - protein, 7 aa, Artificial Sequence
  Synthetic construct
YSGFQCY

SEQ ID NO: 22284 - protein, 7 aa, Artificial Sequence
  Synthetic construct
YSGFQLF

SEQ ID NO: 22285 - protein, 7 aa, Artificial Sequence
  Synthetic construct
YSGFQLY

SEQ ID NO: 22286 - protein, 7 aa, Artificial Sequence
  Synthetic construct
YSGFQAF

SEQ ID NO: 22287 - protein, 7 aa, Artificial Sequence
  Synthetic construct
YSGFQAY

SEQ ID NO: 22288 - protein, 7 aa, Artificial Sequence
  Synthetic construct
YSGFQQF

SEQ ID NO: 22289 - protein, 7 aa, Artificial Sequence
  Synthetic construct
YSGFQQY

SEQ ID NO: 22290 - protein, 7 aa, Artificial Sequence
  Synthetic construct
YSGFQDF

SEQ ID NO: 22291 - protein, 7 aa, Artificial Sequence
  Synthetic construct
YSGFQDY

SEQ ID NO: 22292 - protein, 7 aa, Artificial Sequence
  Synthetic construct
YSGFQVF

SEQ ID NO: 22293 - protein, 7 aa, Artificial Sequence
  Synthetic construct
YSGFQVY

SEQ ID NO: 22294 - protein, 7 aa, Artificial Sequence
  Synthetic construct
YLIYIFF

SEQ ID NO: 22295 - protein, 7 aa, Artificial Sequence
  Synthetic construct
YLIYIFY

SEQ ID NO: 22296 - protein, 7 aa, Artificial Sequence
  Synthetic construct
YLIYIRF

SEQ ID NO: 22297 - protein, 7 aa, Artificial Sequence
  Synthetic construct
YLIYIRY

SEQ ID NO: 22298 - protein, 7 aa, Artificial Sequence
  Synthetic construct
YLIYICF

SEQ ID NO: 22299 - protein, 7 aa, Artificial Sequence
  Synthetic construct
YLIYICY

SEQ ID NO: 22300 - protein, 7 aa, Artificial Sequence
  Synthetic construct
YLIYILF

SEQ ID NO: 22301 - protein, 7 aa, Artificial Sequence
  Synthetic construct
YLIYILY

SEQ ID NO: 22302 - protein, 7 aa, Artificial Sequence
  Synthetic construct
YLIYIAF

SEQ ID NO: 22303 - protein, 7 aa, Artificial Sequence
  Synthetic construct
YLIYIAY

SEQ ID NO: 22304 - protein, 7 aa, Artificial Sequence
  Synthetic construct
YLIYIQF

SEQ ID NO: 22305 - protein, 7 aa, Artificial Sequence
  Synthetic construct
YLIYIQY

SEQ ID NO: 22306 - protein, 7 aa, Artificial Sequence
  Synthetic construct
YLIYIDF

SEQ ID NO: 22307 - protein, 7 aa, Artificial Sequence
  Synthetic construct
YLIYIDY

SEQ ID NO: 22308 - protein, 7 aa, Artificial Sequence
  Synthetic construct
YLIYIVF

SEQ ID NO: 22309 - protein, 7 aa, Artificial Sequence
  Synthetic construct
YLIYIVY

SEQ ID NO: 22310 - protein, 7 aa, Artificial Sequence
  Synthetic construct
YLIYDFF

SEQ ID NO: 22311 - protein, 7 aa, Artificial Sequence
  Synthetic construct
YLIYDFY

SEQ ID NO: 22312 - protein, 7 aa, Artificial Sequence
  Synthetic construct
YLIYDRF

SEQ ID NO: 22313 - protein, 7 aa, Artificial Sequence
  Synthetic construct
YLIYDRY

SEQ ID NO: 22314 - protein, 7 aa, Artificial Sequence
  Synthetic construct
YLIYDCF

SEQ ID NO: 22315 - protein, 7 aa, Artificial Sequence
  Synthetic construct
YLIYDCY

SEQ ID NO: 22316 - protein, 7 aa, Artificial Sequence
  Synthetic construct
YLIYDLF

SEQ ID NO: 22317 - protein, 7 aa, Artificial Sequence
  Synthetic construct
YLIYDLY

SEQ ID NO: 22318 - protein, 7 aa, Artificial Sequence
  Synthetic construct
YLIYDAF

SEQ ID NO: 22319 - protein, 7 aa, Artificial Sequence
  Synthetic construct
YLIYDAY

SEQ ID NO: 22320 - protein, 7 aa, Artificial Sequence
  Synthetic construct
YLIYDQF

SEQ ID NO: 22321 - protein, 7 aa, Artificial Sequence
  Synthetic construct
YLIYDQY

SEQ ID NO: 22322 - protein, 7 aa, Artificial Sequence
  Synthetic construct
YLIYDDF

SEQ ID NO: 22323 - protein, 7 aa, Artificial Sequence
  Synthetic construct
YLIYDDY

SEQ ID NO: 22324 - protein, 7 aa, Artificial Sequence
  Synthetic construct
YLIYDVF

SEQ ID NO: 22325 - protein, 7 aa, Artificial Sequence
  Synthetic construct
YLIYDVY

SEQ ID NO: 22326 - protein, 7 aa, Artificial Sequence
  Synthetic construct
YLIYYFF

SEQ ID NO: 22327 - protein, 7 aa, Artificial Sequence
  Synthetic construct
YLIYYFY

SEQ ID NO: 22328 - protein, 7 aa, Artificial Sequence
  Synthetic construct
YLIYYRF

SEQ ID NO: 22329 - protein, 7 aa, Artificial Sequence
  Synthetic construct
YLIYYRY

SEQ ID NO: 22330 - protein, 7 aa, Artificial Sequence
  Synthetic construct
YLIYYCF

SEQ ID NO: 22331 - protein, 7 aa, Artificial Sequence
  Synthetic construct
YLIYYCY

SEQ ID NO: 22332 - protein, 7 aa, Artificial Sequence
  Synthetic construct
YLIYYLF

SEQ ID NO: 22333 - protein, 7 aa, Artificial Sequence
  Synthetic construct
YLIYYLY

SEQ ID NO: 22334 - protein, 7 aa, Artificial Sequence
  Synthetic construct
YLIYYAF

SEQ ID NO: 22335 - protein, 7 aa, Artificial Sequence
  Synthetic construct
YLIYYAY

SEQ ID NO: 22336 - protein, 7 aa, Artificial Sequence
  Synthetic construct
YLIYYQF

SEQ ID NO: 22337 - protein, 7 aa, Artificial Sequence
  Synthetic construct
YLIYYQY

SEQ ID NO: 22338 - protein, 7 aa, Artificial Sequence
  Synthetic construct
YLIYYDF

SEQ ID NO: 22339 - protein, 7 aa, Artificial Sequence
  Synthetic construct
YLIYYDY

SEQ ID NO: 22340 - protein, 7 aa, Artificial Sequence
  Synthetic construct
YLIYYVF

SEQ ID NO: 22341 - protein, 7 aa, Artificial Sequence
  Synthetic construct
YLIYYVY

SEQ ID NO: 22342 - protein, 7 aa, Artificial Sequence
  Synthetic construct
YLIYFFF

SEQ ID NO: 22343 - protein, 7 aa, Artificial Sequence
  Synthetic construct
YLIYFFY

SEQ ID NO: 22344 - protein, 7 aa, Artificial Sequence
  Synthetic construct
YLIYFRF

SEQ ID NO: 22345 - protein, 7 aa, Artificial Sequence
  Synthetic construct
YLIYFRY

SEQ ID NO: 22346 - protein, 7 aa, Artificial Sequence
  Synthetic construct
YLIYFCF

SEQ ID NO: 22347 - protein, 7 aa, Artificial Sequence
  Synthetic construct
YLIYFCY

SEQ ID NO: 22348 - protein, 7 aa, Artificial Sequence
  Synthetic construct
YLIYFLF

SEQ ID NO: 22349 - protein, 7 aa, Artificial Sequence
  Synthetic construct
YLIYFLY

SEQ ID NO: 22350 - protein, 7 aa, Artificial Sequence
  Synthetic construct
YLIYFAF

SEQ ID NO: 22351 - protein, 7 aa, Artificial Sequence
  Synthetic construct
YLIYFAY

SEQ ID NO: 22352 - protein, 7 aa, Artificial Sequence
  Synthetic construct
YLIYFQF

SEQ ID NO: 22353 - protein, 7 aa, Artificial Sequence
  Synthetic construct
YLIYFQY

SEQ ID NO: 22354 - protein, 7 aa, Artificial Sequence
  Synthetic construct
YLIYFDF

SEQ ID NO: 22355 - protein, 7 aa, Artificial Sequence
  Synthetic construct
YLIYFDY

SEQ ID NO: 22356 - protein, 7 aa, Artificial Sequence
  Synthetic construct
YLIYFVF

SEQ ID NO: 22357 - protein, 7 aa, Artificial Sequence
  Synthetic construct
YLIYFVY

SEQ ID NO: 22358 - protein, 7 aa, Artificial Sequence
  Synthetic construct
YLIYVFF

SEQ ID NO: 22359 - protein, 7 aa, Artificial Sequence
  Synthetic construct
YLIYVFY

SEQ ID NO: 22360 - protein, 7 aa, Artificial Sequence
  Synthetic construct
YLIYVRF

SEQ ID NO: 22361 - protein, 7 aa, Artificial Sequence
  Synthetic construct
YLIYVRY

SEQ ID NO: 22362 - protein, 7 aa, Artificial Sequence
  Synthetic construct
YLIYVCF

SEQ ID NO: 22363 - protein, 7 aa, Artificial Sequence
  Synthetic construct
YLIYVCY

SEQ ID NO: 22364 - protein, 7 aa, Artificial Sequence
  Synthetic construct
YLIYVLF

SEQ ID NO: 22365 - protein, 7 aa, Artificial Sequence
  Synthetic construct
YLIYVLY

SEQ ID NO: 22366 - protein, 7 aa, Artificial Sequence
  Synthetic construct
YLIYVAF

SEQ ID NO: 22367 - protein, 7 aa, Artificial Sequence
  Synthetic construct
YLIYVAY

SEQ ID NO: 22368 - protein, 7 aa, Artificial Sequence
  Synthetic construct
YLIYVQF

SEQ ID NO: 22369 - protein, 7 aa, Artificial Sequence
  Synthetic construct
YLIYVQY

SEQ ID NO: 22370 - protein, 7 aa, Artificial Sequence
  Synthetic construct
YLIYVDF

SEQ ID NO: 22371 - protein, 7 aa, Artificial Sequence
  Synthetic construct
YLIYVDY

SEQ ID NO: 22372 - protein, 7 aa, Artificial Sequence
  Synthetic construct
YLIYVVF

SEQ ID NO: 22373 - protein, 7 aa, Artificial Sequence
  Synthetic construct
YLIYVVY

SEQ ID NO: 22374 - protein, 7 aa, Artificial Sequence
  Synthetic construct
YLIYTFF

SEQ ID NO: 22375 - protein, 7 aa, Artificial Sequence
  Synthetic construct
YLIYTFY

SEQ ID NO: 22376 - protein, 7 aa, Artificial Sequence
  Synthetic construct
YLIYTRF

SEQ ID NO: 22377 - protein, 7 aa, Artificial Sequence
  Synthetic construct
YLIYTRY

SEQ ID NO: 22378 - protein, 7 aa, Artificial Sequence
  Synthetic construct
YLIYTCF

SEQ ID NO: 22379 - protein, 7 aa, Artificial Sequence
  Synthetic construct
YLIYTCY

SEQ ID NO: 22380 - protein, 7 aa, Artificial Sequence
  Synthetic construct
YLIYTLF

SEQ ID NO: 22381 - protein, 7 aa, Artificial Sequence
  Synthetic construct
YLIYTLY

SEQ ID NO: 22382 - protein, 7 aa, Artificial Sequence
  Synthetic construct
YLIYTAF

SEQ ID NO: 22383 - protein, 7 aa, Artificial Sequence
  Synthetic construct
YLIYTAY

SEQ ID NO: 22384 - protein, 7 aa, Artificial Sequence
  Synthetic construct
YLIYTQF

SEQ ID NO: 22385 - protein, 7 aa, Artificial Sequence
  Synthetic construct
YLIYTQY

SEQ ID NO: 22386 - protein, 7 aa, Artificial Sequence
  Synthetic construct
YLIYTDF

SEQ ID NO: 22387 - protein, 7 aa, Artificial Sequence
  Synthetic construct
YLIYTDY

SEQ ID NO: 22388 - protein, 7 aa, Artificial Sequence
  Synthetic construct
YLIYTVF

SEQ ID NO: 22389 - protein, 7 aa, Artificial Sequence
  Synthetic construct
YLIYTVY

SEQ ID NO: 22390 - protein, 7 aa, Artificial Sequence
  Synthetic construct
YLIYGFF

SEQ ID NO: 22391 - protein, 7 aa, Artificial Sequence
  Synthetic construct
YLIYGFY

SEQ ID NO: 22392 - protein, 7 aa, Artificial Sequence
  Synthetic construct
YLIYGRF

SEQ ID NO: 22393 - protein, 7 aa, Artificial Sequence
  Synthetic construct
YLIYGRY

SEQ ID NO: 22394 - protein, 7 aa, Artificial Sequence
  Synthetic construct
YLIYGCF

SEQ ID NO: 22395 - protein, 7 aa, Artificial Sequence
  Synthetic construct
YLIYGCY

SEQ ID NO: 22396 - protein, 7 aa, Artificial Sequence
  Synthetic construct
YLIYGLF

SEQ ID NO: 22397 - protein, 7 aa, Artificial Sequence
  Synthetic construct
YLIYGLY

SEQ ID NO: 22398 - protein, 7 aa, Artificial Sequence
  Synthetic construct
YLIYGAF

SEQ ID NO: 22399 - protein, 7 aa, Artificial Sequence
  Synthetic construct
YLIYGAY

SEQ ID NO: 22400 - protein, 7 aa, Artificial Sequence
  Synthetic construct
YLIYGQF

SEQ ID NO: 22401 - protein, 7 aa, Artificial Sequence
  Synthetic construct
YLIYGQY

SEQ ID NO: 22402 - protein, 7 aa, Artificial Sequence
  Synthetic construct
YLIYGDF

SEQ ID NO: 22403 - protein, 7 aa, Artificial Sequence
  Synthetic construct
YLIYGDY

SEQ ID NO: 22404 - protein, 7 aa, Artificial Sequence
  Synthetic construct
YLIYGVF

SEQ ID NO: 22405 - protein, 7 aa, Artificial Sequence
  Synthetic construct
YLIYGVY

SEQ ID NO: 22406 - protein, 7 aa, Artificial Sequence
  Synthetic construct
YLIYAFF

SEQ ID NO: 22407 - protein, 7 aa, Artificial Sequence
  Synthetic construct
YLIYAFY

SEQ ID NO: 22408 - protein, 7 aa, Artificial Sequence
  Synthetic construct
YLIYARF

SEQ ID NO: 22409 - protein, 7 aa, Artificial Sequence
  Synthetic construct
YLIYARY

SEQ ID NO: 22410 - protein, 7 aa, Artificial Sequence
  Synthetic construct
YLIYACF

SEQ ID NO: 22411 - protein, 7 aa, Artificial Sequence
  Synthetic construct
YLIYACY

SEQ ID NO: 22412 - protein, 7 aa, Artificial Sequence
  Synthetic construct
YLIYALF

SEQ ID NO: 22413 - protein, 7 aa, Artificial Sequence
  Synthetic construct
YLIYALY

SEQ ID NO: 22414 - protein, 7 aa, Artificial Sequence
  Synthetic construct
YLIYAAF

SEQ ID NO: 22415 - protein, 7 aa, Artificial Sequence
  Synthetic construct
YLIYAAY

SEQ ID NO: 22416 - protein, 7 aa, Artificial Sequence
  Synthetic construct
YLIYAQF

SEQ ID NO: 22417 - protein, 7 aa, Artificial Sequence
  Synthetic construct
YLIYAQY

SEQ ID NO: 22418 - protein, 7 aa, Artificial Sequence
  Synthetic construct
YLIYADF

SEQ ID NO: 22419 - protein, 7 aa, Artificial Sequence
  Synthetic construct
YLIYADY

SEQ ID NO: 22420 - protein, 7 aa, Artificial Sequence
  Synthetic construct
YLIYAVF

SEQ ID NO: 22421 - protein, 7 aa, Artificial Sequence
  Synthetic construct
YLIYAVY

SEQ ID NO: 22422 - protein, 7 aa, Artificial Sequence
  Synthetic construct
YLIYQFF

SEQ ID NO: 22423 - protein, 7 aa, Artificial Sequence
  Synthetic construct
YLIYQFY

SEQ ID NO: 22424 - protein, 7 aa, Artificial Sequence
  Synthetic construct
YLIYQRF

SEQ ID NO: 22425 - protein, 7 aa, Artificial Sequence
  Synthetic construct
YLIYQRY

SEQ ID NO: 22426 - protein, 7 aa, Artificial Sequence
  Synthetic construct
YLIYQCF

SEQ ID NO: 22427 - protein, 7 aa, Artificial Sequence
  Synthetic construct
YLIYQCY

SEQ ID NO: 22428 - protein, 7 aa, Artificial Sequence
  Synthetic construct
YLIYQLF

SEQ ID NO: 22429 - protein, 7 aa, Artificial Sequence
  Synthetic construct
YLIYQLY

SEQ ID NO: 22430 - protein, 7 aa, Artificial Sequence
  Synthetic construct
YLIYQAF

SEQ ID NO: 22431 - protein, 7 aa, Artificial Sequence
  Synthetic construct
YLIYQAY

SEQ ID NO: 22432 - protein, 7 aa, Artificial Sequence
  Synthetic construct
YLIYQQF

SEQ ID NO: 22433 - protein, 7 aa, Artificial Sequence
  Synthetic construct
YLIYQQY

SEQ ID NO: 22434 - protein, 7 aa, Artificial Sequence
  Synthetic construct
YLIYQDF

SEQ ID NO: 22435 - protein, 7 aa, Artificial Sequence
  Synthetic construct
YLIYQDY

SEQ ID NO: 22436 - protein, 7 aa, Artificial Sequence
  Synthetic construct
YLIYQVF

SEQ ID NO: 22437 - protein, 7 aa, Artificial Sequence
  Synthetic construct
YLIYQVY

SEQ ID NO: 22438 - protein, 7 aa, Artificial Sequence
  Synthetic construct
YLIPIFF

SEQ ID NO: 22439 - protein, 7 aa, Artificial Sequence
  Synthetic construct
YLIPIFY

SEQ ID NO: 22440 - protein, 7 aa, Artificial Sequence
  Synthetic construct
YLIPIRF

SEQ ID NO: 22441 - protein, 7 aa, Artificial Sequence
  Synthetic construct
YLIPIRY

SEQ ID NO: 22442 - protein, 7 aa, Artificial Sequence
  Synthetic construct
YLIPICF

SEQ ID NO: 22443 - protein, 7 aa, Artificial Sequence
  Synthetic construct
YLIPICY

SEQ ID NO: 22444 - protein, 7 aa, Artificial Sequence
  Synthetic construct
YLIPILF

SEQ ID NO: 22445 - protein, 7 aa, Artificial Sequence
  Synthetic construct
YLIPILY

SEQ ID NO: 22446 - protein, 7 aa, Artificial Sequence
  Synthetic construct
YLIPIAF

SEQ ID NO: 22447 - protein, 7 aa, Artificial Sequence
  Synthetic construct
YLIPIAY

SEQ ID NO: 22448 - protein, 7 aa, Artificial Sequence
  Synthetic construct
YLIPIQF

SEQ ID NO: 22449 - protein, 7 aa, Artificial Sequence
  Synthetic construct
YLIPIQY

SEQ ID NO: 22450 - protein, 7 aa, Artificial Sequence
  Synthetic construct
YLIPIDF

SEQ ID NO: 22451 - protein, 7 aa, Artificial Sequence
  Synthetic construct
YLIPIDY

SEQ ID NO: 22452 - protein, 7 aa, Artificial Sequence
  Synthetic construct
YLIPIVF

SEQ ID NO: 22453 - protein, 7 aa, Artificial Sequence
  Synthetic construct
YLIPIVY

SEQ ID NO: 22454 - protein, 7 aa, Artificial Sequence
  Synthetic construct
YLIPDFF

SEQ ID NO: 22455 - protein, 7 aa, Artificial Sequence
  Synthetic construct
YLIPDFY

SEQ ID NO: 22456 - protein, 7 aa, Artificial Sequence
  Synthetic construct
YLIPDRF

SEQ ID NO: 22457 - protein, 7 aa, Artificial Sequence
  Synthetic construct
YLIPDRY

SEQ ID NO: 22458 - protein, 7 aa, Artificial Sequence
  Synthetic construct
YLIPDCF

SEQ ID NO: 22459 - protein, 7 aa, Artificial Sequence
  Synthetic construct
YLIPDCY

SEQ ID NO: 22460 - protein, 7 aa, Artificial Sequence
  Synthetic construct
YLIPDLF

SEQ ID NO: 22461 - protein, 7 aa, Artificial Sequence
  Synthetic construct
YLIPDLY

SEQ ID NO: 22462 - protein, 7 aa, Artificial Sequence
  Synthetic construct
YLIPDAF

SEQ ID NO: 22463 - protein, 7 aa, Artificial Sequence
  Synthetic construct
YLIPDAY

SEQ ID NO: 22464 - protein, 7 aa, Artificial Sequence
  Synthetic construct
YLIPDQF

SEQ ID NO: 22465 - protein, 7 aa, Artificial Sequence
  Synthetic construct
YLIPDQY

SEQ ID NO: 22466 - protein, 7 aa, Artificial Sequence
  Synthetic construct
YLIPDDF

SEQ ID NO: 22467 - protein, 7 aa, Artificial Sequence
  Synthetic construct
YLIPDDY

SEQ ID NO: 22468 - protein, 7 aa, Artificial Sequence
  Synthetic construct
YLIPDVF

SEQ ID NO: 22469 - protein, 7 aa, Artificial Sequence
  Synthetic construct
YLIPDVY

SEQ ID NO: 22470 - protein, 7 aa, Artificial Sequence
  Synthetic construct
YLIPYFF

SEQ ID NO: 22471 - protein, 7 aa, Artificial Sequence
  Synthetic construct
YLIPYFY

SEQ ID NO: 22472 - protein, 7 aa, Artificial Sequence
  Synthetic construct
YLIPYRF

SEQ ID NO: 22473 - protein, 7 aa, Artificial Sequence
  Synthetic construct
YLIPYRY

SEQ ID NO: 22474 - protein, 7 aa, Artificial Sequence
  Synthetic construct
YLIPYCF

SEQ ID NO: 22475 - protein, 7 aa, Artificial Sequence
  Synthetic construct
YLIPYCY

SEQ ID NO: 22476 - protein, 7 aa, Artificial Sequence
  Synthetic construct
YLIPYLF

SEQ ID NO: 22477 - protein, 7 aa, Artificial Sequence
  Synthetic construct
YLIPYLY

SEQ ID NO: 22478 - protein, 7 aa, Artificial Sequence
  Synthetic construct
YLIPYAF

SEQ ID NO: 22479 - protein, 7 aa, Artificial Sequence
  Synthetic construct
YLIPYAY

SEQ ID NO: 22480 - protein, 7 aa, Artificial Sequence
  Synthetic construct
YLIPYQF

SEQ ID NO: 22481 - protein, 7 aa, Artificial Sequence
  Synthetic construct
YLIPYQY

SEQ ID NO: 22482 - protein, 7 aa, Artificial Sequence
  Synthetic construct
YLIPYDF

SEQ ID NO: 22483 - protein, 7 aa, Artificial Sequence
  Synthetic construct
YLIPYDY

SEQ ID NO: 22484 - protein, 7 aa, Artificial Sequence
  Synthetic construct
YLIPYVF

SEQ ID NO: 22485 - protein, 7 aa, Artificial Sequence
  Synthetic construct
YLIPYVY

SEQ ID NO: 22486 - protein, 7 aa, Artificial Sequence
  Synthetic construct
YLIPFFF

SEQ ID NO: 22487 - protein, 7 aa, Artificial Sequence
  Synthetic construct
YLIPFFY

SEQ ID NO: 22488 - protein, 7 aa, Artificial Sequence
  Synthetic construct
YLIPFRF

SEQ ID NO: 22489 - protein, 7 aa, Artificial Sequence
  Synthetic construct
YLIPFRY

SEQ ID NO: 22490 - protein, 7 aa, Artificial Sequence
  Synthetic construct
YLIPFCF

SEQ ID NO: 22491 - protein, 7 aa, Artificial Sequence
  Synthetic construct
YLIPFCY

SEQ ID NO: 22492 - protein, 7 aa, Artificial Sequence
  Synthetic construct
YLIPFLF

SEQ ID NO: 22493 - protein, 7 aa, Artificial Sequence
  Synthetic construct
YLIPFLY

SEQ ID NO: 22494 - protein, 7 aa, Artificial Sequence
  Synthetic construct
YLIPFAF

SEQ ID NO: 22495 - protein, 7 aa, Artificial Sequence
  Synthetic construct
YLIPFAY

SEQ ID NO: 22496 - protein, 7 aa, Artificial Sequence
  Synthetic construct
YLIPFQF

SEQ ID NO: 22497 - protein, 7 aa, Artificial Sequence
  Synthetic construct
YLIPFQY

SEQ ID NO: 22498 - protein, 7 aa, Artificial Sequence
  Synthetic construct
YLIPFDF

SEQ ID NO: 22499 - protein, 7 aa, Artificial Sequence
  Synthetic construct
YLIPFDY

SEQ ID NO: 22500 - protein, 7 aa, Artificial Sequence
  Synthetic construct
YLIPFVF

SEQ ID NO: 22501 - protein, 7 aa, Artificial Sequence
  Synthetic construct
YLIPFVY

SEQ ID NO: 22502 - protein, 7 aa, Artificial Sequence
  Synthetic construct
YLIPVFF

SEQ ID NO: 22503 - protein, 7 aa, Artificial Sequence
  Synthetic construct
YLIPVFY

SEQ ID NO: 22504 - protein, 7 aa, Artificial Sequence
  Synthetic construct
YLIPVRF

SEQ ID NO: 22505 - protein, 7 aa, Artificial Sequence
  Synthetic construct
YLIPVRY

SEQ ID NO: 22506 - protein, 7 aa, Artificial Sequence
  Synthetic construct
YLIPVCF

SEQ ID NO: 22507 - protein, 7 aa, Artificial Sequence
  Synthetic construct
YLIPVCY

SEQ ID NO: 22508 - protein, 7 aa, Artificial Sequence
  Synthetic construct
YLIPVLF

SEQ ID NO: 22509 - protein, 7 aa, Artificial Sequence
  Synthetic construct
YLIPVLY

SEQ ID NO: 22510 - protein, 7 aa, Artificial Sequence
  Synthetic construct
YLIPVAF

SEQ ID NO: 22511 - protein, 7 aa, Artificial Sequence
  Synthetic construct
YLIPVAY

SEQ ID NO: 22512 - protein, 7 aa, Artificial Sequence
  Synthetic construct
YLIPVQF

SEQ ID NO: 22513 - protein, 7 aa, Artificial Sequence
  Synthetic construct
YLIPVQY

SEQ ID NO: 22514 - protein, 7 aa, Artificial Sequence
  Synthetic construct
YLIPVDF

SEQ ID NO: 22515 - protein, 7 aa, Artificial Sequence
  Synthetic construct
YLIPVDY

SEQ ID NO: 22516 - protein, 7 aa, Artificial Sequence
  Synthetic construct
YLIPVVF

SEQ ID NO: 22517 - protein, 7 aa, Artificial Sequence
  Synthetic construct
YLIPVVY

SEQ ID NO: 22518 - protein, 7 aa, Artificial Sequence
  Synthetic construct
YLIPTFF

SEQ ID NO: 22519 - protein, 7 aa, Artificial Sequence
  Synthetic construct
YLIPTFY

SEQ ID NO: 22520 - protein, 7 aa, Artificial Sequence
  Synthetic construct
YLIPTRF

SEQ ID NO: 22521 - protein, 7 aa, Artificial Sequence
  Synthetic construct
YLIPTRY

SEQ ID NO: 22522 - protein, 7 aa, Artificial Sequence
  Synthetic construct
YLIPTCF

SEQ ID NO: 22523 - protein, 7 aa, Artificial Sequence
  Synthetic construct
YLIPTCY

SEQ ID NO: 22524 - protein, 7 aa, Artificial Sequence
  Synthetic construct
YLIPTLF

SEQ ID NO: 22525 - protein, 7 aa, Artificial Sequence
  Synthetic construct
YLIPTLY

SEQ ID NO: 22526 - protein, 7 aa, Artificial Sequence
  Synthetic construct
YLIPTAF

SEQ ID NO: 22527 - protein, 7 aa, Artificial Sequence
  Synthetic construct
YLIPTAY

SEQ ID NO: 22528 - protein, 7 aa, Artificial Sequence
  Synthetic construct
YLIPTQF

SEQ ID NO: 22529 - protein, 7 aa, Artificial Sequence
  Synthetic construct
YLIPTQY

SEQ ID NO: 22530 - protein, 7 aa, Artificial Sequence
  Synthetic construct
YLIPTDF

SEQ ID NO: 22531 - protein, 7 aa, Artificial Sequence
  Synthetic construct
YLIPTDY

SEQ ID NO: 22532 - protein, 7 aa, Artificial Sequence
  Synthetic construct
YLIPTVF

SEQ ID NO: 22533 - protein, 7 aa, Artificial Sequence
  Synthetic construct
YLIPTVY

SEQ ID NO: 22534 - protein, 7 aa, Artificial Sequence
  Synthetic construct
YLIPGFF

SEQ ID NO: 22535 - protein, 7 aa, Artificial Sequence
  Synthetic construct
YLIPGFY

SEQ ID NO: 22536 - protein, 7 aa, Artificial Sequence
  Synthetic construct
YLIPGRF

SEQ ID NO: 22537 - protein, 7 aa, Artificial Sequence
  Synthetic construct
YLIPGRY

SEQ ID NO: 22538 - protein, 7 aa, Artificial Sequence
  Synthetic construct
YLIPGCF

SEQ ID NO: 22539 - protein, 7 aa, Artificial Sequence
  Synthetic construct
YLIPGCY

SEQ ID NO: 22540 - protein, 7 aa, Artificial Sequence
  Synthetic construct
YLIPGLF

SEQ ID NO: 22541 - protein, 7 aa, Artificial Sequence
  Synthetic construct
YLIPGLY

SEQ ID NO: 22542 - protein, 7 aa, Artificial Sequence
  Synthetic construct
YLIPGAF

SEQ ID NO: 22543 - protein, 7 aa, Artificial Sequence
  Synthetic construct
YLIPGAY

SEQ ID NO: 22544 - protein, 7 aa, Artificial Sequence
  Synthetic construct
YLIPGQF

SEQ ID NO: 22545 - protein, 7 aa, Artificial Sequence
  Synthetic construct
YLIPGQY

SEQ ID NO: 22546 - protein, 7 aa, Artificial Sequence
  Synthetic construct
YLIPGDF

SEQ ID NO: 22547 - protein, 7 aa, Artificial Sequence
  Synthetic construct
YLIPGDY

SEQ ID NO: 22548 - protein, 7 aa, Artificial Sequence
  Synthetic construct
YLIPGVF

SEQ ID NO: 22549 - protein, 7 aa, Artificial Sequence
  Synthetic construct
YLIPGVY

SEQ ID NO: 22550 - protein, 7 aa, Artificial Sequence
  Synthetic construct
YLIPAFF

SEQ ID NO: 22551 - protein, 7 aa, Artificial Sequence
  Synthetic construct
YLIPAFY

SEQ ID NO: 22552 - protein, 7 aa, Artificial Sequence
  Synthetic construct
YLIPARF

SEQ ID NO: 22553 - protein, 7 aa, Artificial Sequence
  Synthetic construct
YLIPARY

SEQ ID NO: 22554 - protein, 7 aa, Artificial Sequence
  Synthetic construct
YLIPACF

SEQ ID NO: 22555 - protein, 7 aa, Artificial Sequence
  Synthetic construct
YLIPACY

SEQ ID NO: 22556 - protein, 7 aa, Artificial Sequence
  Synthetic construct
YLIPALF

SEQ ID NO: 22557 - protein, 7 aa, Artificial Sequence
  Synthetic construct
YLIPALY

SEQ ID NO: 22558 - protein, 7 aa, Artificial Sequence
  Synthetic construct
YLIPAAF

SEQ ID NO: 22559 - protein, 7 aa, Artificial Sequence
  Synthetic construct
YLIPAAY

SEQ ID NO: 22560 - protein, 7 aa, Artificial Sequence
  Synthetic construct
YLIPAQF

SEQ ID NO: 22561 - protein, 7 aa, Artificial Sequence
  Synthetic construct
YLIPAQY

SEQ ID NO: 22562 - protein, 7 aa, Artificial Sequence
  Synthetic construct
YLIPADF

SEQ ID NO: 22563 - protein, 7 aa, Artificial Sequence
  Synthetic construct
YLIPADY

SEQ ID NO: 22564 - protein, 7 aa, Artificial Sequence
  Synthetic construct
YLIPAVF

SEQ ID NO: 22565 - protein, 7 aa, Artificial Sequence
  Synthetic construct
YLIPAVY

SEQ ID NO: 22566 - protein, 7 aa, Artificial Sequence
  Synthetic construct
YLIPQFF

SEQ ID NO: 22567 - protein, 7 aa, Artificial Sequence
  Synthetic construct
YLIPQFY

SEQ ID NO: 22568 - protein, 7 aa, Artificial Sequence
  Synthetic construct
YLIPQRF

SEQ ID NO: 22569 - protein, 7 aa, Artificial Sequence
  Synthetic construct
YLIPQRY

SEQ ID NO: 22570 - protein, 7 aa, Artificial Sequence
  Synthetic construct
YLIPQCF

SEQ ID NO: 22571 - protein, 7 aa, Artificial Sequence
  Synthetic construct
YLIPQCY

SEQ ID NO: 22572 - protein, 7 aa, Artificial Sequence
  Synthetic construct
YLIPQLF

SEQ ID NO: 22573 - protein, 7 aa, Artificial Sequence
  Synthetic construct
YLIPQLY

SEQ ID NO: 22574 - protein, 7 aa, Artificial Sequence
  Synthetic construct
YLIPQAF

SEQ ID NO: 22575 - protein, 7 aa, Artificial Sequence
  Synthetic construct
YLIPQAY

SEQ ID NO: 22576 - protein, 7 aa, Artificial Sequence
  Synthetic construct
YLIPQQF

SEQ ID NO: 22577 - protein, 7 aa, Artificial Sequence
  Synthetic construct
YLIPQQY

SEQ ID NO: 22578 - protein, 7 aa, Artificial Sequence
  Synthetic construct
YLIPQDF

SEQ ID NO: 22579 - protein, 7 aa, Artificial Sequence
  Synthetic construct
YLIPQDY

SEQ ID NO: 22580 - protein, 7 aa, Artificial Sequence
  Synthetic construct
YLIPQVF

SEQ ID NO: 22581 - protein, 7 aa, Artificial Sequence
  Synthetic construct
YLIPQVY

SEQ ID NO: 22582 - protein, 7 aa, Artificial Sequence
  Synthetic construct
YLIHIFF

SEQ ID NO: 22583 - protein, 7 aa, Artificial Sequence
  Synthetic construct
YLIHIFY

SEQ ID NO: 22584 - protein, 7 aa, Artificial Sequence
  Synthetic construct
YLIHIRF

SEQ ID NO: 22585 - protein, 7 aa, Artificial Sequence
  Synthetic construct
YLIHIRY

SEQ ID NO: 22586 - protein, 7 aa, Artificial Sequence
  Synthetic construct
YLIHICF

SEQ ID NO: 22587 - protein, 7 aa, Artificial Sequence
  Synthetic construct
YLIHICY

SEQ ID NO: 22588 - protein, 7 aa, Artificial Sequence
  Synthetic construct
YLIHILF

SEQ ID NO: 22589 - protein, 7 aa, Artificial Sequence
  Synthetic construct
YLIHILY

SEQ ID NO: 22590 - protein, 7 aa, Artificial Sequence
  Synthetic construct
YLIHIAF

SEQ ID NO: 22591 - protein, 7 aa, Artificial Sequence
  Synthetic construct
YLIHIAY

SEQ ID NO: 22592 - protein, 7 aa, Artificial Sequence
  Synthetic construct
YLIHIQF

SEQ ID NO: 22593 - protein, 7 aa, Artificial Sequence
  Synthetic construct
YLIHIQY

SEQ ID NO: 22594 - protein, 7 aa, Artificial Sequence
  Synthetic construct
YLIHIDF

SEQ ID NO: 22595 - protein, 7 aa, Artificial Sequence
  Synthetic construct
YLIHIDY

SEQ ID NO: 22596 - protein, 7 aa, Artificial Sequence
  Synthetic construct
YLIHIVF

SEQ ID NO: 22597 - protein, 7 aa, Artificial Sequence
  Synthetic construct
YLIHIVY

SEQ ID NO: 22598 - protein, 7 aa, Artificial Sequence
  Synthetic construct
YLIHDFF

SEQ ID NO: 22599 - protein, 7 aa, Artificial Sequence
  Synthetic construct
YLIHDFY

SEQ ID NO: 22600 - protein, 7 aa, Artificial Sequence
  Synthetic construct
YLIHDRF

SEQ ID NO: 22601 - protein, 7 aa, Artificial Sequence
  Synthetic construct
YLIHDRY

SEQ ID NO: 22602 - protein, 7 aa, Artificial Sequence
  Synthetic construct
YLIHDCF

SEQ ID NO: 22603 - protein, 7 aa, Artificial Sequence
  Synthetic construct
YLIHDCY

SEQ ID NO: 22604 - protein, 7 aa, Artificial Sequence
  Synthetic construct
YLIHDLF

SEQ ID NO: 22605 - protein, 7 aa, Artificial Sequence
  Synthetic construct
YLIHDLY

SEQ ID NO: 22606 - protein, 7 aa, Artificial Sequence
  Synthetic construct
YLIHDAF

SEQ ID NO: 22607 - protein, 7 aa, Artificial Sequence
  Synthetic construct
YLIHDAY

SEQ ID NO: 22608 - protein, 7 aa, Artificial Sequence
  Synthetic construct
YLIHDQF

SEQ ID NO: 22609 - protein, 7 aa, Artificial Sequence
  Synthetic construct
YLIHDQY

SEQ ID NO: 22610 - protein, 7 aa, Artificial Sequence
  Synthetic construct
YLIHDDF

SEQ ID NO: 22611 - protein, 7 aa, Artificial Sequence
  Synthetic construct
YLIHDDY

SEQ ID NO: 22612 - protein, 7 aa, Artificial Sequence
  Synthetic construct
YLIHDVF

SEQ ID NO: 22613 - protein, 7 aa, Artificial Sequence
  Synthetic construct
YLIHDVY

SEQ ID NO: 22614 - protein, 7 aa, Artificial Sequence
  Synthetic construct
YLIHYFF

SEQ ID NO: 22615 - protein, 7 aa, Artificial Sequence
  Synthetic construct
YLIHYFY

SEQ ID NO: 22616 - protein, 7 aa, Artificial Sequence
  Synthetic construct
YLIHYRF

SEQ ID NO: 22617 - protein, 7 aa, Artificial Sequence
  Synthetic construct
YLIHYRY

SEQ ID NO: 22618 - protein, 7 aa, Artificial Sequence
  Synthetic construct
YLIHYCF

SEQ ID NO: 22619 - protein, 7 aa, Artificial Sequence
  Synthetic construct
YLIHYCY

SEQ ID NO: 22620 - protein, 7 aa, Artificial Sequence
  Synthetic construct
YLIHYLF

SEQ ID NO: 22621 - protein, 7 aa, Artificial Sequence
  Synthetic construct
YLIHYLY

SEQ ID NO: 22622 - protein, 7 aa, Artificial Sequence
  Synthetic construct
YLIHYAF

SEQ ID NO: 22623 - protein, 7 aa, Artificial Sequence
  Synthetic construct
YLIHYAY

SEQ ID NO: 22624 - protein, 7 aa, Artificial Sequence
  Synthetic construct
YLIHYQF

SEQ ID NO: 22625 - protein, 7 aa, Artificial Sequence
  Synthetic construct
YLIHYQY

SEQ ID NO: 22626 - protein, 7 aa, Artificial Sequence
  Synthetic construct
YLIHYDF

SEQ ID NO: 22627 - protein, 7 aa, Artificial Sequence
  Synthetic construct
YLIHYDY

SEQ ID NO: 22628 - protein, 7 aa, Artificial Sequence
  Synthetic construct
YLIHYVF

SEQ ID NO: 22629 - protein, 7 aa, Artificial Sequence
  Synthetic construct
YLIHYVY

SEQ ID NO: 22630 - protein, 7 aa, Artificial Sequence
  Synthetic construct
YLIHFFF

SEQ ID NO: 22631 - protein, 7 aa, Artificial Sequence
  Synthetic construct
YLIHFFY

SEQ ID NO: 22632 - protein, 7 aa, Artificial Sequence
  Synthetic construct
YLIHFRF

SEQ ID NO: 22633 - protein, 7 aa, Artificial Sequence
  Synthetic construct
YLIHFRY

SEQ ID NO: 22634 - protein, 7 aa, Artificial Sequence
  Synthetic construct
YLIHFCF

SEQ ID NO: 22635 - protein, 7 aa, Artificial Sequence
  Synthetic construct
YLIHFCY

SEQ ID NO: 22636 - protein, 7 aa, Artificial Sequence
  Synthetic construct
YLIHFLF

SEQ ID NO: 22637 - protein, 7 aa, Artificial Sequence
  Synthetic construct
YLIHFLY

SEQ ID NO: 22638 - protein, 7 aa, Artificial Sequence
  Synthetic construct
YLIHFAF

SEQ ID NO: 22639 - protein, 7 aa, Artificial Sequence
  Synthetic construct
YLIHFAY

SEQ ID NO: 22640 - protein, 7 aa, Artificial Sequence
  Synthetic construct
YLIHFQF

SEQ ID NO: 22641 - protein, 7 aa, Artificial Sequence
  Synthetic construct
YLIHFQY

SEQ ID NO: 22642 - protein, 7 aa, Artificial Sequence
  Synthetic construct
YLIHFDF

SEQ ID NO: 22643 - protein, 7 aa, Artificial Sequence
  Synthetic construct
YLIHFDY

SEQ ID NO: 22644 - protein, 7 aa, Artificial Sequence
  Synthetic construct
YLIHFVF

SEQ ID NO: 22645 - protein, 7 aa, Artificial Sequence
  Synthetic construct
YLIHFVY

SEQ ID NO: 22646 - protein, 7 aa, Artificial Sequence
  Synthetic construct
YLIHVFF

SEQ ID NO: 22647 - protein, 7 aa, Artificial Sequence
  Synthetic construct
YLIHVFY

SEQ ID NO: 22648 - protein, 7 aa, Artificial Sequence
  Synthetic construct
YLIHVRF

SEQ ID NO: 22649 - protein, 7 aa, Artificial Sequence
  Synthetic construct
YLIHVRY

SEQ ID NO: 22650 - protein, 7 aa, Artificial Sequence
  Synthetic construct
YLIHVCF

SEQ ID NO: 22651 - protein, 7 aa, Artificial Sequence
  Synthetic construct
YLIHVCY

SEQ ID NO: 22652 - protein, 7 aa, Artificial Sequence
  Synthetic construct
YLIHVLF

SEQ ID NO: 22653 - protein, 7 aa, Artificial Sequence
  Synthetic construct
YLIHVLY

SEQ ID NO: 22654 - protein, 7 aa, Artificial Sequence
  Synthetic construct
YLIHVAF

SEQ ID NO: 22655 - protein, 7 aa, Artificial Sequence
  Synthetic construct
YLIHVAY

SEQ ID NO: 22656 - protein, 7 aa, Artificial Sequence
  Synthetic construct
YLIHVQF

SEQ ID NO: 22657 - protein, 7 aa, Artificial Sequence
  Synthetic construct
YLIHVQY

SEQ ID NO: 22658 - protein, 7 aa, Artificial Sequence
  Synthetic construct
YLIHVDF

SEQ ID NO: 22659 - protein, 7 aa, Artificial Sequence
  Synthetic construct
YLIHVDY

SEQ ID NO: 22660 - protein, 7 aa, Artificial Sequence
  Synthetic construct
YLIHVVF

SEQ ID NO: 22661 - protein, 7 aa, Artificial Sequence
  Synthetic construct
YLIHVVY

SEQ ID NO: 22662 - protein, 7 aa, Artificial Sequence
  Synthetic construct
YLIHTFF

SEQ ID NO: 22663 - protein, 7 aa, Artificial Sequence
  Synthetic construct
YLIHTFY

SEQ ID NO: 22664 - protein, 7 aa, Artificial Sequence
  Synthetic construct
YLIHTRF

SEQ ID NO: 22665 - protein, 7 aa, Artificial Sequence
  Synthetic construct
YLIHTRY

SEQ ID NO: 22666 - protein, 7 aa, Artificial Sequence
  Synthetic construct
YLIHTCF

SEQ ID NO: 22667 - protein, 7 aa, Artificial Sequence
  Synthetic construct
YLIHTCY

SEQ ID NO: 22668 - protein, 7 aa, Artificial Sequence
  Synthetic construct
YLIHTLF

SEQ ID NO: 22669 - protein, 7 aa, Artificial Sequence
  Synthetic construct
YLIHTLY

SEQ ID NO: 22670 - protein, 7 aa, Artificial Sequence
  Synthetic construct
YLIHTAF

SEQ ID NO: 22671 - protein, 7 aa, Artificial Sequence
  Synthetic construct
YLIHTAY

SEQ ID NO: 22672 - protein, 7 aa, Artificial Sequence
  Synthetic construct
YLIHTQF

SEQ ID NO: 22673 - protein, 7 aa, Artificial Sequence
  Synthetic construct
YLIHTQY

SEQ ID NO: 22674 - protein, 7 aa, Artificial Sequence
  Synthetic construct
YLIHTDF

SEQ ID NO: 22675 - protein, 7 aa, Artificial Sequence
  Synthetic construct
YLIHTDY

SEQ ID NO: 22676 - protein, 7 aa, Artificial Sequence
  Synthetic construct
YLIHTVF

SEQ ID NO: 22677 - protein, 7 aa, Artificial Sequence
  Synthetic construct
YLIHTVY

SEQ ID NO: 22678 - protein, 7 aa, Artificial Sequence
  Synthetic construct
YLIHGFF

SEQ ID NO: 22679 - protein, 7 aa, Artificial Sequence
  Synthetic construct
YLIHGFY

SEQ ID NO: 22680 - protein, 7 aa, Artificial Sequence
  Synthetic construct
YLIHGRF

SEQ ID NO: 22681 - protein, 7 aa, Artificial Sequence
  Synthetic construct
YLIHGRY

SEQ ID NO: 22682 - protein, 7 aa, Artificial Sequence
  Synthetic construct
YLIHGCF

SEQ ID NO: 22683 - protein, 7 aa, Artificial Sequence
  Synthetic construct
YLIHGCY

SEQ ID NO: 22684 - protein, 7 aa, Artificial Sequence
  Synthetic construct
YLIHGLF

SEQ ID NO: 22685 - protein, 7 aa, Artificial Sequence
  Synthetic construct
YLIHGLY

SEQ ID NO: 22686 - protein, 7 aa, Artificial Sequence
  Synthetic construct
YLIHGAF

SEQ ID NO: 22687 - protein, 7 aa, Artificial Sequence
  Synthetic construct
YLIHGAY

SEQ ID NO: 22688 - protein, 7 aa, Artificial Sequence
  Synthetic construct
YLIHGQF

SEQ ID NO: 22689 - protein, 7 aa, Artificial Sequence
  Synthetic construct
YLIHGQY

SEQ ID NO: 22690 - protein, 7 aa, Artificial Sequence
  Synthetic construct
YLIHGDF

SEQ ID NO: 22691 - protein, 7 aa, Artificial Sequence
  Synthetic construct
YLIHGDY

SEQ ID NO: 22692 - protein, 7 aa, Artificial Sequence
  Synthetic construct
YLIHGVF

SEQ ID NO: 22693 - protein, 7 aa, Artificial Sequence
  Synthetic construct
YLIHGVY

SEQ ID NO: 22694 - protein, 7 aa, Artificial Sequence
  Synthetic construct
YLIHAFF

SEQ ID NO: 22695 - protein, 7 aa, Artificial Sequence
  Synthetic construct
YLIHAFY

SEQ ID NO: 22696 - protein, 7 aa, Artificial Sequence
  Synthetic construct
YLIHARF

SEQ ID NO: 22697 - protein, 7 aa, Artificial Sequence
  Synthetic construct
YLIHARY

SEQ ID NO: 22698 - protein, 7 aa, Artificial Sequence
  Synthetic construct
YLIHACF

SEQ ID NO: 22699 - protein, 7 aa, Artificial Sequence
  Synthetic construct
YLIHACY

SEQ ID NO: 22700 - protein, 7 aa, Artificial Sequence
  Synthetic construct
YLIHALF

SEQ ID NO: 22701 - protein, 7 aa, Artificial Sequence
  Synthetic construct
YLIHALY

SEQ ID NO: 22702 - protein, 7 aa, Artificial Sequence
  Synthetic construct
YLIHAAF

SEQ ID NO: 22703 - protein, 7 aa, Artificial Sequence
  Synthetic construct
YLIHAAY

SEQ ID NO: 22704 - protein, 7 aa, Artificial Sequence
  Synthetic construct
YLIHAQF

SEQ ID NO: 22705 - protein, 7 aa, Artificial Sequence
  Synthetic construct
YLIHAQY

SEQ ID NO: 22706 - protein, 7 aa, Artificial Sequence
  Synthetic construct
YLIHADF

SEQ ID NO: 22707 - protein, 7 aa, Artificial Sequence
  Synthetic construct
YLIHADY

SEQ ID NO: 22708 - protein, 7 aa, Artificial Sequence
  Synthetic construct
YLIHAVF

SEQ ID NO: 22709 - protein, 7 aa, Artificial Sequence
  Synthetic construct
YLIHAVY

SEQ ID NO: 22710 - protein, 7 aa, Artificial Sequence
  Synthetic construct
YLIHQFF

SEQ ID NO: 22711 - protein, 7 aa, Artificial Sequence
  Synthetic construct
YLIHQFY

SEQ ID NO: 22712 - protein, 7 aa, Artificial Sequence
  Synthetic construct
YLIHQRF

SEQ ID NO: 22713 - protein, 7 aa, Artificial Sequence
  Synthetic construct
YLIHQRY

SEQ ID NO: 22714 - protein, 7 aa, Artificial Sequence
  Synthetic construct
YLIHQCF

SEQ ID NO: 22715 - protein, 7 aa, Artificial Sequence
  Synthetic construct
YLIHQCY

SEQ ID NO: 22716 - protein, 7 aa, Artificial Sequence
  Synthetic construct
YLIHQLF

SEQ ID NO: 22717 - protein, 7 aa, Artificial Sequence
  Synthetic construct
YLIHQLY

SEQ ID NO: 22718 - protein, 7 aa, Artificial Sequence
  Synthetic construct
YLIHQAF

SEQ ID NO: 22719 - protein, 7 aa, Artificial Sequence
  Synthetic construct
YLIHQAY

SEQ ID NO: 22720 - protein, 7 aa, Artificial Sequence
  Synthetic construct
YLIHQQF

SEQ ID NO: 22721 - protein, 7 aa, Artificial Sequence
  Synthetic construct
YLIHQQY

SEQ ID NO: 22722 - protein, 7 aa, Artificial Sequence
  Synthetic construct
YLIHQDF

SEQ ID NO: 22723 - protein, 7 aa, Artificial Sequence
  Synthetic construct
YLIHQDY

SEQ ID NO: 22724 - protein, 7 aa, Artificial Sequence
  Synthetic construct
YLIHQVF

SEQ ID NO: 22725 - protein, 7 aa, Artificial Sequence
  Synthetic construct
YLIHQVY

SEQ ID NO: 22726 - protein, 7 aa, Artificial Sequence
  Synthetic construct
YLILIFF

SEQ ID NO: 22727 - protein, 7 aa, Artificial Sequence
  Synthetic construct
YLILIFY

SEQ ID NO: 22728 - protein, 7 aa, Artificial Sequence
  Synthetic construct
YLILIRF

SEQ ID NO: 22729 - protein, 7 aa, Artificial Sequence
  Synthetic construct
YLILIRY

SEQ ID NO: 22730 - protein, 7 aa, Artificial Sequence
  Synthetic construct
YLILICF

SEQ ID NO: 22731 - protein, 7 aa, Artificial Sequence
  Synthetic construct
YLILICY

SEQ ID NO: 22732 - protein, 7 aa, Artificial Sequence
  Synthetic construct
YLILILF

SEQ ID NO: 22733 - protein, 7 aa, Artificial Sequence
  Synthetic construct
YLILILY

SEQ ID NO: 22734 - protein, 7 aa, Artificial Sequence
  Synthetic construct
YLILIAF

SEQ ID NO: 22735 - protein, 7 aa, Artificial Sequence
  Synthetic construct
YLILIAY

SEQ ID NO: 22736 - protein, 7 aa, Artificial Sequence
  Synthetic construct
YLILIQF

SEQ ID NO: 22737 - protein, 7 aa, Artificial Sequence
  Synthetic construct
YLILIQY

SEQ ID NO: 22738 - protein, 7 aa, Artificial Sequence
  Synthetic construct
YLILIDF

SEQ ID NO: 22739 - protein, 7 aa, Artificial Sequence
  Synthetic construct
YLILIDY

SEQ ID NO: 22740 - protein, 7 aa, Artificial Sequence
  Synthetic construct
YLILIVF

SEQ ID NO: 22741 - protein, 7 aa, Artificial Sequence
  Synthetic construct
YLILIVY

SEQ ID NO: 22742 - protein, 7 aa, Artificial Sequence
  Synthetic construct
YLILDFF

SEQ ID NO: 22743 - protein, 7 aa, Artificial Sequence
  Synthetic construct
YLILDFY

SEQ ID NO: 22744 - protein, 7 aa, Artificial Sequence
  Synthetic construct
YLILDRF

SEQ ID NO: 22745 - protein, 7 aa, Artificial Sequence
  Synthetic construct
YLILDRY

SEQ ID NO: 22746 - protein, 7 aa, Artificial Sequence
  Synthetic construct
YLILDCF

SEQ ID NO: 22747 - protein, 7 aa, Artificial Sequence
  Synthetic construct
YLILDCY

SEQ ID NO: 22748 - protein, 7 aa, Artificial Sequence
  Synthetic construct
YLILDLF

SEQ ID NO: 22749 - protein, 7 aa, Artificial Sequence
  Synthetic construct
YLILDLY

SEQ ID NO: 22750 - protein, 7 aa, Artificial Sequence
  Synthetic construct
YLILDAF

SEQ ID NO: 22751 - protein, 7 aa, Artificial Sequence
  Synthetic construct
YLILDAY

SEQ ID NO: 22752 - protein, 7 aa, Artificial Sequence
  Synthetic construct
YLILDQF

SEQ ID NO: 22753 - protein, 7 aa, Artificial Sequence
  Synthetic construct
YLILDQY

SEQ ID NO: 22754 - protein, 7 aa, Artificial Sequence
  Synthetic construct
YLILDDF

SEQ ID NO: 22755 - protein, 7 aa, Artificial Sequence
  Synthetic construct
YLILDDY

SEQ ID NO: 22756 - protein, 7 aa, Artificial Sequence
  Synthetic construct
YLILDVF

SEQ ID NO: 22757 - protein, 7 aa, Artificial Sequence
  Synthetic construct
YLILDVY

SEQ ID NO: 22758 - protein, 7 aa, Artificial Sequence
  Synthetic construct
YLILYFF

SEQ ID NO: 22759 - protein, 7 aa, Artificial Sequence
  Synthetic construct
YLILYFY

SEQ ID NO: 22760 - protein, 7 aa, Artificial Sequence
  Synthetic construct
YLILYRF

SEQ ID NO: 22761 - protein, 7 aa, Artificial Sequence
  Synthetic construct
YLILYRY

SEQ ID NO: 22762 - protein, 7 aa, Artificial Sequence
  Synthetic construct
YLILYCF

SEQ ID NO: 22763 - protein, 7 aa, Artificial Sequence
  Synthetic construct
YLILYCY

SEQ ID NO: 22764 - protein, 7 aa, Artificial Sequence
  Synthetic construct
YLILYLF

SEQ ID NO: 22765 - protein, 7 aa, Artificial Sequence
  Synthetic construct
YLILYLY

SEQ ID NO: 22766 - protein, 7 aa, Artificial Sequence
  Synthetic construct
YLILYAF

SEQ ID NO: 22767 - protein, 7 aa, Artificial Sequence
  Synthetic construct
YLILYAY

SEQ ID NO: 22768 - protein, 7 aa, Artificial Sequence
  Synthetic construct
YLILYQF

SEQ ID NO: 22769 - protein, 7 aa, Artificial Sequence
  Synthetic construct
YLILYQY

SEQ ID NO: 22770 - protein, 7 aa, Artificial Sequence
  Synthetic construct
YLILYDF

SEQ ID NO: 22771 - protein, 7 aa, Artificial Sequence
  Synthetic construct
YLILYDY

SEQ ID NO: 22772 - protein, 7 aa, Artificial Sequence
  Synthetic construct
YLILYVF

SEQ ID NO: 22773 - protein, 7 aa, Artificial Sequence
  Synthetic construct
YLILYVY

SEQ ID NO: 22774 - protein, 7 aa, Artificial Sequence
  Synthetic construct
YLILFFF

SEQ ID NO: 22775 - protein, 7 aa, Artificial Sequence
  Synthetic construct
YLILFFY

SEQ ID NO: 22776 - protein, 7 aa, Artificial Sequence
  Synthetic construct
YLILFRF

SEQ ID NO: 22777 - protein, 7 aa, Artificial Sequence
  Synthetic construct
YLILFRY

SEQ ID NO: 22778 - protein, 7 aa, Artificial Sequence
  Synthetic construct
YLILFCF

SEQ ID NO: 22779 - protein, 7 aa, Artificial Sequence
  Synthetic construct
YLILFCY

SEQ ID NO: 22780 - protein, 7 aa, Artificial Sequence
  Synthetic construct
YLILFLF

SEQ ID NO: 22781 - protein, 7 aa, Artificial Sequence
  Synthetic construct
YLILFLY

SEQ ID NO: 22782 - protein, 7 aa, Artificial Sequence
  Synthetic construct
YLILFAF

SEQ ID NO: 22783 - protein, 7 aa, Artificial Sequence
  Synthetic construct
YLILFAY

SEQ ID NO: 22784 - protein, 7 aa, Artificial Sequence
  Synthetic construct
YLILFQF

SEQ ID NO: 22785 - protein, 7 aa, Artificial Sequence
  Synthetic construct
YLILFQY

SEQ ID NO: 22786 - protein, 7 aa, Artificial Sequence
  Synthetic construct
YLILFDF

SEQ ID NO: 22787 - protein, 7 aa, Artificial Sequence
  Synthetic construct
YLILFDY

SEQ ID NO: 22788 - protein, 7 aa, Artificial Sequence
  Synthetic construct
YLILFVF

SEQ ID NO: 22789 - protein, 7 aa, Artificial Sequence
  Synthetic construct
YLILFVY

SEQ ID NO: 22790 - protein, 7 aa, Artificial Sequence
  Synthetic construct
YLILVFF

SEQ ID NO: 22791 - protein, 7 aa, Artificial Sequence
  Synthetic construct
YLILVFY

SEQ ID NO: 22792 - protein, 7 aa, Artificial Sequence
  Synthetic construct
YLILVRF

SEQ ID NO: 22793 - protein, 7 aa, Artificial Sequence
  Synthetic construct
YLILVRY

SEQ ID NO: 22794 - protein, 7 aa, Artificial Sequence
  Synthetic construct
YLILVCF

SEQ ID NO: 22795 - protein, 7 aa, Artificial Sequence
  Synthetic construct
YLILVCY

SEQ ID NO: 22796 - protein, 7 aa, Artificial Sequence
  Synthetic construct
YLILVLF

SEQ ID NO: 22797 - protein, 7 aa, Artificial Sequence
  Synthetic construct
YLILVLY

SEQ ID NO: 22798 - protein, 7 aa, Artificial Sequence
  Synthetic construct
YLILVAF

SEQ ID NO: 22799 - protein, 7 aa, Artificial Sequence
  Synthetic construct
YLILVAY

SEQ ID NO: 22800 - protein, 7 aa, Artificial Sequence
  Synthetic construct
YLILVQF

SEQ ID NO: 22801 - protein, 7 aa, Artificial Sequence
  Synthetic construct
YLILVQY

SEQ ID NO: 22802 - protein, 7 aa, Artificial Sequence
  Synthetic construct
YLILVDF

SEQ ID NO: 22803 - protein, 7 aa, Artificial Sequence
  Synthetic construct
YLILVDY

SEQ ID NO: 22804 - protein, 7 aa, Artificial Sequence
  Synthetic construct
YLILVVF

SEQ ID NO: 22805 - protein, 7 aa, Artificial Sequence
  Synthetic construct
YLILVVY

SEQ ID NO: 22806 - protein, 7 aa, Artificial Sequence
  Synthetic construct
YLILTFF

SEQ ID NO: 22807 - protein, 7 aa, Artificial Sequence
  Synthetic construct
YLILTFY

SEQ ID NO: 22808 - protein, 7 aa, Artificial Sequence
  Synthetic construct
YLILTRF

SEQ ID NO: 22809 - protein, 7 aa, Artificial Sequence
  Synthetic construct
YLILTRY

SEQ ID NO: 22810 - protein, 7 aa, Artificial Sequence
  Synthetic construct
YLILTCF

SEQ ID NO: 22811 - protein, 7 aa, Artificial Sequence
  Synthetic construct
YLILTCY

SEQ ID NO: 22812 - protein, 7 aa, Artificial Sequence
  Synthetic construct
YLILTLF

SEQ ID NO: 22813 - protein, 7 aa, Artificial Sequence
  Synthetic construct
YLILTLY

SEQ ID NO: 22814 - protein, 7 aa, Artificial Sequence
  Synthetic construct
YLILTAF

SEQ ID NO: 22815 - protein, 7 aa, Artificial Sequence
  Synthetic construct
YLILTAY

SEQ ID NO: 22816 - protein, 7 aa, Artificial Sequence
  Synthetic construct
YLILTQF

SEQ ID NO: 22817 - protein, 7 aa, Artificial Sequence
  Synthetic construct
YLILTQY

SEQ ID NO: 22818 - protein, 7 aa, Artificial Sequence
  Synthetic construct
YLILTDF

SEQ ID NO: 22819 - protein, 7 aa, Artificial Sequence
  Synthetic construct
YLILTDY

SEQ ID NO: 22820 - protein, 7 aa, Artificial Sequence
  Synthetic construct
YLILTVF

SEQ ID NO: 22821 - protein, 7 aa, Artificial Sequence
  Synthetic construct
YLILTVY

SEQ ID NO: 22822 - protein, 7 aa, Artificial Sequence
  Synthetic construct
YLILGFF

SEQ ID NO: 22823 - protein, 7 aa, Artificial Sequence
  Synthetic construct
YLILGFY

SEQ ID NO: 22824 - protein, 7 aa, Artificial Sequence
  Synthetic construct
YLILGRF

SEQ ID NO: 22825 - protein, 7 aa, Artificial Sequence
  Synthetic construct
YLILGRY

SEQ ID NO: 22826 - protein, 7 aa, Artificial Sequence
  Synthetic construct
YLILGCF

SEQ ID NO: 22827 - protein, 7 aa, Artificial Sequence
  Synthetic construct
YLILGCY

SEQ ID NO: 22828 - protein, 7 aa, Artificial Sequence
  Synthetic construct
YLILGLF

SEQ ID NO: 22829 - protein, 7 aa, Artificial Sequence
  Synthetic construct
YLILGLY

SEQ ID NO: 22830 - protein, 7 aa, Artificial Sequence
  Synthetic construct
YLILGAF

SEQ ID NO: 22831 - protein, 7 aa, Artificial Sequence
  Synthetic construct
YLILGAY

SEQ ID NO: 22832 - protein, 7 aa, Artificial Sequence
  Synthetic construct
YLILGQF

SEQ ID NO: 22833 - protein, 7 aa, Artificial Sequence
  Synthetic construct
YLILGQY

SEQ ID NO: 22834 - protein, 7 aa, Artificial Sequence
  Synthetic construct
YLILGDF

SEQ ID NO: 22835 - protein, 7 aa, Artificial Sequence
  Synthetic construct
YLILGDY

SEQ ID NO: 22836 - protein, 7 aa, Artificial Sequence
  Synthetic construct
YLILGVF

SEQ ID NO: 22837 - protein, 7 aa, Artificial Sequence
  Synthetic construct
YLILGVY

SEQ ID NO: 22838 - protein, 7 aa, Artificial Sequence
  Synthetic construct
YLILAFF

SEQ ID NO: 22839 - protein, 7 aa, Artificial Sequence
  Synthetic construct
YLILAFY

SEQ ID NO: 22840 - protein, 7 aa, Artificial Sequence
  Synthetic construct
YLILARF

SEQ ID NO: 22841 - protein, 7 aa, Artificial Sequence
  Synthetic construct
YLILARY

SEQ ID NO: 22842 - protein, 7 aa, Artificial Sequence
  Synthetic construct
YLILACF

SEQ ID NO: 22843 - protein, 7 aa, Artificial Sequence
  Synthetic construct
YLILACY

SEQ ID NO: 22844 - protein, 7 aa, Artificial Sequence
  Synthetic construct
YLILALF

SEQ ID NO: 22845 - protein, 7 aa, Artificial Sequence
  Synthetic construct
YLILALY

SEQ ID NO: 22846 - protein, 7 aa, Artificial Sequence
  Synthetic construct
YLILAAF

SEQ ID NO: 22847 - protein, 7 aa, Artificial Sequence
  Synthetic construct
YLILAAY

SEQ ID NO: 22848 - protein, 7 aa, Artificial Sequence
  Synthetic construct
YLILAQF

SEQ ID NO: 22849 - protein, 7 aa, Artificial Sequence
  Synthetic construct
YLILAQY

SEQ ID NO: 22850 - protein, 7 aa, Artificial Sequence
  Synthetic construct
YLILADF

SEQ ID NO: 22851 - protein, 7 aa, Artificial Sequence
  Synthetic construct
YLILADY

SEQ ID NO: 22852 - protein, 7 aa, Artificial Sequence
  Synthetic construct
YLILAVF

SEQ ID NO: 22853 - protein, 7 aa, Artificial Sequence
  Synthetic construct
YLILAVY

SEQ ID NO: 22854 - protein, 7 aa, Artificial Sequence
  Synthetic construct
YLILQFF

SEQ ID NO: 22855 - protein, 7 aa, Artificial Sequence
  Synthetic construct
YLILQFY

SEQ ID NO: 22856 - protein, 7 aa, Artificial Sequence
  Synthetic construct
YLILQRF

SEQ ID NO: 22857 - protein, 7 aa, Artificial Sequence
  Synthetic construct
YLILQRY

SEQ ID NO: 22858 - protein, 7 aa, Artificial Sequence
  Synthetic construct
YLILQCF

SEQ ID NO: 22859 - protein, 7 aa, Artificial Sequence
  Synthetic construct
YLILQCY

SEQ ID NO: 22860 - protein, 7 aa, Artificial Sequence
  Synthetic construct
YLILQLF

SEQ ID NO: 22861 - protein, 7 aa, Artificial Sequence
  Synthetic construct
YLILQLY

SEQ ID NO: 22862 - protein, 7 aa, Artificial Sequence
  Synthetic construct
YLILQAF

SEQ ID NO: 22863 - protein, 7 aa, Artificial Sequence
  Synthetic construct
YLILQAY

SEQ ID NO: 22864 - protein, 7 aa, Artificial Sequence
  Synthetic construct
YLILQQF

SEQ ID NO: 22865 - protein, 7 aa, Artificial Sequence
  Synthetic construct
YLILQQY

SEQ ID NO: 22866 - protein, 7 aa, Artificial Sequence
  Synthetic construct
YLILQDF

SEQ ID NO: 22867 - protein, 7 aa, Artificial Sequence
  Synthetic construct
YLILQDY

SEQ ID NO: 22868 - protein, 7 aa, Artificial Sequence
  Synthetic construct
YLILQVF

SEQ ID NO: 22869 - protein, 7 aa, Artificial Sequence
  Synthetic construct
YLILQVY

SEQ ID NO: 22870 - protein, 7 aa, Artificial Sequence
  Synthetic construct
YLIFIFF

SEQ ID NO: 22871 - protein, 7 aa, Artificial Sequence
  Synthetic construct
YLIFIFY

SEQ ID NO: 22872 - protein, 7 aa, Artificial Sequence
  Synthetic construct
YLIFIRF

SEQ ID NO: 22873 - protein, 7 aa, Artificial Sequence
  Synthetic construct
YLIFIRY

SEQ ID NO: 22874 - protein, 7 aa, Artificial Sequence
  Synthetic construct
YLIFICF

SEQ ID NO: 22875 - protein, 7 aa, Artificial Sequence
  Synthetic construct
YLIFICY

SEQ ID NO: 22876 - protein, 7 aa, Artificial Sequence
  Synthetic construct
YLIFILF

SEQ ID NO: 22877 - protein, 7 aa, Artificial Sequence
  Synthetic construct
YLIFILY

SEQ ID NO: 22878 - protein, 7 aa, Artificial Sequence
  Synthetic construct
YLIFIAF

SEQ ID NO: 22879 - protein, 7 aa, Artificial Sequence
  Synthetic construct
YLIFIAY

SEQ ID NO: 22880 - protein, 7 aa, Artificial Sequence
  Synthetic construct
YLIFIQF

SEQ ID NO: 22881 - protein, 7 aa, Artificial Sequence
  Synthetic construct
YLIFIQY

SEQ ID NO: 22882 - protein, 7 aa, Artificial Sequence
  Synthetic construct
YLIFIDF

SEQ ID NO: 22883 - protein, 7 aa, Artificial Sequence
  Synthetic construct
YLIFIDY

SEQ ID NO: 22884 - protein, 7 aa, Artificial Sequence
  Synthetic construct
YLIFIVF

SEQ ID NO: 22885 - protein, 7 aa, Artificial Sequence
  Synthetic construct
YLIFIVY

SEQ ID NO: 22886 - protein, 7 aa, Artificial Sequence
  Synthetic construct
YLIFDFF

SEQ ID NO: 22887 - protein, 7 aa, Artificial Sequence
  Synthetic construct
YLIFDFY

SEQ ID NO: 22888 - protein, 7 aa, Artificial Sequence
  Synthetic construct
YLIFDRF

SEQ ID NO: 22889 - protein, 7 aa, Artificial Sequence
  Synthetic construct
YLIFDRY

SEQ ID NO: 22890 - protein, 7 aa, Artificial Sequence
  Synthetic construct
YLIFDCF

SEQ ID NO: 22891 - protein, 7 aa, Artificial Sequence
  Synthetic construct
YLIFDCY

SEQ ID NO: 22892 - protein, 7 aa, Artificial Sequence
  Synthetic construct
YLIFDLF

SEQ ID NO: 22893 - protein, 7 aa, Artificial Sequence
  Synthetic construct
YLIFDLY

SEQ ID NO: 22894 - protein, 7 aa, Artificial Sequence
  Synthetic construct
YLIFDAF

SEQ ID NO: 22895 - protein, 7 aa, Artificial Sequence
  Synthetic construct
YLIFDAY

SEQ ID NO: 22896 - protein, 7 aa, Artificial Sequence
  Synthetic construct
YLIFDQF

SEQ ID NO: 22897 - protein, 7 aa, Artificial Sequence
  Synthetic construct
YLIFDQY

SEQ ID NO: 22898 - protein, 7 aa, Artificial Sequence
  Synthetic construct
YLIFDDF

SEQ ID NO: 22899 - protein, 7 aa, Artificial Sequence
  Synthetic construct
YLIFDDY

SEQ ID NO: 22900 - protein, 7 aa, Artificial Sequence
  Synthetic construct
YLIFDVF

SEQ ID NO: 22901 - protein, 7 aa, Artificial Sequence
  Synthetic construct
YLIFDVY

SEQ ID NO: 22902 - protein, 7 aa, Artificial Sequence
  Synthetic construct
YLIFYFF

SEQ ID NO: 22903 - protein, 7 aa, Artificial Sequence
  Synthetic construct
YLIFYFY

SEQ ID NO: 22904 - protein, 7 aa, Artificial Sequence
  Synthetic construct
YLIFYRF

SEQ ID NO: 22905 - protein, 7 aa, Artificial Sequence
  Synthetic construct
YLIFYRY

SEQ ID NO: 22906 - protein, 7 aa, Artificial Sequence
  Synthetic construct
YLIFYCF

SEQ ID NO: 22907 - protein, 7 aa, Artificial Sequence
  Synthetic construct
YLIFYCY

SEQ ID NO: 22908 - protein, 7 aa, Artificial Sequence
  Synthetic construct
YLIFYLF

SEQ ID NO: 22909 - protein, 7 aa, Artificial Sequence
  Synthetic construct
YLIFYLY

SEQ ID NO: 22910 - protein, 7 aa, Artificial Sequence
  Synthetic construct
YLIFYAF

SEQ ID NO: 22911 - protein, 7 aa, Artificial Sequence
  Synthetic construct
YLIFYAY

SEQ ID NO: 22912 - protein, 7 aa, Artificial Sequence
  Synthetic construct
YLIFYQF

SEQ ID NO: 22913 - protein, 7 aa, Artificial Sequence
  Synthetic construct
YLIFYQY

SEQ ID NO: 22914 - protein, 7 aa, Artificial Sequence
  Synthetic construct
YLIFYDF

SEQ ID NO: 22915 - protein, 7 aa, Artificial Sequence
  Synthetic construct
YLIFYDY

SEQ ID NO: 22916 - protein, 7 aa, Artificial Sequence
  Synthetic construct
YLIFYVF

SEQ ID NO: 22917 - protein, 7 aa, Artificial Sequence
  Synthetic construct
YLIFYVY

SEQ ID NO: 22918 - protein, 7 aa, Artificial Sequence
  Synthetic construct
YLIFFFF

SEQ ID NO: 22919 - protein, 7 aa, Artificial Sequence
  Synthetic construct
YLIFFFY

SEQ ID NO: 22920 - protein, 7 aa, Artificial Sequence
  Synthetic construct
YLIFFRF

SEQ ID NO: 22921 - protein, 7 aa, Artificial Sequence
  Synthetic construct
YLIFFRY

SEQ ID NO: 22922 - protein, 7 aa, Artificial Sequence
  Synthetic construct
YLIFFCF

SEQ ID NO: 22923 - protein, 7 aa, Artificial Sequence
  Synthetic construct
YLIFFCY

SEQ ID NO: 22924 - protein, 7 aa, Artificial Sequence
  Synthetic construct
YLIFFLF

SEQ ID NO: 22925 - protein, 7 aa, Artificial Sequence
  Synthetic construct
YLIFFLY

SEQ ID NO: 22926 - protein, 7 aa, Artificial Sequence
  Synthetic construct
YLIFFAF

SEQ ID NO: 22927 - protein, 7 aa, Artificial Sequence
  Synthetic construct
YLIFFAY

SEQ ID NO: 22928 - protein, 7 aa, Artificial Sequence
  Synthetic construct
YLIFFQF

SEQ ID NO: 22929 - protein, 7 aa, Artificial Sequence
  Synthetic construct
YLIFFQY

SEQ ID NO: 22930 - protein, 7 aa, Artificial Sequence
  Synthetic construct
YLIFFDF

SEQ ID NO: 22931 - protein, 7 aa, Artificial Sequence
  Synthetic construct
YLIFFDY

SEQ ID NO: 22932 - protein, 7 aa, Artificial Sequence
  Synthetic construct
YLIFFVF

SEQ ID NO: 22933 - protein, 7 aa, Artificial Sequence
  Synthetic construct
YLIFFVY

SEQ ID NO: 22934 - protein, 7 aa, Artificial Sequence
  Synthetic construct
YLIFVFF

SEQ ID NO: 22935 - protein, 7 aa, Artificial Sequence
  Synthetic construct
YLIFVFY

SEQ ID NO: 22936 - protein, 7 aa, Artificial Sequence
  Synthetic construct
YLIFVRF

SEQ ID NO: 22937 - protein, 7 aa, Artificial Sequence
  Synthetic construct
YLIFVRY

SEQ ID NO: 22938 - protein, 7 aa, Artificial Sequence
  Synthetic construct
YLIFVCF

SEQ ID NO: 22939 - protein, 7 aa, Artificial Sequence
  Synthetic construct
YLIFVCY

SEQ ID NO: 22940 - protein, 7 aa, Artificial Sequence
  Synthetic construct
YLIFVLF

SEQ ID NO: 22941 - protein, 7 aa, Artificial Sequence
  Synthetic construct
YLIFVLY

SEQ ID NO: 22942 - protein, 7 aa, Artificial Sequence
  Synthetic construct
YLIFVAF

SEQ ID NO: 22943 - protein, 7 aa, Artificial Sequence
  Synthetic construct
YLIFVAY

SEQ ID NO: 22944 - protein, 7 aa, Artificial Sequence
  Synthetic construct
YLIFVQF

SEQ ID NO: 22945 - protein, 7 aa, Artificial Sequence
  Synthetic construct
YLIFVQY

SEQ ID NO: 22946 - protein, 7 aa, Artificial Sequence
  Synthetic construct
YLIFVDF

SEQ ID NO: 22947 - protein, 7 aa, Artificial Sequence
  Synthetic construct
YLIFVDY

SEQ ID NO: 22948 - protein, 7 aa, Artificial Sequence
  Synthetic construct
YLIFVVF

SEQ ID NO: 22949 - protein, 7 aa, Artificial Sequence
  Synthetic construct
YLIFVVY

SEQ ID NO: 22950 - protein, 7 aa, Artificial Sequence
  Synthetic construct
YLIFTFF

SEQ ID NO: 22951 - protein, 7 aa, Artificial Sequence
  Synthetic construct
YLIFTFY

SEQ ID NO: 22952 - protein, 7 aa, Artificial Sequence
  Synthetic construct
YLIFTRF

SEQ ID NO: 22953 - protein, 7 aa, Artificial Sequence
  Synthetic construct
YLIFTRY

SEQ ID NO: 22954 - protein, 7 aa, Artificial Sequence
  Synthetic construct
YLIFTCF

SEQ ID NO: 22955 - protein, 7 aa, Artificial Sequence
  Synthetic construct
YLIFTCY

SEQ ID NO: 22956 - protein, 7 aa, Artificial Sequence
  Synthetic construct
YLIFTLF

SEQ ID NO: 22957 - protein, 7 aa, Artificial Sequence
  Synthetic construct
YLIFTLY

SEQ ID NO: 22958 - protein, 7 aa, Artificial Sequence
  Synthetic construct
YLIFTAF

SEQ ID NO: 22959 - protein, 7 aa, Artificial Sequence
  Synthetic construct
YLIFTAY

SEQ ID NO: 22960 - protein, 7 aa, Artificial Sequence
  Synthetic construct
YLIFTQF

SEQ ID NO: 22961 - protein, 7 aa, Artificial Sequence
  Synthetic construct
YLIFTQY

SEQ ID NO: 22962 - protein, 7 aa, Artificial Sequence
  Synthetic construct
YLIFTDF

SEQ ID NO: 22963 - protein, 7 aa, Artificial Sequence
  Synthetic construct
YLIFTDY

SEQ ID NO: 22964 - protein, 7 aa, Artificial Sequence
  Synthetic construct
YLIFTVF

SEQ ID NO: 22965 - protein, 7 aa, Artificial Sequence
  Synthetic construct
YLIFTVY

SEQ ID NO: 22966 - protein, 7 aa, Artificial Sequence
  Synthetic construct
YLIFGFF

SEQ ID NO: 22967 - protein, 7 aa, Artificial Sequence
  Synthetic construct
YLIFGFY

SEQ ID NO: 22968 - protein, 7 aa, Artificial Sequence
  Synthetic construct
YLIFGRF

SEQ ID NO: 22969 - protein, 7 aa, Artificial Sequence
  Synthetic construct
YLIFGRY

SEQ ID NO: 22970 - protein, 7 aa, Artificial Sequence
  Synthetic construct
YLIFGCF

SEQ ID NO: 22971 - protein, 7 aa, Artificial Sequence
  Synthetic construct
YLIFGCY

SEQ ID NO: 22972 - protein, 7 aa, Artificial Sequence
  Synthetic construct
YLIFGLF

SEQ ID NO: 22973 - protein, 7 aa, Artificial Sequence
  Synthetic construct
YLIFGLY

SEQ ID NO: 22974 - protein, 7 aa, Artificial Sequence
  Synthetic construct
YLIFGAF

SEQ ID NO: 22975 - protein, 7 aa, Artificial Sequence
  Synthetic construct
YLIFGAY

SEQ ID NO: 22976 - protein, 7 aa, Artificial Sequence
  Synthetic construct
YLIFGQF

SEQ ID NO: 22977 - protein, 7 aa, Artificial Sequence
  Synthetic construct
YLIFGQY

SEQ ID NO: 22978 - protein, 7 aa, Artificial Sequence
  Synthetic construct
YLIFGDF

SEQ ID NO: 22979 - protein, 7 aa, Artificial Sequence
  Synthetic construct
YLIFGDY

SEQ ID NO: 22980 - protein, 7 aa, Artificial Sequence
  Synthetic construct
YLIFGVF

SEQ ID NO: 22981 - protein, 7 aa, Artificial Sequence
  Synthetic construct
YLIFGVY

SEQ ID NO: 22982 - protein, 7 aa, Artificial Sequence
  Synthetic construct
YLIFAFF

SEQ ID NO: 22983 - protein, 7 aa, Artificial Sequence
  Synthetic construct
YLIFAFY

SEQ ID NO: 22984 - protein, 7 aa, Artificial Sequence
  Synthetic construct
YLIFARF

SEQ ID NO: 22985 - protein, 7 aa, Artificial Sequence
  Synthetic construct
YLIFARY

SEQ ID NO: 22986 - protein, 7 aa, Artificial Sequence
  Synthetic construct
YLIFACF

SEQ ID NO: 22987 - protein, 7 aa, Artificial Sequence
  Synthetic construct
YLIFACY

SEQ ID NO: 22988 - protein, 7 aa, Artificial Sequence
  Synthetic construct
YLIFALF

SEQ ID NO: 22989 - protein, 7 aa, Artificial Sequence
  Synthetic construct
YLIFALY

SEQ ID NO: 22990 - protein, 7 aa, Artificial Sequence
  Synthetic construct
YLIFAAF

SEQ ID NO: 22991 - protein, 7 aa, Artificial Sequence
  Synthetic construct
YLIFAAY

SEQ ID NO: 22992 - protein, 7 aa, Artificial Sequence
  Synthetic construct
YLIFAQF

SEQ ID NO: 22993 - protein, 7 aa, Artificial Sequence
  Synthetic construct
YLIFAQY

SEQ ID NO: 22994 - protein, 7 aa, Artificial Sequence
  Synthetic construct
YLIFADF

SEQ ID NO: 22995 - protein, 7 aa, Artificial Sequence
  Synthetic construct
YLIFADY

SEQ ID NO: 22996 - protein, 7 aa, Artificial Sequence
  Synthetic construct
YLIFAVF

SEQ ID NO: 22997 - protein, 7 aa, Artificial Sequence
  Synthetic construct
YLIFAVY

SEQ ID NO: 22998 - protein, 7 aa, Artificial Sequence
  Synthetic construct
YLIFQFF

SEQ ID NO: 22999 - protein, 7 aa, Artificial Sequence
  Synthetic construct
YLIFQFY

SEQ ID NO: 23000 - protein, 7 aa, Artificial Sequence
  Synthetic construct
YLIFQRF

SEQ ID NO: 23001 - protein, 7 aa, Artificial Sequence
  Synthetic construct
YLIFQRY

SEQ ID NO: 23002 - protein, 7 aa, Artificial Sequence
  Synthetic construct
YLIFQCF

SEQ ID NO: 23003 - protein, 7 aa, Artificial Sequence
  Synthetic construct
YLIFQCY

SEQ ID NO: 23004 - protein, 7 aa, Artificial Sequence
  Synthetic construct
YLIFQLF

SEQ ID NO: 23005 - protein, 7 aa, Artificial Sequence
  Synthetic construct
YLIFQLY

SEQ ID NO: 23006 - protein, 7 aa, Artificial Sequence
  Synthetic construct
YLIFQAF

SEQ ID NO: 23007 - protein, 7 aa, Artificial Sequence
  Synthetic construct
YLIFQAY

SEQ ID NO: 23008 - protein, 7 aa, Artificial Sequence
  Synthetic construct
YLIFQQF

SEQ ID NO: 23009 - protein, 7 aa, Artificial Sequence
  Synthetic construct
YLIFQQY

SEQ ID NO: 23010 - protein, 7 aa, Artificial Sequence
  Synthetic construct
YLIFQDF

SEQ ID NO: 23011 - protein, 7 aa, Artificial Sequence
  Synthetic construct
YLIFQDY

SEQ ID NO: 23012 - protein, 7 aa, Artificial Sequence
  Synthetic construct
YLIFQVF

SEQ ID NO: 23013 - protein, 7 aa, Artificial Sequence
  Synthetic construct
YLIFQVY

SEQ ID NO: 23014 - protein, 7 aa, Artificial Sequence
  Synthetic construct
YLGYIFF

SEQ ID NO: 23015 - protein, 7 aa, Artificial Sequence
  Synthetic construct
YLGYIFY

SEQ ID NO: 23016 - protein, 7 aa, Artificial Sequence
  Synthetic construct
YLGYIRF

SEQ ID NO: 23017 - protein, 7 aa, Artificial Sequence
  Synthetic construct
YLGYIRY

SEQ ID NO: 23018 - protein, 7 aa, Artificial Sequence
  Synthetic construct
YLGYICF

SEQ ID NO: 23019 - protein, 7 aa, Artificial Sequence
  Synthetic construct
YLGYICY

SEQ ID NO: 23020 - protein, 7 aa, Artificial Sequence
  Synthetic construct
YLGYILF

SEQ ID NO: 23021 - protein, 7 aa, Artificial Sequence
  Synthetic construct
YLGYILY

SEQ ID NO: 23022 - protein, 7 aa, Artificial Sequence
  Synthetic construct
YLGYIAF

SEQ ID NO: 23023 - protein, 7 aa, Artificial Sequence
  Synthetic construct
YLGYIAY

SEQ ID NO: 23024 - protein, 7 aa, Artificial Sequence
  Synthetic construct
YLGYIQF

SEQ ID NO: 23025 - protein, 7 aa, Artificial Sequence
  Synthetic construct
YLGYIQY

SEQ ID NO: 23026 - protein, 7 aa, Artificial Sequence
  Synthetic construct
YLGYIDF

SEQ ID NO: 23027 - protein, 7 aa, Artificial Sequence
  Synthetic construct
YLGYIDY

SEQ ID NO: 23028 - protein, 7 aa, Artificial Sequence
  Synthetic construct
YLGYIVF

SEQ ID NO: 23029 - protein, 7 aa, Artificial Sequence
  Synthetic construct
YLGYIVY

SEQ ID NO: 23030 - protein, 7 aa, Artificial Sequence
  Synthetic construct
YLGYDFF

SEQ ID NO: 23031 - protein, 7 aa, Artificial Sequence
  Synthetic construct
YLGYDFY

SEQ ID NO: 23032 - protein, 7 aa, Artificial Sequence
  Synthetic construct
YLGYDRF

SEQ ID NO: 23033 - protein, 7 aa, Artificial Sequence
  Synthetic construct
YLGYDRY

SEQ ID NO: 23034 - protein, 7 aa, Artificial Sequence
  Synthetic construct
YLGYDCF

SEQ ID NO: 23035 - protein, 7 aa, Artificial Sequence
  Synthetic construct
YLGYDCY

SEQ ID NO: 23036 - protein, 7 aa, Artificial Sequence
  Synthetic construct
YLGYDLF

SEQ ID NO: 23037 - protein, 7 aa, Artificial Sequence
  Synthetic construct
YLGYDLY

SEQ ID NO: 23038 - protein, 7 aa, Artificial Sequence
  Synthetic construct
YLGYDAF

SEQ ID NO: 23039 - protein, 7 aa, Artificial Sequence
  Synthetic construct
YLGYDAY

SEQ ID NO: 23040 - protein, 7 aa, Artificial Sequence
  Synthetic construct
YLGYDQF

SEQ ID NO: 23041 - protein, 7 aa, Artificial Sequence
  Synthetic construct
YLGYDQY

SEQ ID NO: 23042 - protein, 7 aa, Artificial Sequence
  Synthetic construct
YLGYDDF

SEQ ID NO: 23043 - protein, 7 aa, Artificial Sequence
  Synthetic construct
YLGYDDY

SEQ ID NO: 23044 - protein, 7 aa, Artificial Sequence
  Synthetic construct
YLGYDVF

SEQ ID NO: 23045 - protein, 7 aa, Artificial Sequence
  Synthetic construct
YLGYDVY

SEQ ID NO: 23046 - protein, 7 aa, Artificial Sequence
  Synthetic construct
YLGYYFF

SEQ ID NO: 23047 - protein, 7 aa, Artificial Sequence
  Synthetic construct
YLGYYFY

SEQ ID NO: 23048 - protein, 7 aa, Artificial Sequence
  Synthetic construct
YLGYYRF

SEQ ID NO: 23049 - protein, 7 aa, Artificial Sequence
  Synthetic construct
YLGYYRY

SEQ ID NO: 23050 - protein, 7 aa, Artificial Sequence
  Synthetic construct
YLGYYCF

SEQ ID NO: 23051 - protein, 7 aa, Artificial Sequence
  Synthetic construct
YLGYYCY

SEQ ID NO: 23052 - protein, 7 aa, Artificial Sequence
  Synthetic construct
YLGYYLF

SEQ ID NO: 23053 - protein, 7 aa, Artificial Sequence
  Synthetic construct
YLGYYLY

SEQ ID NO: 23054 - protein, 7 aa, Artificial Sequence
  Synthetic construct
YLGYYAF

SEQ ID NO: 23055 - protein, 7 aa, Artificial Sequence
  Synthetic construct
YLGYYAY

SEQ ID NO: 23056 - protein, 7 aa, Artificial Sequence
  Synthetic construct
YLGYYQF

SEQ ID NO: 23057 - protein, 7 aa, Artificial Sequence
  Synthetic construct
YLGYYQY

SEQ ID NO: 23058 - protein, 7 aa, Artificial Sequence
  Synthetic construct
YLGYYDF

SEQ ID NO: 23059 - protein, 7 aa, Artificial Sequence
  Synthetic construct
YLGYYDY

SEQ ID NO: 23060 - protein, 7 aa, Artificial Sequence
  Synthetic construct
YLGYYVF

SEQ ID NO: 23061 - protein, 7 aa, Artificial Sequence
  Synthetic construct
YLGYYVY

SEQ ID NO: 23062 - protein, 7 aa, Artificial Sequence
  Synthetic construct
YLGYFFF

SEQ ID NO: 23063 - protein, 7 aa, Artificial Sequence
  Synthetic construct
YLGYFFY

SEQ ID NO: 23064 - protein, 7 aa, Artificial Sequence
  Synthetic construct
YLGYFRF

SEQ ID NO: 23065 - protein, 7 aa, Artificial Sequence
  Synthetic construct
YLGYFRY

SEQ ID NO: 23066 - protein, 7 aa, Artificial Sequence
  Synthetic construct
YLGYFCF

SEQ ID NO: 23067 - protein, 7 aa, Artificial Sequence
  Synthetic construct
YLGYFCY

SEQ ID NO: 23068 - protein, 7 aa, Artificial Sequence
  Synthetic construct
YLGYFLF

SEQ ID NO: 23069 - protein, 7 aa, Artificial Sequence
  Synthetic construct
YLGYFLY

SEQ ID NO: 23070 - protein, 7 aa, Artificial Sequence
  Synthetic construct
YLGYFAF

SEQ ID NO: 23071 - protein, 7 aa, Artificial Sequence
  Synthetic construct
YLGYFAY

SEQ ID NO: 23072 - protein, 7 aa, Artificial Sequence
  Synthetic construct
YLGYFQF

SEQ ID NO: 23073 - protein, 7 aa, Artificial Sequence
  Synthetic construct
YLGYFQY

SEQ ID NO: 23074 - protein, 7 aa, Artificial Sequence
  Synthetic construct
YLGYFDF

SEQ ID NO: 23075 - protein, 7 aa, Artificial Sequence
  Synthetic construct
YLGYFDY

SEQ ID NO: 23076 - protein, 7 aa, Artificial Sequence
  Synthetic construct
YLGYFVF

SEQ ID NO: 23077 - protein, 7 aa, Artificial Sequence
  Synthetic construct
YLGYFVY

SEQ ID NO: 23078 - protein, 7 aa, Artificial Sequence
  Synthetic construct
YLGYVFF

SEQ ID NO: 23079 - protein, 7 aa, Artificial Sequence
  Synthetic construct
YLGYVFY

SEQ ID NO: 23080 - protein, 7 aa, Artificial Sequence
  Synthetic construct
YLGYVRF

SEQ ID NO: 23081 - protein, 7 aa, Artificial Sequence
  Synthetic construct
YLGYVRY

SEQ ID NO: 23082 - protein, 7 aa, Artificial Sequence
  Synthetic construct
YLGYVCF

SEQ ID NO: 23083 - protein, 7 aa, Artificial Sequence
  Synthetic construct
YLGYVCY

SEQ ID NO: 23084 - protein, 7 aa, Artificial Sequence
  Synthetic construct
YLGYVLF

SEQ ID NO: 23085 - protein, 7 aa, Artificial Sequence
  Synthetic construct
YLGYVLY

SEQ ID NO: 23086 - protein, 7 aa, Artificial Sequence
  Synthetic construct
YLGYVAF

SEQ ID NO: 23087 - protein, 7 aa, Artificial Sequence
  Synthetic construct
YLGYVAY

SEQ ID NO: 23088 - protein, 7 aa, Artificial Sequence
  Synthetic construct
YLGYVQF

SEQ ID NO: 23089 - protein, 7 aa, Artificial Sequence
  Synthetic construct
YLGYVQY

SEQ ID NO: 23090 - protein, 7 aa, Artificial Sequence
  Synthetic construct
YLGYVDF

SEQ ID NO: 23091 - protein, 7 aa, Artificial Sequence
  Synthetic construct
YLGYVDY

SEQ ID NO: 23092 - protein, 7 aa, Artificial Sequence
  Synthetic construct
YLGYVVF

SEQ ID NO: 23093 - protein, 7 aa, Artificial Sequence
  Synthetic construct
YLGYVVY

SEQ ID NO: 23094 - protein, 7 aa, Artificial Sequence
  Synthetic construct
YLGYTFF

SEQ ID NO: 23095 - protein, 7 aa, Artificial Sequence
  Synthetic construct
YLGYTFY

SEQ ID NO: 23096 - protein, 7 aa, Artificial Sequence
  Synthetic construct
YLGYTRF

SEQ ID NO: 23097 - protein, 7 aa, Artificial Sequence
  Synthetic construct
YLGYTRY

SEQ ID NO: 23098 - protein, 7 aa, Artificial Sequence
  Synthetic construct
YLGYTCF

SEQ ID NO: 23099 - protein, 7 aa, Artificial Sequence
  Synthetic construct
YLGYTCY

SEQ ID NO: 23100 - protein, 7 aa, Artificial Sequence
  Synthetic construct
YLGYTLF

SEQ ID NO: 23101 - protein, 7 aa, Artificial Sequence
  Synthetic construct
YLGYTLY

SEQ ID NO: 23102 - protein, 7 aa, Artificial Sequence
  Synthetic construct
YLGYTAF

SEQ ID NO: 23103 - protein, 7 aa, Artificial Sequence
  Synthetic construct
YLGYTAY

SEQ ID NO: 23104 - protein, 7 aa, Artificial Sequence
  Synthetic construct
YLGYTQF

SEQ ID NO: 23105 - protein, 7 aa, Artificial Sequence
  Synthetic construct
YLGYTQY

SEQ ID NO: 23106 - protein, 7 aa, Artificial Sequence
  Synthetic construct
YLGYTDF

SEQ ID NO: 23107 - protein, 7 aa, Artificial Sequence
  Synthetic construct
YLGYTDY

SEQ ID NO: 23108 - protein, 7 aa, Artificial Sequence
  Synthetic construct
YLGYTVF

SEQ ID NO: 23109 - protein, 7 aa, Artificial Sequence
  Synthetic construct
YLGYTVY

SEQ ID NO: 23110 - protein, 7 aa, Artificial Sequence
  Synthetic construct
YLGYGFF

SEQ ID NO: 23111 - protein, 7 aa, Artificial Sequence
  Synthetic construct
YLGYGFY

SEQ ID NO: 23112 - protein, 7 aa, Artificial Sequence
  Synthetic construct
YLGYGRF

SEQ ID NO: 23113 - protein, 7 aa, Artificial Sequence
  Synthetic construct
YLGYGRY

SEQ ID NO: 23114 - protein, 7 aa, Artificial Sequence
  Synthetic construct
YLGYGCF

SEQ ID NO: 23115 - protein, 7 aa, Artificial Sequence
  Synthetic construct
YLGYGCY

SEQ ID NO: 23116 - protein, 7 aa, Artificial Sequence
  Synthetic construct
YLGYGLF

SEQ ID NO: 23117 - protein, 7 aa, Artificial Sequence
  Synthetic construct
YLGYGLY

SEQ ID NO: 23118 - protein, 7 aa, Artificial Sequence
  Synthetic construct
YLGYGAF

SEQ ID NO: 23119 - protein, 7 aa, Artificial Sequence
  Synthetic construct
YLGYGAY

SEQ ID NO: 23120 - protein, 7 aa, Artificial Sequence
  Synthetic construct
YLGYGQF

SEQ ID NO: 23121 - protein, 7 aa, Artificial Sequence
  Synthetic construct
YLGYGQY

SEQ ID NO: 23122 - protein, 7 aa, Artificial Sequence
  Synthetic construct
YLGYGDF

SEQ ID NO: 23123 - protein, 7 aa, Artificial Sequence
  Synthetic construct
YLGYGDY

SEQ ID NO: 23124 - protein, 7 aa, Artificial Sequence
  Synthetic construct
YLGYGVF

SEQ ID NO: 23125 - protein, 7 aa, Artificial Sequence
  Synthetic construct
YLGYGVY

SEQ ID NO: 23126 - protein, 7 aa, Artificial Sequence
  Synthetic construct
YLGYAFF

SEQ ID NO: 23127 - protein, 7 aa, Artificial Sequence
  Synthetic construct
YLGYAFY

SEQ ID NO: 23128 - protein, 7 aa, Artificial Sequence
  Synthetic construct
YLGYARF

SEQ ID NO: 23129 - protein, 7 aa, Artificial Sequence
  Synthetic construct
YLGYARY

SEQ ID NO: 23130 - protein, 7 aa, Artificial Sequence
  Synthetic construct
YLGYACF

SEQ ID NO: 23131 - protein, 7 aa, Artificial Sequence
  Synthetic construct
YLGYACY

SEQ ID NO: 23132 - protein, 7 aa, Artificial Sequence
  Synthetic construct
YLGYALF

SEQ ID NO: 23133 - protein, 7 aa, Artificial Sequence
  Synthetic construct
YLGYALY

SEQ ID NO: 23134 - protein, 7 aa, Artificial Sequence
  Synthetic construct
YLGYAAF

SEQ ID NO: 23135 - protein, 7 aa, Artificial Sequence
  Synthetic construct
YLGYAAY

SEQ ID NO: 23136 - protein, 7 aa, Artificial Sequence
  Synthetic construct
YLGYAQF

SEQ ID NO: 23137 - protein, 7 aa, Artificial Sequence
  Synthetic construct
YLGYAQY

SEQ ID NO: 23138 - protein, 7 aa, Artificial Sequence
  Synthetic construct
YLGYADF

SEQ ID NO: 23139 - protein, 7 aa, Artificial Sequence
  Synthetic construct
YLGYADY

SEQ ID NO: 23140 - protein, 7 aa, Artificial Sequence
  Synthetic construct
YLGYAVF

SEQ ID NO: 23141 - protein, 7 aa, Artificial Sequence
  Synthetic construct
YLGYAVY

SEQ ID NO: 23142 - protein, 7 aa, Artificial Sequence
  Synthetic construct
YLGYQFF

SEQ ID NO: 23143 - protein, 7 aa, Artificial Sequence
  Synthetic construct
YLGYQFY

SEQ ID NO: 23144 - protein, 7 aa, Artificial Sequence
  Synthetic construct
YLGYQRF

SEQ ID NO: 23145 - protein, 7 aa, Artificial Sequence
  Synthetic construct
YLGYQRY

SEQ ID NO: 23146 - protein, 7 aa, Artificial Sequence
  Synthetic construct
YLGYQCF

SEQ ID NO: 23147 - protein, 7 aa, Artificial Sequence
  Synthetic construct
YLGYQCY

SEQ ID NO: 23148 - protein, 7 aa, Artificial Sequence
  Synthetic construct
YLGYQLF

SEQ ID NO: 23149 - protein, 7 aa, Artificial Sequence
  Synthetic construct
YLGYQLY

SEQ ID NO: 23150 - protein, 7 aa, Artificial Sequence
  Synthetic construct
YLGYQAF

SEQ ID NO: 23151 - protein, 7 aa, Artificial Sequence
  Synthetic construct
YLGYQAY

SEQ ID NO: 23152 - protein, 7 aa, Artificial Sequence
  Synthetic construct
YLGYQQF

SEQ ID NO: 23153 - protein, 7 aa, Artificial Sequence
  Synthetic construct
YLGYQQY

SEQ ID NO: 23154 - protein, 7 aa, Artificial Sequence
  Synthetic construct
YLGYQDF

SEQ ID NO: 23155 - protein, 7 aa, Artificial Sequence
  Synthetic construct
YLGYQDY

SEQ ID NO: 23156 - protein, 7 aa, Artificial Sequence
  Synthetic construct
YLGYQVF

SEQ ID NO: 23157 - protein, 7 aa, Artificial Sequence
  Synthetic construct
YLGYQVY

SEQ ID NO: 23158 - protein, 7 aa, Artificial Sequence
  Synthetic construct
YLGPIFF

SEQ ID NO: 23159 - protein, 7 aa, Artificial Sequence
  Synthetic construct
YLGPIFY

SEQ ID NO: 23160 - protein, 7 aa, Artificial Sequence
  Synthetic construct
YLGPIRF

SEQ ID NO: 23161 - protein, 7 aa, Artificial Sequence
  Synthetic construct
YLGPIRY

SEQ ID NO: 23162 - protein, 7 aa, Artificial Sequence
  Synthetic construct
YLGPICF

SEQ ID NO: 23163 - protein, 7 aa, Artificial Sequence
  Synthetic construct
YLGPICY

SEQ ID NO: 23164 - protein, 7 aa, Artificial Sequence
  Synthetic construct
YLGPILF

SEQ ID NO: 23165 - protein, 7 aa, Artificial Sequence
  Synthetic construct
YLGPILY

SEQ ID NO: 23166 - protein, 7 aa, Artificial Sequence
  Synthetic construct
YLGPIAF

SEQ ID NO: 23167 - protein, 7 aa, Artificial Sequence
  Synthetic construct
YLGPIAY

SEQ ID NO: 23168 - protein, 7 aa, Artificial Sequence
  Synthetic construct
YLGPIQF

SEQ ID NO: 23169 - protein, 7 aa, Artificial Sequence
  Synthetic construct
YLGPIQY

SEQ ID NO: 23170 - protein, 7 aa, Artificial Sequence
  Synthetic construct
YLGPIDF

SEQ ID NO: 23171 - protein, 7 aa, Artificial Sequence
  Synthetic construct
YLGPIDY

SEQ ID NO: 23172 - protein, 7 aa, Artificial Sequence
  Synthetic construct
YLGPIVF

SEQ ID NO: 23173 - protein, 7 aa, Artificial Sequence
  Synthetic construct
YLGPIVY

SEQ ID NO: 23174 - protein, 7 aa, Artificial Sequence
  Synthetic construct
YLGPDFF

SEQ ID NO: 23175 - protein, 7 aa, Artificial Sequence
  Synthetic construct
YLGPDFY

SEQ ID NO: 23176 - protein, 7 aa, Artificial Sequence
  Synthetic construct
YLGPDRF

SEQ ID NO: 23177 - protein, 7 aa, Artificial Sequence
  Synthetic construct
YLGPDRY

SEQ ID NO: 23178 - protein, 7 aa, Artificial Sequence
  Synthetic construct
YLGPDCF

SEQ ID NO: 23179 - protein, 7 aa, Artificial Sequence
  Synthetic construct
YLGPDCY

SEQ ID NO: 23180 - protein, 7 aa, Artificial Sequence
  Synthetic construct
YLGPDLF

SEQ ID NO: 23181 - protein, 7 aa, Artificial Sequence
  Synthetic construct
YLGPDLY

SEQ ID NO: 23182 - protein, 7 aa, Artificial Sequence
  Synthetic construct
YLGPDAF

SEQ ID NO: 23183 - protein, 7 aa, Artificial Sequence
  Synthetic construct
YLGPDAY

SEQ ID NO: 23184 - protein, 7 aa, Artificial Sequence
  Synthetic construct
YLGPDQF

SEQ ID NO: 23185 - protein, 7 aa, Artificial Sequence
  Synthetic construct
YLGPDQY

SEQ ID NO: 23186 - protein, 7 aa, Artificial Sequence
  Synthetic construct
YLGPDDF

SEQ ID NO: 23187 - protein, 7 aa, Artificial Sequence
  Synthetic construct
YLGPDDY

SEQ ID NO: 23188 - protein, 7 aa, Artificial Sequence
  Synthetic construct
YLGPDVF

SEQ ID NO: 23189 - protein, 7 aa, Artificial Sequence
  Synthetic construct
YLGPDVY

SEQ ID NO: 23190 - protein, 7 aa, Artificial Sequence
  Synthetic construct
YLGPYFF

SEQ ID NO: 23191 - protein, 7 aa, Artificial Sequence
  Synthetic construct
YLGPYFY

SEQ ID NO: 23192 - protein, 7 aa, Artificial Sequence
  Synthetic construct
YLGPYRF

SEQ ID NO: 23193 - protein, 7 aa, Artificial Sequence
  Synthetic construct
YLGPYRY

SEQ ID NO: 23194 - protein, 7 aa, Artificial Sequence
  Synthetic construct
YLGPYCF

SEQ ID NO: 23195 - protein, 7 aa, Artificial Sequence
  Synthetic construct
YLGPYCY

SEQ ID NO: 23196 - protein, 7 aa, Artificial Sequence
  Synthetic construct
YLGPYLF

SEQ ID NO: 23197 - protein, 7 aa, Artificial Sequence
  Synthetic construct
YLGPYLY

SEQ ID NO: 23198 - protein, 7 aa, Artificial Sequence
  Synthetic construct
YLGPYAF

SEQ ID NO: 23199 - protein, 7 aa, Artificial Sequence
  Synthetic construct
YLGPYAY

SEQ ID NO: 23200 - protein, 7 aa, Artificial Sequence
  Synthetic construct
YLGPYQF

SEQ ID NO: 23201 - protein, 7 aa, Artificial Sequence
  Synthetic construct
YLGPYQY

SEQ ID NO: 23202 - protein, 7 aa, Artificial Sequence
  Synthetic construct
YLGPYDF

SEQ ID NO: 23203 - protein, 7 aa, Artificial Sequence
  Synthetic construct
YLGPYDY

SEQ ID NO: 23204 - protein, 7 aa, Artificial Sequence
  Synthetic construct
YLGPYVF

SEQ ID NO: 23205 - protein, 7 aa, Artificial Sequence
  Synthetic construct
YLGPYVY

SEQ ID NO: 23206 - protein, 7 aa, Artificial Sequence
  Synthetic construct
YLGPFFF

SEQ ID NO: 23207 - protein, 7 aa, Artificial Sequence
  Synthetic construct
YLGPFFY

SEQ ID NO: 23208 - protein, 7 aa, Artificial Sequence
  Synthetic construct
YLGPFRF

SEQ ID NO: 23209 - protein, 7 aa, Artificial Sequence
  Synthetic construct
YLGPFRY

SEQ ID NO: 23210 - protein, 7 aa, Artificial Sequence
  Synthetic construct
YLGPFCF

SEQ ID NO: 23211 - protein, 7 aa, Artificial Sequence
  Synthetic construct
YLGPFCY

SEQ ID NO: 23212 - protein, 7 aa, Artificial Sequence
  Synthetic construct
YLGPFLF

SEQ ID NO: 23213 - protein, 7 aa, Artificial Sequence
  Synthetic construct
YLGPFLY

SEQ ID NO: 23214 - protein, 7 aa, Artificial Sequence
  Synthetic construct
YLGPFAF

SEQ ID NO: 23215 - protein, 7 aa, Artificial Sequence
  Synthetic construct
YLGPFAY

SEQ ID NO: 23216 - protein, 7 aa, Artificial Sequence
  Synthetic construct
YLGPFQF

SEQ ID NO: 23217 - protein, 7 aa, Artificial Sequence
  Synthetic construct
YLGPFQY

SEQ ID NO: 23218 - protein, 7 aa, Artificial Sequence
  Synthetic construct
YLGPFDF

SEQ ID NO: 23219 - protein, 7 aa, Artificial Sequence
  Synthetic construct
YLGPFDY

SEQ ID NO: 23220 - protein, 7 aa, Artificial Sequence
  Synthetic construct
YLGPFVF

SEQ ID NO: 23221 - protein, 7 aa, Artificial Sequence
  Synthetic construct
YLGPFVY

SEQ ID NO: 23222 - protein, 7 aa, Artificial Sequence
  Synthetic construct
YLGPVFF

SEQ ID NO: 23223 - protein, 7 aa, Artificial Sequence
  Synthetic construct
YLGPVFY

SEQ ID NO: 23224 - protein, 7 aa, Artificial Sequence
  Synthetic construct
YLGPVRF

SEQ ID NO: 23225 - protein, 7 aa, Artificial Sequence
  Synthetic construct
YLGPVRY

SEQ ID NO: 23226 - protein, 7 aa, Artificial Sequence
  Synthetic construct
YLGPVCF

SEQ ID NO: 23227 - protein, 7 aa, Artificial Sequence
  Synthetic construct
YLGPVCY

SEQ ID NO: 23228 - protein, 7 aa, Artificial Sequence
  Synthetic construct
YLGPVLF

SEQ ID NO: 23229 - protein, 7 aa, Artificial Sequence
  Synthetic construct
YLGPVLY

SEQ ID NO: 23230 - protein, 7 aa, Artificial Sequence
  Synthetic construct
YLGPVAF

SEQ ID NO: 23231 - protein, 7 aa, Artificial Sequence
  Synthetic construct
YLGPVAY

SEQ ID NO: 23232 - protein, 7 aa, Artificial Sequence
  Synthetic construct
YLGPVQF

SEQ ID NO: 23233 - protein, 7 aa, Artificial Sequence
  Synthetic construct
YLGPVQY

SEQ ID NO: 23234 - protein, 7 aa, Artificial Sequence
  Synthetic construct
YLGPVDF

SEQ ID NO: 23235 - protein, 7 aa, Artificial Sequence
  Synthetic construct
YLGPVDY

SEQ ID NO: 23236 - protein, 7 aa, Artificial Sequence
  Synthetic construct
YLGPVVF

SEQ ID NO: 23237 - protein, 7 aa, Artificial Sequence
  Synthetic construct
YLGPVVY

SEQ ID NO: 23238 - protein, 7 aa, Artificial Sequence
  Synthetic construct
YLGPTFF

SEQ ID NO: 23239 - protein, 7 aa, Artificial Sequence
  Synthetic construct
YLGPTFY

SEQ ID NO: 23240 - protein, 7 aa, Artificial Sequence
  Synthetic construct
YLGPTRF

SEQ ID NO: 23241 - protein, 7 aa, Artificial Sequence
  Synthetic construct
YLGPTRY

SEQ ID NO: 23242 - protein, 7 aa, Artificial Sequence
  Synthetic construct
YLGPTCF

SEQ ID NO: 23243 - protein, 7 aa, Artificial Sequence
  Synthetic construct
YLGPTCY

SEQ ID NO: 23244 - protein, 7 aa, Artificial Sequence
  Synthetic construct
YLGPTLF

SEQ ID NO: 23245 - protein, 7 aa, Artificial Sequence
  Synthetic construct
YLGPTLY

SEQ ID NO: 23246 - protein, 7 aa, Artificial Sequence
  Synthetic construct
YLGPTAF

SEQ ID NO: 23247 - protein, 7 aa, Artificial Sequence
  Synthetic construct
YLGPTAY

SEQ ID NO: 23248 - protein, 7 aa, Artificial Sequence
  Synthetic construct
YLGPTQF

SEQ ID NO: 23249 - protein, 7 aa, Artificial Sequence
  Synthetic construct
YLGPTQY

SEQ ID NO: 23250 - protein, 7 aa, Artificial Sequence
  Synthetic construct
YLGPTDF

SEQ ID NO: 23251 - protein, 7 aa, Artificial Sequence
  Synthetic construct
YLGPTDY

SEQ ID NO: 23252 - protein, 7 aa, Artificial Sequence
  Synthetic construct
YLGPTVF

SEQ ID NO: 23253 - protein, 7 aa, Artificial Sequence
  Synthetic construct
YLGPTVY

SEQ ID NO: 23254 - protein, 7 aa, Artificial Sequence
  Synthetic construct
YLGPGFF

SEQ ID NO: 23255 - protein, 7 aa, Artificial Sequence
  Synthetic construct
YLGPGFY

SEQ ID NO: 23256 - protein, 7 aa, Artificial Sequence
  Synthetic construct
YLGPGRF

SEQ ID NO: 23257 - protein, 7 aa, Artificial Sequence
  Synthetic construct
YLGPGRY

SEQ ID NO: 23258 - protein, 7 aa, Artificial Sequence
  Synthetic construct
YLGPGCF

SEQ ID NO: 23259 - protein, 7 aa, Artificial Sequence
  Synthetic construct
YLGPGCY

SEQ ID NO: 23260 - protein, 7 aa, Artificial Sequence
  Synthetic construct
YLGPGLF

SEQ ID NO: 23261 - protein, 7 aa, Artificial Sequence
  Synthetic construct
YLGPGLY

SEQ ID NO: 23262 - protein, 7 aa, Artificial Sequence
  Synthetic construct
YLGPGAF

SEQ ID NO: 23263 - protein, 7 aa, Artificial Sequence
  Synthetic construct
YLGPGAY

SEQ ID NO: 23264 - protein, 7 aa, Artificial Sequence
  Synthetic construct
YLGPGQF

SEQ ID NO: 23265 - protein, 7 aa, Artificial Sequence
  Synthetic construct
YLGPGQY

SEQ ID NO: 23266 - protein, 7 aa, Artificial Sequence
  Synthetic construct
YLGPGDF

SEQ ID NO: 23267 - protein, 7 aa, Artificial Sequence
  Synthetic construct
YLGPGDY

SEQ ID NO: 23268 - protein, 7 aa, Artificial Sequence
  Synthetic construct
YLGPGVF

SEQ ID NO: 23269 - protein, 7 aa, Artificial Sequence
  Synthetic construct
YLGPGVY

SEQ ID NO: 23270 - protein, 7 aa, Artificial Sequence
  Synthetic construct
YLGPAFF

SEQ ID NO: 23271 - protein, 7 aa, Artificial Sequence
  Synthetic construct
YLGPAFY

SEQ ID NO: 23272 - protein, 7 aa, Artificial Sequence
  Synthetic construct
YLGPARF

SEQ ID NO: 23273 - protein, 7 aa, Artificial Sequence
  Synthetic construct
YLGPARY

SEQ ID NO: 23274 - protein, 7 aa, Artificial Sequence
  Synthetic construct
YLGPACF

SEQ ID NO: 23275 - protein, 7 aa, Artificial Sequence
  Synthetic construct
YLGPACY

SEQ ID NO: 23276 - protein, 7 aa, Artificial Sequence
  Synthetic construct
YLGPALF

SEQ ID NO: 23277 - protein, 7 aa, Artificial Sequence
  Synthetic construct
YLGPALY

SEQ ID NO: 23278 - protein, 7 aa, Artificial Sequence
  Synthetic construct
YLGPAAF

SEQ ID NO: 23279 - protein, 7 aa, Artificial Sequence
  Synthetic construct
YLGPAAY

SEQ ID NO: 23280 - protein, 7 aa, Artificial Sequence
  Synthetic construct
YLGPAQF

SEQ ID NO: 23281 - protein, 7 aa, Artificial Sequence
  Synthetic construct
YLGPAQY

SEQ ID NO: 23282 - protein, 7 aa, Artificial Sequence
  Synthetic construct
YLGPADF

SEQ ID NO: 23283 - protein, 7 aa, Artificial Sequence
  Synthetic construct
YLGPADY

SEQ ID NO: 23284 - protein, 7 aa, Artificial Sequence
  Synthetic construct
YLGPAVF

SEQ ID NO: 23285 - protein, 7 aa, Artificial Sequence
  Synthetic construct
YLGPAVY

SEQ ID NO: 23286 - protein, 7 aa, Artificial Sequence
  Synthetic construct
YLGPQFF

SEQ ID NO: 23287 - protein, 7 aa, Artificial Sequence
  Synthetic construct
YLGPQFY

SEQ ID NO: 23288 - protein, 7 aa, Artificial Sequence
  Synthetic construct
YLGPQRF

SEQ ID NO: 23289 - protein, 7 aa, Artificial Sequence
  Synthetic construct
YLGPQRY

SEQ ID NO: 23290 - protein, 7 aa, Artificial Sequence
  Synthetic construct
YLGPQCF

SEQ ID NO: 23291 - protein, 7 aa, Artificial Sequence
  Synthetic construct
YLGPQCY

SEQ ID NO: 23292 - protein, 7 aa, Artificial Sequence
  Synthetic construct
YLGPQLF

SEQ ID NO: 23293 - protein, 7 aa, Artificial Sequence
  Synthetic construct
YLGPQLY

SEQ ID NO: 23294 - protein, 7 aa, Artificial Sequence
  Synthetic construct
YLGPQAF

SEQ ID NO: 23295 - protein, 7 aa, Artificial Sequence
  Synthetic construct
YLGPQAY

SEQ ID NO: 23296 - protein, 7 aa, Artificial Sequence
  Synthetic construct
YLGPQQF

SEQ ID NO: 23297 - protein, 7 aa, Artificial Sequence
  Synthetic construct
YLGPQQY

SEQ ID NO: 23298 - protein, 7 aa, Artificial Sequence
  Synthetic construct
YLGPQDF

SEQ ID NO: 23299 - protein, 7 aa, Artificial Sequence
  Synthetic construct
YLGPQDY

SEQ ID NO: 23300 - protein, 7 aa, Artificial Sequence
  Synthetic construct
YLGPQVF

SEQ ID NO: 23301 - protein, 7 aa, Artificial Sequence
  Synthetic construct
YLGPQVY

SEQ ID NO: 23302 - protein, 7 aa, Artificial Sequence
  Synthetic construct
YLGHIFF

SEQ ID NO: 23303 - protein, 7 aa, Artificial Sequence
  Synthetic construct
YLGHIFY

SEQ ID NO: 23304 - protein, 7 aa, Artificial Sequence
  Synthetic construct
YLGHIRF

SEQ ID NO: 23305 - protein, 7 aa, Artificial Sequence
  Synthetic construct
YLGHIRY

SEQ ID NO: 23306 - protein, 7 aa, Artificial Sequence
  Synthetic construct
YLGHICF

SEQ ID NO: 23307 - protein, 7 aa, Artificial Sequence
  Synthetic construct
YLGHICY

SEQ ID NO: 23308 - protein, 7 aa, Artificial Sequence
  Synthetic construct
YLGHILF

SEQ ID NO: 23309 - protein, 7 aa, Artificial Sequence
  Synthetic construct
YLGHILY

SEQ ID NO: 23310 - protein, 7 aa, Artificial Sequence
  Synthetic construct
YLGHIAF

SEQ ID NO: 23311 - protein, 7 aa, Artificial Sequence
  Synthetic construct
YLGHIAY

SEQ ID NO: 23312 - protein, 7 aa, Artificial Sequence
  Synthetic construct
YLGHIQF

SEQ ID NO: 23313 - protein, 7 aa, Artificial Sequence
  Synthetic construct
YLGHIQY

SEQ ID NO: 23314 - protein, 7 aa, Artificial Sequence
  Synthetic construct
YLGHIDF

SEQ ID NO: 23315 - protein, 7 aa, Artificial Sequence
  Synthetic construct
YLGHIDY

SEQ ID NO: 23316 - protein, 7 aa, Artificial Sequence
  Synthetic construct
YLGHIVF

SEQ ID NO: 23317 - protein, 7 aa, Artificial Sequence
  Synthetic construct
YLGHIVY

SEQ ID NO: 23318 - protein, 7 aa, Artificial Sequence
  Synthetic construct
YLGHDFF

SEQ ID NO: 23319 - protein, 7 aa, Artificial Sequence
  Synthetic construct
YLGHDFY

SEQ ID NO: 23320 - protein, 7 aa, Artificial Sequence
  Synthetic construct
YLGHDRF

SEQ ID NO: 23321 - protein, 7 aa, Artificial Sequence
  Synthetic construct
YLGHDRY

SEQ ID NO: 23322 - protein, 7 aa, Artificial Sequence
  Synthetic construct
YLGHDCF

SEQ ID NO: 23323 - protein, 7 aa, Artificial Sequence
  Synthetic construct
YLGHDCY

SEQ ID NO: 23324 - protein, 7 aa, Artificial Sequence
  Synthetic construct
YLGHDLF

SEQ ID NO: 23325 - protein, 7 aa, Artificial Sequence
  Synthetic construct
YLGHDLY

SEQ ID NO: 23326 - protein, 7 aa, Artificial Sequence
  Synthetic construct
YLGHDAF

SEQ ID NO: 23327 - protein, 7 aa, Artificial Sequence
  Synthetic construct
YLGHDAY

SEQ ID NO: 23328 - protein, 7 aa, Artificial Sequence
  Synthetic construct
YLGHDQF

SEQ ID NO: 23329 - protein, 7 aa, Artificial Sequence
  Synthetic construct
YLGHDQY

SEQ ID NO: 23330 - protein, 7 aa, Artificial Sequence
  Synthetic construct
YLGHDDF

SEQ ID NO: 23331 - protein, 7 aa, Artificial Sequence
  Synthetic construct
YLGHDDY

SEQ ID NO: 23332 - protein, 7 aa, Artificial Sequence
  Synthetic construct
YLGHDVF

SEQ ID NO: 23333 - protein, 7 aa, Artificial Sequence
  Synthetic construct
YLGHDVY

SEQ ID NO: 23334 - protein, 7 aa, Artificial Sequence
  Synthetic construct
YLGHYFF

SEQ ID NO: 23335 - protein, 7 aa, Artificial Sequence
  Synthetic construct
YLGHYFY

SEQ ID NO: 23336 - protein, 7 aa, Artificial Sequence
  Synthetic construct
YLGHYRF

SEQ ID NO: 23337 - protein, 7 aa, Artificial Sequence
  Synthetic construct
YLGHYRY

SEQ ID NO: 23338 - protein, 7 aa, Artificial Sequence
  Synthetic construct
YLGHYCF

SEQ ID NO: 23339 - protein, 7 aa, Artificial Sequence
  Synthetic construct
YLGHYCY

SEQ ID NO: 23340 - protein, 7 aa, Artificial Sequence
  Synthetic construct
YLGHYLF

SEQ ID NO: 23341 - protein, 7 aa, Artificial Sequence
  Synthetic construct
YLGHYLY

SEQ ID NO: 23342 - protein, 7 aa, Artificial Sequence
  Synthetic construct
YLGHYAF

SEQ ID NO: 23343 - protein, 7 aa, Artificial Sequence
  Synthetic construct
YLGHYAY

SEQ ID NO: 23344 - protein, 7 aa, Artificial Sequence
  Synthetic construct
YLGHYQF

SEQ ID NO: 23345 - protein, 7 aa, Artificial Sequence
  Synthetic construct
YLGHYQY

SEQ ID NO: 23346 - protein, 7 aa, Artificial Sequence
  Synthetic construct
YLGHYDF

SEQ ID NO: 23347 - protein, 7 aa, Artificial Sequence
  Synthetic construct
YLGHYDY

SEQ ID NO: 23348 - protein, 7 aa, Artificial Sequence
  Synthetic construct
YLGHYVF

SEQ ID NO: 23349 - protein, 7 aa, Artificial Sequence
  Synthetic construct
YLGHYVY

SEQ ID NO: 23350 - protein, 7 aa, Artificial Sequence
  Synthetic construct
YLGHFFF

SEQ ID NO: 23351 - protein, 7 aa, Artificial Sequence
  Synthetic construct
YLGHFFY

SEQ ID NO: 23352 - protein, 7 aa, Artificial Sequence
  Synthetic construct
YLGHFRF

SEQ ID NO: 23353 - protein, 7 aa, Artificial Sequence
  Synthetic construct
YLGHFRY

SEQ ID NO: 23354 - protein, 7 aa, Artificial Sequence
  Synthetic construct
YLGHFCF

SEQ ID NO: 23355 - protein, 7 aa, Artificial Sequence
  Synthetic construct
YLGHFCY

SEQ ID NO: 23356 - protein, 7 aa, Artificial Sequence
  Synthetic construct
YLGHFLF

SEQ ID NO: 23357 - protein, 7 aa, Artificial Sequence
  Synthetic construct
YLGHFLY

SEQ ID NO: 23358 - protein, 7 aa, Artificial Sequence
  Synthetic construct
YLGHFAF

SEQ ID NO: 23359 - protein, 7 aa, Artificial Sequence
  Synthetic construct
YLGHFAY

SEQ ID NO: 23360 - protein, 7 aa, Artificial Sequence
  Synthetic construct
YLGHFQF

SEQ ID NO: 23361 - protein, 7 aa, Artificial Sequence
  Synthetic construct
YLGHFQY

SEQ ID NO: 23362 - protein, 7 aa, Artificial Sequence
  Synthetic construct
YLGHFDF

SEQ ID NO: 23363 - protein, 7 aa, Artificial Sequence
  Synthetic construct
YLGHFDY

SEQ ID NO: 23364 - protein, 7 aa, Artificial Sequence
  Synthetic construct
YLGHFVF

SEQ ID NO: 23365 - protein, 7 aa, Artificial Sequence
  Synthetic construct
YLGHFVY

SEQ ID NO: 23366 - protein, 7 aa, Artificial Sequence
  Synthetic construct
YLGHVFF

SEQ ID NO: 23367 - protein, 7 aa, Artificial Sequence
  Synthetic construct
YLGHVFY

SEQ ID NO: 23368 - protein, 7 aa, Artificial Sequence
  Synthetic construct
YLGHVRF

SEQ ID NO: 23369 - protein, 7 aa, Artificial Sequence
  Synthetic construct
YLGHVRY

SEQ ID NO: 23370 - protein, 7 aa, Artificial Sequence
  Synthetic construct
YLGHVCF

SEQ ID NO: 23371 - protein, 7 aa, Artificial Sequence
  Synthetic construct
YLGHVCY

SEQ ID NO: 23372 - protein, 7 aa, Artificial Sequence
  Synthetic construct
YLGHVLF

SEQ ID NO: 23373 - protein, 7 aa, Artificial Sequence
  Synthetic construct
YLGHVLY

SEQ ID NO: 23374 - protein, 7 aa, Artificial Sequence
  Synthetic construct
YLGHVAF

SEQ ID NO: 23375 - protein, 7 aa, Artificial Sequence
  Synthetic construct
YLGHVAY

SEQ ID NO: 23376 - protein, 7 aa, Artificial Sequence
  Synthetic construct
YLGHVQF

SEQ ID NO: 23377 - protein, 7 aa, Artificial Sequence
  Synthetic construct
YLGHVQY

SEQ ID NO: 23378 - protein, 7 aa, Artificial Sequence
  Synthetic construct
YLGHVDF

SEQ ID NO: 23379 - protein, 7 aa, Artificial Sequence
  Synthetic construct
YLGHVDY

SEQ ID NO: 23380 - protein, 7 aa, Artificial Sequence
  Synthetic construct
YLGHVVF

SEQ ID NO: 23381 - protein, 7 aa, Artificial Sequence
  Synthetic construct
YLGHVVY

SEQ ID NO: 23382 - protein, 7 aa, Artificial Sequence
  Synthetic construct
YLGHTFF

SEQ ID NO: 23383 - protein, 7 aa, Artificial Sequence
  Synthetic construct
YLGHTFY

SEQ ID NO: 23384 - protein, 7 aa, Artificial Sequence
  Synthetic construct
YLGHTRF

SEQ ID NO: 23385 - protein, 7 aa, Artificial Sequence
  Synthetic construct
YLGHTRY

SEQ ID NO: 23386 - protein, 7 aa, Artificial Sequence
  Synthetic construct
YLGHTCF

SEQ ID NO: 23387 - protein, 7 aa, Artificial Sequence
  Synthetic construct
YLGHTCY

SEQ ID NO: 23388 - protein, 7 aa, Artificial Sequence
  Synthetic construct
YLGHTLF

SEQ ID NO: 23389 - protein, 7 aa, Artificial Sequence
  Synthetic construct
YLGHTLY

SEQ ID NO: 23390 - protein, 7 aa, Artificial Sequence
  Synthetic construct
YLGHTAF

SEQ ID NO: 23391 - protein, 7 aa, Artificial Sequence
  Synthetic construct
YLGHTAY

SEQ ID NO: 23392 - protein, 7 aa, Artificial Sequence
  Synthetic construct
YLGHTQF

SEQ ID NO: 23393 - protein, 7 aa, Artificial Sequence
  Synthetic construct
YLGHTQY

SEQ ID NO: 23394 - protein, 7 aa, Artificial Sequence
  Synthetic construct
YLGHTDF

SEQ ID NO: 23395 - protein, 7 aa, Artificial Sequence
  Synthetic construct
YLGHTDY

SEQ ID NO: 23396 - protein, 7 aa, Artificial Sequence
  Synthetic construct
YLGHTVF

SEQ ID NO: 23397 - protein, 7 aa, Artificial Sequence
  Synthetic construct
YLGHTVY

SEQ ID NO: 23398 - protein, 7 aa, Artificial Sequence
  Synthetic construct
YLGHGFF

SEQ ID NO: 23399 - protein, 7 aa, Artificial Sequence
  Synthetic construct
YLGHGFY

SEQ ID NO: 23400 - protein, 7 aa, Artificial Sequence
  Synthetic construct
YLGHGRF

SEQ ID NO: 23401 - protein, 7 aa, Artificial Sequence
  Synthetic construct
YLGHGRY

SEQ ID NO: 23402 - protein, 7 aa, Artificial Sequence
  Synthetic construct
YLGHGCF

SEQ ID NO: 23403 - protein, 7 aa, Artificial Sequence
  Synthetic construct
YLGHGCY

SEQ ID NO: 23404 - protein, 7 aa, Artificial Sequence
  Synthetic construct
YLGHGLF

SEQ ID NO: 23405 - protein, 7 aa, Artificial Sequence
  Synthetic construct
YLGHGLY

SEQ ID NO: 23406 - protein, 7 aa, Artificial Sequence
  Synthetic construct
YLGHGAF

SEQ ID NO: 23407 - protein, 7 aa, Artificial Sequence
  Synthetic construct
YLGHGAY

SEQ ID NO: 23408 - protein, 7 aa, Artificial Sequence
  Synthetic construct
YLGHGQF

SEQ ID NO: 23409 - protein, 7 aa, Artificial Sequence
  Synthetic construct
YLGHGQY

SEQ ID NO: 23410 - protein, 7 aa, Artificial Sequence
  Synthetic construct
YLGHGDF

SEQ ID NO: 23411 - protein, 7 aa, Artificial Sequence
  Synthetic construct
YLGHGDY

SEQ ID NO: 23412 - protein, 7 aa, Artificial Sequence
  Synthetic construct
YLGHGVF

SEQ ID NO: 23413 - protein, 7 aa, Artificial Sequence
  Synthetic construct
YLGHGVY

SEQ ID NO: 23414 - protein, 7 aa, Artificial Sequence
  Synthetic construct
YLGHAFF

SEQ ID NO: 23415 - protein, 7 aa, Artificial Sequence
  Synthetic construct
YLGHAFY

SEQ ID NO: 23416 - protein, 7 aa, Artificial Sequence
  Synthetic construct
YLGHARF

SEQ ID NO: 23417 - protein, 7 aa, Artificial Sequence
  Synthetic construct
YLGHARY

SEQ ID NO: 23418 - protein, 7 aa, Artificial Sequence
  Synthetic construct
YLGHACF

SEQ ID NO: 23419 - protein, 7 aa, Artificial Sequence
  Synthetic construct
YLGHACY

SEQ ID NO: 23420 - protein, 7 aa, Artificial Sequence
  Synthetic construct
YLGHALF

SEQ ID NO: 23421 - protein, 7 aa, Artificial Sequence
  Synthetic construct
YLGHALY

SEQ ID NO: 23422 - protein, 7 aa, Artificial Sequence
  Synthetic construct
YLGHAAF

SEQ ID NO: 23423 - protein, 7 aa, Artificial Sequence
  Synthetic construct
YLGHAAY

SEQ ID NO: 23424 - protein, 7 aa, Artificial Sequence
  Synthetic construct
YLGHAQF

SEQ ID NO: 23425 - protein, 7 aa, Artificial Sequence
  Synthetic construct
YLGHAQY

SEQ ID NO: 23426 - protein, 7 aa, Artificial Sequence
  Synthetic construct
YLGHADF

SEQ ID NO: 23427 - protein, 7 aa, Artificial Sequence
  Synthetic construct
YLGHADY

SEQ ID NO: 23428 - protein, 7 aa, Artificial Sequence
  Synthetic construct
YLGHAVF

SEQ ID NO: 23429 - protein, 7 aa, Artificial Sequence
  Synthetic construct
YLGHAVY

SEQ ID NO: 23430 - protein, 7 aa, Artificial Sequence
  Synthetic construct
YLGHQFF

SEQ ID NO: 23431 - protein, 7 aa, Artificial Sequence
  Synthetic construct
YLGHQFY

SEQ ID NO: 23432 - protein, 7 aa, Artificial Sequence
  Synthetic construct
YLGHQRF

SEQ ID NO: 23433 - protein, 7 aa, Artificial Sequence
  Synthetic construct
YLGHQRY

SEQ ID NO: 23434 - protein, 7 aa, Artificial Sequence
  Synthetic construct
YLGHQCF

SEQ ID NO: 23435 - protein, 7 aa, Artificial Sequence
  Synthetic construct
YLGHQCY

SEQ ID NO: 23436 - protein, 7 aa, Artificial Sequence
  Synthetic construct
YLGHQLF

SEQ ID NO: 23437 - protein, 7 aa, Artificial Sequence
  Synthetic construct
YLGHQLY

SEQ ID NO: 23438 - protein, 7 aa, Artificial Sequence
  Synthetic construct
YLGHQAF

SEQ ID NO: 23439 - protein, 7 aa, Artificial Sequence
  Synthetic construct
YLGHQAY

SEQ ID NO: 23440 - protein, 7 aa, Artificial Sequence
  Synthetic construct
YLGHQQF

SEQ ID NO: 23441 - protein, 7 aa, Artificial Sequence
  Synthetic construct
YLGHQQY

SEQ ID NO: 23442 - protein, 7 aa, Artificial Sequence
  Synthetic construct
YLGHQDF

SEQ ID NO: 23443 - protein, 7 aa, Artificial Sequence
  Synthetic construct
YLGHQDY

SEQ ID NO: 23444 - protein, 7 aa, Artificial Sequence
  Synthetic construct
YLGHQVF

SEQ ID NO: 23445 - protein, 7 aa, Artificial Sequence
  Synthetic construct
YLGHQVY

SEQ ID NO: 23446 - protein, 7 aa, Artificial Sequence
  Synthetic construct
YLGLIFF

SEQ ID NO: 23447 - protein, 7 aa, Artificial Sequence
  Synthetic construct
YLGLIFY

SEQ ID NO: 23448 - protein, 7 aa, Artificial Sequence
  Synthetic construct
YLGLIRF

SEQ ID NO: 23449 - protein, 7 aa, Artificial Sequence
  Synthetic construct
YLGLIRY

SEQ ID NO: 23450 - protein, 7 aa, Artificial Sequence
  Synthetic construct
YLGLICF

SEQ ID NO: 23451 - protein, 7 aa, Artificial Sequence
  Synthetic construct
YLGLICY

SEQ ID NO: 23452 - protein, 7 aa, Artificial Sequence
  Synthetic construct
YLGLILF

SEQ ID NO: 23453 - protein, 7 aa, Artificial Sequence
  Synthetic construct
YLGLILY

SEQ ID NO: 23454 - protein, 7 aa, Artificial Sequence
  Synthetic construct
YLGLIAF

SEQ ID NO: 23455 - protein, 7 aa, Artificial Sequence
  Synthetic construct
YLGLIAY

SEQ ID NO: 23456 - protein, 7 aa, Artificial Sequence
  Synthetic construct
YLGLIQF

SEQ ID NO: 23457 - protein, 7 aa, Artificial Sequence
  Synthetic construct
YLGLIQY

SEQ ID NO: 23458 - protein, 7 aa, Artificial Sequence
  Synthetic construct
YLGLIDF

SEQ ID NO: 23459 - protein, 7 aa, Artificial Sequence
  Synthetic construct
YLGLIDY

SEQ ID NO: 23460 - protein, 7 aa, Artificial Sequence
  Synthetic construct
YLGLIVF

SEQ ID NO: 23461 - protein, 7 aa, Artificial Sequence
  Synthetic construct
YLGLIVY

SEQ ID NO: 23462 - protein, 7 aa, Artificial Sequence
  Synthetic construct
YLGLDFF

SEQ ID NO: 23463 - protein, 7 aa, Artificial Sequence
  Synthetic construct
YLGLDFY

SEQ ID NO: 23464 - protein, 7 aa, Artificial Sequence
  Synthetic construct
YLGLDRF

SEQ ID NO: 23465 - protein, 7 aa, Artificial Sequence
  Synthetic construct
YLGLDRY

SEQ ID NO: 23466 - protein, 7 aa, Artificial Sequence
  Synthetic construct
YLGLDCF

SEQ ID NO: 23467 - protein, 7 aa, Artificial Sequence
  Synthetic construct
YLGLDCY

SEQ ID NO: 23468 - protein, 7 aa, Artificial Sequence
  Synthetic construct
YLGLDLF

SEQ ID NO: 23469 - protein, 7 aa, Artificial Sequence
  Synthetic construct
YLGLDLY

SEQ ID NO: 23470 - protein, 7 aa, Artificial Sequence
  Synthetic construct
YLGLDAF

SEQ ID NO: 23471 - protein, 7 aa, Artificial Sequence
  Synthetic construct
YLGLDAY

SEQ ID NO: 23472 - protein, 7 aa, Artificial Sequence
  Synthetic construct
YLGLDQF

SEQ ID NO: 23473 - protein, 7 aa, Artificial Sequence
  Synthetic construct
YLGLDQY

SEQ ID NO: 23474 - protein, 7 aa, Artificial Sequence
  Synthetic construct
YLGLDDF

SEQ ID NO: 23475 - protein, 7 aa, Artificial Sequence
  Synthetic construct
YLGLDDY

SEQ ID NO: 23476 - protein, 7 aa, Artificial Sequence
  Synthetic construct
YLGLDVF

SEQ ID NO: 23477 - protein, 7 aa, Artificial Sequence
  Synthetic construct
YLGLDVY

SEQ ID NO: 23478 - protein, 7 aa, Artificial Sequence
  Synthetic construct
YLGLYFF

SEQ ID NO: 23479 - protein, 7 aa, Artificial Sequence
  Synthetic construct
YLGLYFY

SEQ ID NO: 23480 - protein, 7 aa, Artificial Sequence
  Synthetic construct
YLGLYRF

SEQ ID NO: 23481 - protein, 7 aa, Artificial Sequence
  Synthetic construct
YLGLYRY

SEQ ID NO: 23482 - protein, 7 aa, Artificial Sequence
  Synthetic construct
YLGLYCF

SEQ ID NO: 23483 - protein, 7 aa, Artificial Sequence
  Synthetic construct
YLGLYCY

SEQ ID NO: 23484 - protein, 7 aa, Artificial Sequence
  Synthetic construct
YLGLYLF

SEQ ID NO: 23485 - protein, 7 aa, Artificial Sequence
  Synthetic construct
YLGLYLY

SEQ ID NO: 23486 - protein, 7 aa, Artificial Sequence
  Synthetic construct
YLGLYAF

SEQ ID NO: 23487 - protein, 7 aa, Artificial Sequence
  Synthetic construct
YLGLYAY

SEQ ID NO: 23488 - protein, 7 aa, Artificial Sequence
  Synthetic construct
YLGLYQF

SEQ ID NO: 23489 - protein, 7 aa, Artificial Sequence
  Synthetic construct
YLGLYQY

SEQ ID NO: 23490 - protein, 7 aa, Artificial Sequence
  Synthetic construct
YLGLYDF

SEQ ID NO: 23491 - protein, 7 aa, Artificial Sequence
  Synthetic construct
YLGLYDY

SEQ ID NO: 23492 - protein, 7 aa, Artificial Sequence
  Synthetic construct
YLGLYVF

SEQ ID NO: 23493 - protein, 7 aa, Artificial Sequence
  Synthetic construct
YLGLYVY

SEQ ID NO: 23494 - protein, 7 aa, Artificial Sequence
  Synthetic construct
YLGLFFF

SEQ ID NO: 23495 - protein, 7 aa, Artificial Sequence
  Synthetic construct
YLGLFFY

SEQ ID NO: 23496 - protein, 7 aa, Artificial Sequence
  Synthetic construct
YLGLFRF

SEQ ID NO: 23497 - protein, 7 aa, Artificial Sequence
  Synthetic construct
YLGLFRY

SEQ ID NO: 23498 - protein, 7 aa, Artificial Sequence
  Synthetic construct
YLGLFCF

SEQ ID NO: 23499 - protein, 7 aa, Artificial Sequence
  Synthetic construct
YLGLFCY

SEQ ID NO: 23500 - protein, 7 aa, Artificial Sequence
  Synthetic construct
YLGLFLF

SEQ ID NO: 23501 - protein, 7 aa, Artificial Sequence
  Synthetic construct
YLGLFLY

SEQ ID NO: 23502 - protein, 7 aa, Artificial Sequence
  Synthetic construct
YLGLFAF

SEQ ID NO: 23503 - protein, 7 aa, Artificial Sequence
  Synthetic construct
YLGLFAY

SEQ ID NO: 23504 - protein, 7 aa, Artificial Sequence
  Synthetic construct
YLGLFQF

SEQ ID NO: 23505 - protein, 7 aa, Artificial Sequence
  Synthetic construct
YLGLFQY

SEQ ID NO: 23506 - protein, 7 aa, Artificial Sequence
  Synthetic construct
YLGLFDF

SEQ ID NO: 23507 - protein, 7 aa, Artificial Sequence
  Synthetic construct
YLGLFDY

SEQ ID NO: 23508 - protein, 7 aa, Artificial Sequence
  Synthetic construct
YLGLFVF

SEQ ID NO: 23509 - protein, 7 aa, Artificial Sequence
  Synthetic construct
YLGLFVY

SEQ ID NO: 23510 - protein, 7 aa, Artificial Sequence
  Synthetic construct
YLGLVFF

SEQ ID NO: 23511 - protein, 7 aa, Artificial Sequence
  Synthetic construct
YLGLVFY

SEQ ID NO: 23512 - protein, 7 aa, Artificial Sequence
  Synthetic construct
YLGLVRF

SEQ ID NO: 23513 - protein, 7 aa, Artificial Sequence
  Synthetic construct
YLGLVRY

SEQ ID NO: 23514 - protein, 7 aa, Artificial Sequence
  Synthetic construct
YLGLVCF

SEQ ID NO: 23515 - protein, 7 aa, Artificial Sequence
  Synthetic construct
YLGLVCY

SEQ ID NO: 23516 - protein, 7 aa, Artificial Sequence
  Synthetic construct
YLGLVLF

SEQ ID NO: 23517 - protein, 7 aa, Artificial Sequence
  Synthetic construct
YLGLVLY

SEQ ID NO: 23518 - protein, 7 aa, Artificial Sequence
  Synthetic construct
YLGLVAF

SEQ ID NO: 23519 - protein, 7 aa, Artificial Sequence
  Synthetic construct
YLGLVAY

SEQ ID NO: 23520 - protein, 7 aa, Artificial Sequence
  Synthetic construct
YLGLVQF

SEQ ID NO: 23521 - protein, 7 aa, Artificial Sequence
  Synthetic construct
YLGLVQY

SEQ ID NO: 23522 - protein, 7 aa, Artificial Sequence
  Synthetic construct
YLGLVDF

SEQ ID NO: 23523 - protein, 7 aa, Artificial Sequence
  Synthetic construct
YLGLVDY

SEQ ID NO: 23524 - protein, 7 aa, Artificial Sequence
  Synthetic construct
YLGLVVF

SEQ ID NO: 23525 - protein, 7 aa, Artificial Sequence
  Synthetic construct
YLGLVVY

SEQ ID NO: 23526 - protein, 7 aa, Artificial Sequence
  Synthetic construct
YLGLTFF

SEQ ID NO: 23527 - protein, 7 aa, Artificial Sequence
  Synthetic construct
YLGLTFY

SEQ ID NO: 23528 - protein, 7 aa, Artificial Sequence
  Synthetic construct
YLGLTRF

SEQ ID NO: 23529 - protein, 7 aa, Artificial Sequence
  Synthetic construct
YLGLTRY

SEQ ID NO: 23530 - protein, 7 aa, Artificial Sequence
  Synthetic construct
YLGLTCF

SEQ ID NO: 23531 - protein, 7 aa, Artificial Sequence
  Synthetic construct
YLGLTCY

SEQ ID NO: 23532 - protein, 7 aa, Artificial Sequence
  Synthetic construct
YLGLTLF

SEQ ID NO: 23533 - protein, 7 aa, Artificial Sequence
  Synthetic construct
YLGLTLY

SEQ ID NO: 23534 - protein, 7 aa, Artificial Sequence
  Synthetic construct
YLGLTAF

SEQ ID NO: 23535 - protein, 7 aa, Artificial Sequence
  Synthetic construct
YLGLTAY

SEQ ID NO: 23536 - protein, 7 aa, Artificial Sequence
  Synthetic construct
YLGLTQF

SEQ ID NO: 23537 - protein, 7 aa, Artificial Sequence
  Synthetic construct
YLGLTQY

SEQ ID NO: 23538 - protein, 7 aa, Artificial Sequence
  Synthetic construct
YLGLTDF

SEQ ID NO: 23539 - protein, 7 aa, Artificial Sequence
  Synthetic construct
YLGLTDY

SEQ ID NO: 23540 - protein, 7 aa, Artificial Sequence
  Synthetic construct
YLGLTVF

SEQ ID NO: 23541 - protein, 7 aa, Artificial Sequence
  Synthetic construct
YLGLTVY

SEQ ID NO: 23542 - protein, 7 aa, Artificial Sequence
  Synthetic construct
YLGLGFF

SEQ ID NO: 23543 - protein, 7 aa, Artificial Sequence
  Synthetic construct
YLGLGFY

SEQ ID NO: 23544 - protein, 7 aa, Artificial Sequence
  Synthetic construct
YLGLGRF

SEQ ID NO: 23545 - protein, 7 aa, Artificial Sequence
  Synthetic construct
YLGLGRY

SEQ ID NO: 23546 - protein, 7 aa, Artificial Sequence
  Synthetic construct
YLGLGCF

SEQ ID NO: 23547 - protein, 7 aa, Artificial Sequence
  Synthetic construct
YLGLGCY

SEQ ID NO: 23548 - protein, 7 aa, Artificial Sequence
  Synthetic construct
YLGLGLF

SEQ ID NO: 23549 - protein, 7 aa, Artificial Sequence
  Synthetic construct
YLGLGLY

SEQ ID NO: 23550 - protein, 7 aa, Artificial Sequence
  Synthetic construct
YLGLGAF

SEQ ID NO: 23551 - protein, 7 aa, Artificial Sequence
  Synthetic construct
YLGLGAY

SEQ ID NO: 23552 - protein, 7 aa, Artificial Sequence
  Synthetic construct
YLGLGQF

SEQ ID NO: 23553 - protein, 7 aa, Artificial Sequence
  Synthetic construct
YLGLGQY

SEQ ID NO: 23554 - protein, 7 aa, Artificial Sequence
  Synthetic construct
YLGLGDF

SEQ ID NO: 23555 - protein, 7 aa, Artificial Sequence
  Synthetic construct
YLGLGDY

SEQ ID NO: 23556 - protein, 7 aa, Artificial Sequence
  Synthetic construct
YLGLGVF

SEQ ID NO: 23557 - protein, 7 aa, Artificial Sequence
  Synthetic construct
YLGLGVY

SEQ ID NO: 23558 - protein, 7 aa, Artificial Sequence
  Synthetic construct
YLGLAFF

SEQ ID NO: 23559 - protein, 7 aa, Artificial Sequence
  Synthetic construct
YLGLAFY

SEQ ID NO: 23560 - protein, 7 aa, Artificial Sequence
  Synthetic construct
YLGLARF

SEQ ID NO: 23561 - protein, 7 aa, Artificial Sequence
  Synthetic construct
YLGLARY

SEQ ID NO: 23562 - protein, 7 aa, Artificial Sequence
  Synthetic construct
YLGLACF

SEQ ID NO: 23563 - protein, 7 aa, Artificial Sequence
  Synthetic construct
YLGLACY

SEQ ID NO: 23564 - protein, 7 aa, Artificial Sequence
  Synthetic construct
YLGLALF

SEQ ID NO: 23565 - protein, 7 aa, Artificial Sequence
  Synthetic construct
YLGLALY

SEQ ID NO: 23566 - protein, 7 aa, Artificial Sequence
  Synthetic construct
YLGLAAF

SEQ ID NO: 23567 - protein, 7 aa, Artificial Sequence
  Synthetic construct
YLGLAAY

SEQ ID NO: 23568 - protein, 7 aa, Artificial Sequence
  Synthetic construct
YLGLAQF

SEQ ID NO: 23569 - protein, 7 aa, Artificial Sequence
  Synthetic construct
YLGLAQY

SEQ ID NO: 23570 - protein, 7 aa, Artificial Sequence
  Synthetic construct
YLGLADF

SEQ ID NO: 23571 - protein, 7 aa, Artificial Sequence
  Synthetic construct
YLGLADY

SEQ ID NO: 23572 - protein, 7 aa, Artificial Sequence
  Synthetic construct
YLGLAVF

SEQ ID NO: 23573 - protein, 7 aa, Artificial Sequence
  Synthetic construct
YLGLAVY

SEQ ID NO: 23574 - protein, 7 aa, Artificial Sequence
  Synthetic construct
YLGLQFF

SEQ ID NO: 23575 - protein, 7 aa, Artificial Sequence
  Synthetic construct
YLGLQFY

SEQ ID NO: 23576 - protein, 7 aa, Artificial Sequence
  Synthetic construct
YLGLQRF

SEQ ID NO: 23577 - protein, 7 aa, Artificial Sequence
  Synthetic construct
YLGLQRY

SEQ ID NO: 23578 - protein, 7 aa, Artificial Sequence
  Synthetic construct
YLGLQCF

SEQ ID NO: 23579 - protein, 7 aa, Artificial Sequence
  Synthetic construct
YLGLQCY

SEQ ID NO: 23580 - protein, 7 aa, Artificial Sequence
  Synthetic construct
YLGLQLF

SEQ ID NO: 23581 - protein, 7 aa, Artificial Sequence
  Synthetic construct
YLGLQLY

SEQ ID NO: 23582 - protein, 7 aa, Artificial Sequence
  Synthetic construct
YLGLQAF

SEQ ID NO: 23583 - protein, 7 aa, Artificial Sequence
  Synthetic construct
YLGLQAY

SEQ ID NO: 23584 - protein, 7 aa, Artificial Sequence
  Synthetic construct
YLGLQQF

SEQ ID NO: 23585 - protein, 7 aa, Artificial Sequence
  Synthetic construct
YLGLQQY

SEQ ID NO: 23586 - protein, 7 aa, Artificial Sequence
  Synthetic construct
YLGLQDF

SEQ ID NO: 23587 - protein, 7 aa, Artificial Sequence
  Synthetic construct
YLGLQDY

SEQ ID NO: 23588 - protein, 7 aa, Artificial Sequence
  Synthetic construct
YLGLQVF

SEQ ID NO: 23589 - protein, 7 aa, Artificial Sequence
  Synthetic construct
YLGLQVY

SEQ ID NO: 23590 - protein, 7 aa, Artificial Sequence
  Synthetic construct
YLGFIFF

SEQ ID NO: 23591 - protein, 7 aa, Artificial Sequence
  Synthetic construct
YLGFIFY

SEQ ID NO: 23592 - protein, 7 aa, Artificial Sequence
  Synthetic construct
YLGFIRF

SEQ ID NO: 23593 - protein, 7 aa, Artificial Sequence
  Synthetic construct
YLGFIRY

SEQ ID NO: 23594 - protein, 7 aa, Artificial Sequence
  Synthetic construct
YLGFICF

SEQ ID NO: 23595 - protein, 7 aa, Artificial Sequence
  Synthetic construct
YLGFICY

SEQ ID NO: 23596 - protein, 7 aa, Artificial Sequence
  Synthetic construct
YLGFILF

SEQ ID NO: 23597 - protein, 7 aa, Artificial Sequence
  Synthetic construct
YLGFILY

SEQ ID NO: 23598 - protein, 7 aa, Artificial Sequence
  Synthetic construct
YLGFIAF

SEQ ID NO: 23599 - protein, 7 aa, Artificial Sequence
  Synthetic construct
YLGFIAY

SEQ ID NO: 23600 - protein, 7 aa, Artificial Sequence
  Synthetic construct
YLGFIQF

SEQ ID NO: 23601 - protein, 7 aa, Artificial Sequence
  Synthetic construct
YLGFIQY

SEQ ID NO: 23602 - protein, 7 aa, Artificial Sequence
  Synthetic construct
YLGFIDF

SEQ ID NO: 23603 - protein, 7 aa, Artificial Sequence
  Synthetic construct
YLGFIDY

SEQ ID NO: 23604 - protein, 7 aa, Artificial Sequence
  Synthetic construct
YLGFIVF

SEQ ID NO: 23605 - protein, 7 aa, Artificial Sequence
  Synthetic construct
YLGFIVY

SEQ ID NO: 23606 - protein, 7 aa, Artificial Sequence
  Synthetic construct
YLGFDFF

SEQ ID NO: 23607 - protein, 7 aa, Artificial Sequence
  Synthetic construct
YLGFDFY

SEQ ID NO: 23608 - protein, 7 aa, Artificial Sequence
  Synthetic construct
YLGFDRF

SEQ ID NO: 23609 - protein, 7 aa, Artificial Sequence
  Synthetic construct
YLGFDRY

SEQ ID NO: 23610 - protein, 7 aa, Artificial Sequence
  Synthetic construct
YLGFDCF

SEQ ID NO: 23611 - protein, 7 aa, Artificial Sequence
  Synthetic construct
YLGFDCY

SEQ ID NO: 23612 - protein, 7 aa, Artificial Sequence
  Synthetic construct
YLGFDLF

SEQ ID NO: 23613 - protein, 7 aa, Artificial Sequence
  Synthetic construct
YLGFDLY

SEQ ID NO: 23614 - protein, 7 aa, Artificial Sequence
  Synthetic construct
YLGFDAF

SEQ ID NO: 23615 - protein, 7 aa, Artificial Sequence
  Synthetic construct
YLGFDAY

SEQ ID NO: 23616 - protein, 7 aa, Artificial Sequence
  Synthetic construct
YLGFDQF

SEQ ID NO: 23617 - protein, 7 aa, Artificial Sequence
  Synthetic construct
YLGFDQY

SEQ ID NO: 23618 - protein, 7 aa, Artificial Sequence
  Synthetic construct
YLGFDDF

SEQ ID NO: 23619 - protein, 7 aa, Artificial Sequence
  Synthetic construct
YLGFDDY

SEQ ID NO: 23620 - protein, 7 aa, Artificial Sequence
  Synthetic construct
YLGFDVF

SEQ ID NO: 23621 - protein, 7 aa, Artificial Sequence
  Synthetic construct
YLGFDVY

SEQ ID NO: 23622 - protein, 7 aa, Artificial Sequence
  Synthetic construct
YLGFYFF

SEQ ID NO: 23623 - protein, 7 aa, Artificial Sequence
  Synthetic construct
YLGFYFY

SEQ ID NO: 23624 - protein, 7 aa, Artificial Sequence
  Synthetic construct
YLGFYRF

SEQ ID NO: 23625 - protein, 7 aa, Artificial Sequence
  Synthetic construct
YLGFYRY

SEQ ID NO: 23626 - protein, 7 aa, Artificial Sequence
  Synthetic construct
YLGFYCF

SEQ ID NO: 23627 - protein, 7 aa, Artificial Sequence
  Synthetic construct
YLGFYCY

SEQ ID NO: 23628 - protein, 7 aa, Artificial Sequence
  Synthetic construct
YLGFYLF

SEQ ID NO: 23629 - protein, 7 aa, Artificial Sequence
  Synthetic construct
YLGFYLY

SEQ ID NO: 23630 - protein, 7 aa, Artificial Sequence
  Synthetic construct
YLGFYAF

SEQ ID NO: 23631 - protein, 7 aa, Artificial Sequence
  Synthetic construct
YLGFYAY

SEQ ID NO: 23632 - protein, 7 aa, Artificial Sequence
  Synthetic construct
YLGFYQF

SEQ ID NO: 23633 - protein, 7 aa, Artificial Sequence
  Synthetic construct
YLGFYQY

SEQ ID NO: 23634 - protein, 7 aa, Artificial Sequence
  Synthetic construct
YLGFYDF

SEQ ID NO: 23635 - protein, 7 aa, Artificial Sequence
  Synthetic construct
YLGFYDY

SEQ ID NO: 23636 - protein, 7 aa, Artificial Sequence
  Synthetic construct
YLGFYVF

SEQ ID NO: 23637 - protein, 7 aa, Artificial Sequence
  Synthetic construct
YLGFYVY

SEQ ID NO: 23638 - protein, 7 aa, Artificial Sequence
  Synthetic construct
YLGFFFF

SEQ ID NO: 23639 - protein, 7 aa, Artificial Sequence
  Synthetic construct
YLGFFFY

SEQ ID NO: 23640 - protein, 7 aa, Artificial Sequence
  Synthetic construct
YLGFFRF

SEQ ID NO: 23641 - protein, 7 aa, Artificial Sequence
  Synthetic construct
YLGFFRY

SEQ ID NO: 23642 - protein, 7 aa, Artificial Sequence
  Synthetic construct
YLGFFCF

SEQ ID NO: 23643 - protein, 7 aa, Artificial Sequence
  Synthetic construct
YLGFFCY

SEQ ID NO: 23644 - protein, 7 aa, Artificial Sequence
  Synthetic construct
YLGFFLF

SEQ ID NO: 23645 - protein, 7 aa, Artificial Sequence
  Synthetic construct
YLGFFLY

SEQ ID NO: 23646 - protein, 7 aa, Artificial Sequence
  Synthetic construct
YLGFFAF

SEQ ID NO: 23647 - protein, 7 aa, Artificial Sequence
  Synthetic construct
YLGFFAY

SEQ ID NO: 23648 - protein, 7 aa, Artificial Sequence
  Synthetic construct
YLGFFQF

SEQ ID NO: 23649 - protein, 7 aa, Artificial Sequence
  Synthetic construct
YLGFFQY

SEQ ID NO: 23650 - protein, 7 aa, Artificial Sequence
  Synthetic construct
YLGFFDF

SEQ ID NO: 23651 - protein, 7 aa, Artificial Sequence
  Synthetic construct
YLGFFDY

SEQ ID NO: 23652 - protein, 7 aa, Artificial Sequence
  Synthetic construct
YLGFFVF

SEQ ID NO: 23653 - protein, 7 aa, Artificial Sequence
  Synthetic construct
YLGFFVY

SEQ ID NO: 23654 - protein, 7 aa, Artificial Sequence
  Synthetic construct
YLGFVFF

SEQ ID NO: 23655 - protein, 7 aa, Artificial Sequence
  Synthetic construct
YLGFVFY

SEQ ID NO: 23656 - protein, 7 aa, Artificial Sequence
  Synthetic construct
YLGFVRF

SEQ ID NO: 23657 - protein, 7 aa, Artificial Sequence
  Synthetic construct
YLGFVRY

SEQ ID NO: 23658 - protein, 7 aa, Artificial Sequence
  Synthetic construct
YLGFVCF

SEQ ID NO: 23659 - protein, 7 aa, Artificial Sequence
  Synthetic construct
YLGFVCY

SEQ ID NO: 23660 - protein, 7 aa, Artificial Sequence
  Synthetic construct
YLGFVLF

SEQ ID NO: 23661 - protein, 7 aa, Artificial Sequence
  Synthetic construct
YLGFVLY

SEQ ID NO: 23662 - protein, 7 aa, Artificial Sequence
  Synthetic construct
YLGFVAF

SEQ ID NO: 23663 - protein, 7 aa, Artificial Sequence
  Synthetic construct
YLGFVAY

SEQ ID NO: 23664 - protein, 7 aa, Artificial Sequence
  Synthetic construct
YLGFVQF

SEQ ID NO: 23665 - protein, 7 aa, Artificial Sequence
  Synthetic construct
YLGFVQY

SEQ ID NO: 23666 - protein, 7 aa, Artificial Sequence
  Synthetic construct
YLGFVDF

SEQ ID NO: 23667 - protein, 7 aa, Artificial Sequence
  Synthetic construct
YLGFVDY

SEQ ID NO: 23668 - protein, 7 aa, Artificial Sequence
  Synthetic construct
YLGFVVF

SEQ ID NO: 23669 - protein, 7 aa, Artificial Sequence
  Synthetic construct
YLGFVVY

SEQ ID NO: 23670 - protein, 7 aa, Artificial Sequence
  Synthetic construct
YLGFTFF

SEQ ID NO: 23671 - protein, 7 aa, Artificial Sequence
  Synthetic construct
YLGFTFY

SEQ ID NO: 23672 - protein, 7 aa, Artificial Sequence
  Synthetic construct
YLGFTRF

SEQ ID NO: 23673 - protein, 7 aa, Artificial Sequence
  Synthetic construct
YLGFTRY

SEQ ID NO: 23674 - protein, 7 aa, Artificial Sequence
  Synthetic construct
YLGFTCF

SEQ ID NO: 23675 - protein, 7 aa, Artificial Sequence
  Synthetic construct
YLGFTCY

SEQ ID NO: 23676 - protein, 7 aa, Artificial Sequence
  Synthetic construct
YLGFTLF

SEQ ID NO: 23677 - protein, 7 aa, Artificial Sequence
  Synthetic construct
YLGFTLY

SEQ ID NO: 23678 - protein, 7 aa, Artificial Sequence
  Synthetic construct
YLGFTAF

SEQ ID NO: 23679 - protein, 7 aa, Artificial Sequence
  Synthetic construct
YLGFTAY

SEQ ID NO: 23680 - protein, 7 aa, Artificial Sequence
  Synthetic construct
YLGFTQF

SEQ ID NO: 23681 - protein, 7 aa, Artificial Sequence
  Synthetic construct
YLGFTQY

SEQ ID NO: 23682 - protein, 7 aa, Artificial Sequence
  Synthetic construct
YLGFTDF

SEQ ID NO: 23683 - protein, 7 aa, Artificial Sequence
  Synthetic construct
YLGFTDY

SEQ ID NO: 23684 - protein, 7 aa, Artificial Sequence
  Synthetic construct
YLGFTVF

SEQ ID NO: 23685 - protein, 7 aa, Artificial Sequence
  Synthetic construct
YLGFTVY

SEQ ID NO: 23686 - protein, 7 aa, Artificial Sequence
  Synthetic construct
YLGFGFF

SEQ ID NO: 23687 - protein, 7 aa, Artificial Sequence
  Synthetic construct
YLGFGFY

SEQ ID NO: 23688 - protein, 7 aa, Artificial Sequence
  Synthetic construct
YLGFGRF

SEQ ID NO: 23689 - protein, 7 aa, Artificial Sequence
  Synthetic construct
YLGFGRY

SEQ ID NO: 23690 - protein, 7 aa, Artificial Sequence
  Synthetic construct
YLGFGCF

SEQ ID NO: 23691 - protein, 7 aa, Artificial Sequence
  Synthetic construct
YLGFGCY

SEQ ID NO: 23692 - protein, 7 aa, Artificial Sequence
  Synthetic construct
YLGFGLF

SEQ ID NO: 23693 - protein, 7 aa, Artificial Sequence
  Synthetic construct
YLGFGLY

SEQ ID NO: 23694 - protein, 7 aa, Artificial Sequence
  Synthetic construct
YLGFGAF

SEQ ID NO: 23695 - protein, 7 aa, Artificial Sequence
  Synthetic construct
YLGFGAY

SEQ ID NO: 23696 - protein, 7 aa, Artificial Sequence
  Synthetic construct
YLGFGQF

SEQ ID NO: 23697 - protein, 7 aa, Artificial Sequence
  Synthetic construct
YLGFGQY

SEQ ID NO: 23698 - protein, 7 aa, Artificial Sequence
  Synthetic construct
YLGFGDF

SEQ ID NO: 23699 - protein, 7 aa, Artificial Sequence
  Synthetic construct
YLGFGDY

SEQ ID NO: 23700 - protein, 7 aa, Artificial Sequence
  Synthetic construct
YLGFGVF

SEQ ID NO: 23701 - protein, 7 aa, Artificial Sequence
  Synthetic construct
YLGFGVY

SEQ ID NO: 23702 - protein, 7 aa, Artificial Sequence
  Synthetic construct
YLGFAFF

SEQ ID NO: 23703 - protein, 7 aa, Artificial Sequence
  Synthetic construct
YLGFAFY

SEQ ID NO: 23704 - protein, 7 aa, Artificial Sequence
  Synthetic construct
YLGFARF

SEQ ID NO: 23705 - protein, 7 aa, Artificial Sequence
  Synthetic construct
YLGFARY

SEQ ID NO: 23706 - protein, 7 aa, Artificial Sequence
  Synthetic construct
YLGFACF

SEQ ID NO: 23707 - protein, 7 aa, Artificial Sequence
  Synthetic construct
YLGFACY

SEQ ID NO: 23708 - protein, 7 aa, Artificial Sequence
  Synthetic construct
YLGFALF

SEQ ID NO: 23709 - protein, 7 aa, Artificial Sequence
  Synthetic construct
YLGFALY

SEQ ID NO: 23710 - protein, 7 aa, Artificial Sequence
  Synthetic construct
YLGFAAF

SEQ ID NO: 23711 - protein, 7 aa, Artificial Sequence
  Synthetic construct
YLGFAAY

SEQ ID NO: 23712 - protein, 7 aa, Artificial Sequence
  Synthetic construct
YLGFAQF

SEQ ID NO: 23713 - protein, 7 aa, Artificial Sequence
  Synthetic construct
YLGFAQY

SEQ ID NO: 23714 - protein, 7 aa, Artificial Sequence
  Synthetic construct
YLGFADF

SEQ ID NO: 23715 - protein, 7 aa, Artificial Sequence
  Synthetic construct
YLGFADY

SEQ ID NO: 23716 - protein, 7 aa, Artificial Sequence
  Synthetic construct
YLGFAVF

SEQ ID NO: 23717 - protein, 7 aa, Artificial Sequence
  Synthetic construct
YLGFAVY

SEQ ID NO: 23718 - protein, 7 aa, Artificial Sequence
  Synthetic construct
YLGFQFF

SEQ ID NO: 23719 - protein, 7 aa, Artificial Sequence
  Synthetic construct
YLGFQFY

SEQ ID NO: 23720 - protein, 7 aa, Artificial Sequence
  Synthetic construct
YLGFQRF

SEQ ID NO: 23721 - protein, 7 aa, Artificial Sequence
  Synthetic construct
YLGFQRY

SEQ ID NO: 23722 - protein, 7 aa, Artificial Sequence
  Synthetic construct
YLGFQCF

SEQ ID NO: 23723 - protein, 7 aa, Artificial Sequence
  Synthetic construct
YLGFQCY

SEQ ID NO: 23724 - protein, 7 aa, Artificial Sequence
  Synthetic construct
YLGFQLF

SEQ ID NO: 23725 - protein, 7 aa, Artificial Sequence
  Synthetic construct
YLGFQLY

SEQ ID NO: 23726 - protein, 7 aa, Artificial Sequence
  Synthetic construct
YLGFQAF

SEQ ID NO: 23727 - protein, 7 aa, Artificial Sequence
  Synthetic construct
YLGFQAY

SEQ ID NO: 23728 - protein, 7 aa, Artificial Sequence
  Synthetic construct
YLGFQQF

SEQ ID NO: 23729 - protein, 7 aa, Artificial Sequence
  Synthetic construct
YLGFQQY

SEQ ID NO: 23730 - protein, 7 aa, Artificial Sequence
  Synthetic construct
YLGFQDF

SEQ ID NO: 23731 - protein, 7 aa, Artificial Sequence
  Synthetic construct
YLGFQDY

SEQ ID NO: 23732 - protein, 7 aa, Artificial Sequence
  Synthetic construct
YLGFQVF

SEQ ID NO: 23733 - protein, 7 aa, Artificial Sequence
  Synthetic construct
YLGFQVY

SEQ ID NO: 23734 - protein, 7 aa, Artificial Sequence
  Synthetic construct
WWIYIFF

SEQ ID NO: 23735 - protein, 7 aa, Artificial Sequence
  Synthetic construct
WWIYIFY

SEQ ID NO: 23736 - protein, 7 aa, Artificial Sequence
  Synthetic construct
WWIYIRF

SEQ ID NO: 23737 - protein, 7 aa, Artificial Sequence
  Synthetic construct
WWIYIRY

SEQ ID NO: 23738 - protein, 7 aa, Artificial Sequence
  Synthetic construct
WWIYICF

SEQ ID NO: 23739 - protein, 7 aa, Artificial Sequence
  Synthetic construct
WWIYICY

SEQ ID NO: 23740 - protein, 7 aa, Artificial Sequence
  Synthetic construct
WWIYILF

SEQ ID NO: 23741 - protein, 7 aa, Artificial Sequence
  Synthetic construct
WWIYILY

SEQ ID NO: 23742 - protein, 7 aa, Artificial Sequence
  Synthetic construct
WWIYIAF

SEQ ID NO: 23743 - protein, 7 aa, Artificial Sequence
  Synthetic construct
WWIYIAY

SEQ ID NO: 23744 - protein, 7 aa, Artificial Sequence
  Synthetic construct
WWIYIQF

SEQ ID NO: 23745 - protein, 7 aa, Artificial Sequence
  Synthetic construct
WWIYIQY

SEQ ID NO: 23746 - protein, 7 aa, Artificial Sequence
  Synthetic construct
WWIYIDF

SEQ ID NO: 23747 - protein, 7 aa, Artificial Sequence
  Synthetic construct
WWIYIDY

SEQ ID NO: 23748 - protein, 7 aa, Artificial Sequence
  Synthetic construct
WWIYIVF

SEQ ID NO: 23749 - protein, 7 aa, Artificial Sequence
  Synthetic construct
WWIYIVY

SEQ ID NO: 23750 - protein, 7 aa, Artificial Sequence
  Synthetic construct
WWIYDFF

SEQ ID NO: 23751 - protein, 7 aa, Artificial Sequence
  Synthetic construct
WWIYDFY

SEQ ID NO: 23752 - protein, 7 aa, Artificial Sequence
  Synthetic construct
WWIYDRF

SEQ ID NO: 23753 - protein, 7 aa, Artificial Sequence
  Synthetic construct
WWIYDRY

SEQ ID NO: 23754 - protein, 7 aa, Artificial Sequence
  Synthetic construct
WWIYDCF

SEQ ID NO: 23755 - protein, 7 aa, Artificial Sequence
  Synthetic construct
WWIYDCY

SEQ ID NO: 23756 - protein, 7 aa, Artificial Sequence
  Synthetic construct
WWIYDLF

SEQ ID NO: 23757 - protein, 7 aa, Artificial Sequence
  Synthetic construct
WWIYDLY

SEQ ID NO: 23758 - protein, 7 aa, Artificial Sequence
  Synthetic construct
WWIYDAF

SEQ ID NO: 23759 - protein, 7 aa, Artificial Sequence
  Synthetic construct
WWIYDAY

SEQ ID NO: 23760 - protein, 7 aa, Artificial Sequence
  Synthetic construct
WWIYDQF

SEQ ID NO: 23761 - protein, 7 aa, Artificial Sequence
  Synthetic construct
WWIYDQY

SEQ ID NO: 23762 - protein, 7 aa, Artificial Sequence
  Synthetic construct
WWIYDDF

SEQ ID NO: 23763 - protein, 7 aa, Artificial Sequence
  Synthetic construct
WWIYDDY

SEQ ID NO: 23764 - protein, 7 aa, Artificial Sequence
  Synthetic construct
WWIYDVF

SEQ ID NO: 23765 - protein, 7 aa, Artificial Sequence
  Synthetic construct
WWIYDVY

SEQ ID NO: 23766 - protein, 7 aa, Artificial Sequence
  Synthetic construct
WWIYYFF

SEQ ID NO: 23767 - protein, 7 aa, Artificial Sequence
  Synthetic construct
WWIYYFY

SEQ ID NO: 23768 - protein, 7 aa, Artificial Sequence
  Synthetic construct
WWIYYRF

SEQ ID NO: 23769 - protein, 7 aa, Artificial Sequence
  Synthetic construct
WWIYYRY

SEQ ID NO: 23770 - protein, 7 aa, Artificial Sequence
  Synthetic construct
WWIYYCF

SEQ ID NO: 23771 - protein, 7 aa, Artificial Sequence
  Synthetic construct
WWIYYCY

SEQ ID NO: 23772 - protein, 7 aa, Artificial Sequence
  Synthetic construct
WWIYYLF

SEQ ID NO: 23773 - protein, 7 aa, Artificial Sequence
  Synthetic construct
WWIYYLY

SEQ ID NO: 23774 - protein, 7 aa, Artificial Sequence
  Synthetic construct
WWIYYAF

SEQ ID NO: 23775 - protein, 7 aa, Artificial Sequence
  Synthetic construct
WWIYYAY

SEQ ID NO: 23776 - protein, 7 aa, Artificial Sequence
  Synthetic construct
WWIYYQF

SEQ ID NO: 23777 - protein, 7 aa, Artificial Sequence
  Synthetic construct
WWIYYQY

SEQ ID NO: 23778 - protein, 7 aa, Artificial Sequence
  Synthetic construct
WWIYYDF

SEQ ID NO: 23779 - protein, 7 aa, Artificial Sequence
  Synthetic construct
WWIYYDY

SEQ ID NO: 23780 - protein, 7 aa, Artificial Sequence
  Synthetic construct
WWIYYVF

SEQ ID NO: 23781 - protein, 7 aa, Artificial Sequence
  Synthetic construct
WWIYYVY

SEQ ID NO: 23782 - protein, 7 aa, Artificial Sequence
  Synthetic construct
WWIYFFF

SEQ ID NO: 23783 - protein, 7 aa, Artificial Sequence
  Synthetic construct
WWIYFFY

SEQ ID NO: 23784 - protein, 7 aa, Artificial Sequence
  Synthetic construct
WWIYFRF

SEQ ID NO: 23785 - protein, 7 aa, Artificial Sequence
  Synthetic construct
WWIYFRY

SEQ ID NO: 23786 - protein, 7 aa, Artificial Sequence
  Synthetic construct
WWIYFCF

SEQ ID NO: 23787 - protein, 7 aa, Artificial Sequence
  Synthetic construct
WWIYFCY

SEQ ID NO: 23788 - protein, 7 aa, Artificial Sequence
  Synthetic construct
WWIYFLF

SEQ ID NO: 23789 - protein, 7 aa, Artificial Sequence
  Synthetic construct
WWIYFLY

SEQ ID NO: 23790 - protein, 7 aa, Artificial Sequence
  Synthetic construct
WWIYFAF

SEQ ID NO: 23791 - protein, 7 aa, Artificial Sequence
  Synthetic construct
WWIYFAY

SEQ ID NO: 23792 - protein, 7 aa, Artificial Sequence
  Synthetic construct
WWIYFQF

SEQ ID NO: 23793 - protein, 7 aa, Artificial Sequence
  Synthetic construct
WWIYFQY

SEQ ID NO: 23794 - protein, 7 aa, Artificial Sequence
  Synthetic construct
WWIYFDF

SEQ ID NO: 23795 - protein, 7 aa, Artificial Sequence
  Synthetic construct
WWIYFDY

SEQ ID NO: 23796 - protein, 7 aa, Artificial Sequence
  Synthetic construct
WWIYFVF

SEQ ID NO: 23797 - protein, 7 aa, Artificial Sequence
  Synthetic construct
WWIYFVY

SEQ ID NO: 23798 - protein, 7 aa, Artificial Sequence
  Synthetic construct
WWIYVFF

SEQ ID NO: 23799 - protein, 7 aa, Artificial Sequence
  Synthetic construct
WWIYVFY

SEQ ID NO: 23800 - protein, 7 aa, Artificial Sequence
  Synthetic construct
WWIYVRF

SEQ ID NO: 23801 - protein, 7 aa, Artificial Sequence
  Synthetic construct
WWIYVRY

SEQ ID NO: 23802 - protein, 7 aa, Artificial Sequence
  Synthetic construct
WWIYVCF

SEQ ID NO: 23803 - protein, 7 aa, Artificial Sequence
  Synthetic construct
WWIYVCY

SEQ ID NO: 23804 - protein, 7 aa, Artificial Sequence
  Synthetic construct
WWIYVLF

SEQ ID NO: 23805 - protein, 7 aa, Artificial Sequence
  Synthetic construct
WWIYVLY

SEQ ID NO: 23806 - protein, 7 aa, Artificial Sequence
  Synthetic construct
WWIYVAF

SEQ ID NO: 23807 - protein, 7 aa, Artificial Sequence
  Synthetic construct
WWIYVAY

SEQ ID NO: 23808 - protein, 7 aa, Artificial Sequence
  Synthetic construct
WWIYVQF

SEQ ID NO: 23809 - protein, 7 aa, Artificial Sequence
  Synthetic construct
WWIYVQY

SEQ ID NO: 23810 - protein, 7 aa, Artificial Sequence
  Synthetic construct
WWIYVDF

SEQ ID NO: 23811 - protein, 7 aa, Artificial Sequence
  Synthetic construct
WWIYVDY

SEQ ID NO: 23812 - protein, 7 aa, Artificial Sequence
  Synthetic construct
WWIYVVF

SEQ ID NO: 23813 - protein, 7 aa, Artificial Sequence
  Synthetic construct
WWIYVVY

SEQ ID NO: 23814 - protein, 7 aa, Artificial Sequence
  Synthetic construct
WWIYTFF

SEQ ID NO: 23815 - protein, 7 aa, Artificial Sequence
  Synthetic construct
WWIYTFY

SEQ ID NO: 23816 - protein, 7 aa, Artificial Sequence
  Synthetic construct
WWIYTRF

SEQ ID NO: 23817 - protein, 7 aa, Artificial Sequence
  Synthetic construct
WWIYTRY

SEQ ID NO: 23818 - protein, 7 aa, Artificial Sequence
  Synthetic construct
WWIYTCF

SEQ ID NO: 23819 - protein, 7 aa, Artificial Sequence
  Synthetic construct
WWIYTCY

SEQ ID NO: 23820 - protein, 7 aa, Artificial Sequence
  Synthetic construct
WWIYTLF

SEQ ID NO: 23821 - protein, 7 aa, Artificial Sequence
  Synthetic construct
WWIYTLY

SEQ ID NO: 23822 - protein, 7 aa, Artificial Sequence
  Synthetic construct
WWIYTAF

SEQ ID NO: 23823 - protein, 7 aa, Artificial Sequence
  Synthetic construct
WWIYTAY

SEQ ID NO: 23824 - protein, 7 aa, Artificial Sequence
  Synthetic construct
WWIYTQF

SEQ ID NO: 23825 - protein, 7 aa, Artificial Sequence
  Synthetic construct
WWIYTQY

SEQ ID NO: 23826 - protein, 7 aa, Artificial Sequence
  Synthetic construct
WWIYTDF

SEQ ID NO: 23827 - protein, 7 aa, Artificial Sequence
  Synthetic construct
WWIYTDY

SEQ ID NO: 23828 - protein, 7 aa, Artificial Sequence
  Synthetic construct
WWIYTVF

SEQ ID NO: 23829 - protein, 7 aa, Artificial Sequence
  Synthetic construct
WWIYTVY

SEQ ID NO: 23830 - protein, 7 aa, Artificial Sequence
  Synthetic construct
WWIYGFF

SEQ ID NO: 23831 - protein, 7 aa, Artificial Sequence
  Synthetic construct
WWIYGFY

SEQ ID NO: 23832 - protein, 7 aa, Artificial Sequence
  Synthetic construct
WWIYGRF

SEQ ID NO: 23833 - protein, 7 aa, Artificial Sequence
  Synthetic construct
WWIYGRY

SEQ ID NO: 23834 - protein, 7 aa, Artificial Sequence
  Synthetic construct
WWIYGCF

SEQ ID NO: 23835 - protein, 7 aa, Artificial Sequence
  Synthetic construct
WWIYGCY

SEQ ID NO: 23836 - protein, 7 aa, Artificial Sequence
  Synthetic construct
WWIYGLF

SEQ ID NO: 23837 - protein, 7 aa, Artificial Sequence
  Synthetic construct
WWIYGLY

SEQ ID NO: 23838 - protein, 7 aa, Artificial Sequence
  Synthetic construct
WWIYGAF

SEQ ID NO: 23839 - protein, 7 aa, Artificial Sequence
  Synthetic construct
WWIYGAY

SEQ ID NO: 23840 - protein, 7 aa, Artificial Sequence
  Synthetic construct
WWIYGQF

SEQ ID NO: 23841 - protein, 7 aa, Artificial Sequence
  Synthetic construct
WWIYGQY

SEQ ID NO: 23842 - protein, 7 aa, Artificial Sequence
  Synthetic construct
WWIYGDF

SEQ ID NO: 23843 - protein, 7 aa, Artificial Sequence
  Synthetic construct
WWIYGDY

SEQ ID NO: 23844 - protein, 7 aa, Artificial Sequence
  Synthetic construct
WWIYGVF

SEQ ID NO: 23845 - protein, 7 aa, Artificial Sequence
  Synthetic construct
WWIYGVY

SEQ ID NO: 23846 - protein, 7 aa, Artificial Sequence
  Synthetic construct
WWIYAFF

SEQ ID NO: 23847 - protein, 7 aa, Artificial Sequence
  Synthetic construct
WWIYAFY

SEQ ID NO: 23848 - protein, 7 aa, Artificial Sequence
  Synthetic construct
WWIYARF

SEQ ID NO: 23849 - protein, 7 aa, Artificial Sequence
  Synthetic construct
WWIYARY

SEQ ID NO: 23850 - protein, 7 aa, Artificial Sequence
  Synthetic construct
WWIYACF

SEQ ID NO: 23851 - protein, 7 aa, Artificial Sequence
  Synthetic construct
WWIYACY

SEQ ID NO: 23852 - protein, 7 aa, Artificial Sequence
  Synthetic construct
WWIYALF

SEQ ID NO: 23853 - protein, 7 aa, Artificial Sequence
  Synthetic construct
WWIYALY

SEQ ID NO: 23854 - protein, 7 aa, Artificial Sequence
  Synthetic construct
WWIYAAF

SEQ ID NO: 23855 - protein, 7 aa, Artificial Sequence
  Synthetic construct
WWIYAAY

SEQ ID NO: 23856 - protein, 7 aa, Artificial Sequence
  Synthetic construct
WWIYAQF

SEQ ID NO: 23857 - protein, 7 aa, Artificial Sequence
  Synthetic construct
WWIYAQY

SEQ ID NO: 23858 - protein, 7 aa, Artificial Sequence
  Synthetic construct
WWIYADF

SEQ ID NO: 23859 - protein, 7 aa, Artificial Sequence
  Synthetic construct
WWIYADY

SEQ ID NO: 23860 - protein, 7 aa, Artificial Sequence
  Synthetic construct
WWIYAVF

SEQ ID NO: 23861 - protein, 7 aa, Artificial Sequence
  Synthetic construct
WWIYAVY

SEQ ID NO: 23862 - protein, 7 aa, Artificial Sequence
  Synthetic construct
WWIYQFF

SEQ ID NO: 23863 - protein, 7 aa, Artificial Sequence
  Synthetic construct
WWIYQFY

SEQ ID NO: 23864 - protein, 7 aa, Artificial Sequence
  Synthetic construct
WWIYQRF

SEQ ID NO: 23865 - protein, 7 aa, Artificial Sequence
  Synthetic construct
WWIYQRY

SEQ ID NO: 23866 - protein, 7 aa, Artificial Sequence
  Synthetic construct
WWIYQCF

SEQ ID NO: 23867 - protein, 7 aa, Artificial Sequence
  Synthetic construct
WWIYQCY

SEQ ID NO: 23868 - protein, 7 aa, Artificial Sequence
  Synthetic construct
WWIYQLF

SEQ ID NO: 23869 - protein, 7 aa, Artificial Sequence
  Synthetic construct
WWIYQLY

SEQ ID NO: 23870 - protein, 7 aa, Artificial Sequence
  Synthetic construct
WWIYQAF

SEQ ID NO: 23871 - protein, 7 aa, Artificial Sequence
  Synthetic construct
WWIYQAY

SEQ ID NO: 23872 - protein, 7 aa, Artificial Sequence
  Synthetic construct
WWIYQQF

SEQ ID NO: 23873 - protein, 7 aa, Artificial Sequence
  Synthetic construct
WWIYQQY

SEQ ID NO: 23874 - protein, 7 aa, Artificial Sequence
  Synthetic construct
WWIYQDF

SEQ ID NO: 23875 - protein, 7 aa, Artificial Sequence
  Synthetic construct
WWIYQDY

SEQ ID NO: 23876 - protein, 7 aa, Artificial Sequence
  Synthetic construct
WWIYQVF

SEQ ID NO: 23877 - protein, 7 aa, Artificial Sequence
  Synthetic construct
WWIYQVY

SEQ ID NO: 23878 - protein, 7 aa, Artificial Sequence
  Synthetic construct
WWIPIFF

SEQ ID NO: 23879 - protein, 7 aa, Artificial Sequence
  Synthetic construct
WWIPIFY

SEQ ID NO: 23880 - protein, 7 aa, Artificial Sequence
  Synthetic construct
WWIPIRF

SEQ ID NO: 23881 - protein, 7 aa, Artificial Sequence
  Synthetic construct
WWIPIRY

SEQ ID NO: 23882 - protein, 7 aa, Artificial Sequence
  Synthetic construct
WWIPICF

SEQ ID NO: 23883 - protein, 7 aa, Artificial Sequence
  Synthetic construct
WWIPICY

SEQ ID NO: 23884 - protein, 7 aa, Artificial Sequence
  Synthetic construct
WWIPILF

SEQ ID NO: 23885 - protein, 7 aa, Artificial Sequence
  Synthetic construct
WWIPILY

SEQ ID NO: 23886 - protein, 7 aa, Artificial Sequence
  Synthetic construct
WWIPIAF

SEQ ID NO: 23887 - protein, 7 aa, Artificial Sequence
  Synthetic construct
WWIPIAY

SEQ ID NO: 23888 - protein, 7 aa, Artificial Sequence
  Synthetic construct
WWIPIQF

SEQ ID NO: 23889 - protein, 7 aa, Artificial Sequence
  Synthetic construct
WWIPIQY

SEQ ID NO: 23890 - protein, 7 aa, Artificial Sequence
  Synthetic construct
WWIPIDF

SEQ ID NO: 23891 - protein, 7 aa, Artificial Sequence
  Synthetic construct
WWIPIDY

SEQ ID NO: 23892 - protein, 7 aa, Artificial Sequence
  Synthetic construct
WWIPIVF

SEQ ID NO: 23893 - protein, 7 aa, Artificial Sequence
  Synthetic construct
WWIPIVY

SEQ ID NO: 23894 - protein, 7 aa, Artificial Sequence
  Synthetic construct
WWIPDFF

SEQ ID NO: 23895 - protein, 7 aa, Artificial Sequence
  Synthetic construct
WWIPDFY

SEQ ID NO: 23896 - protein, 7 aa, Artificial Sequence
  Synthetic construct
WWIPDRF

SEQ ID NO: 23897 - protein, 7 aa, Artificial Sequence
  Synthetic construct
WWIPDRY

SEQ ID NO: 23898 - protein, 7 aa, Artificial Sequence
  Synthetic construct
WWIPDCF

SEQ ID NO: 23899 - protein, 7 aa, Artificial Sequence
  Synthetic construct
WWIPDCY

SEQ ID NO: 23900 - protein, 7 aa, Artificial Sequence
  Synthetic construct
WWIPDLF

SEQ ID NO: 23901 - protein, 7 aa, Artificial Sequence
  Synthetic construct
WWIPDLY

SEQ ID NO: 23902 - protein, 7 aa, Artificial Sequence
  Synthetic construct
WWIPDAF

SEQ ID NO: 23903 - protein, 7 aa, Artificial Sequence
  Synthetic construct
WWIPDAY

SEQ ID NO: 23904 - protein, 7 aa, Artificial Sequence
  Synthetic construct
WWIPDQF

SEQ ID NO: 23905 - protein, 7 aa, Artificial Sequence
  Synthetic construct
WWIPDQY

SEQ ID NO: 23906 - protein, 7 aa, Artificial Sequence
  Synthetic construct
WWIPDDF

SEQ ID NO: 23907 - protein, 7 aa, Artificial Sequence
  Synthetic construct
WWIPDDY

SEQ ID NO: 23908 - protein, 7 aa, Artificial Sequence
  Synthetic construct
WWIPDVF

SEQ ID NO: 23909 - protein, 7 aa, Artificial Sequence
  Synthetic construct
WWIPDVY

SEQ ID NO: 23910 - protein, 7 aa, Artificial Sequence
  Synthetic construct
WWIPYFF

SEQ ID NO: 23911 - protein, 7 aa, Artificial Sequence
  Synthetic construct
WWIPYFY

SEQ ID NO: 23912 - protein, 7 aa, Artificial Sequence
  Synthetic construct
WWIPYRF

SEQ ID NO: 23913 - protein, 7 aa, Artificial Sequence
  Synthetic construct
WWIPYRY

SEQ ID NO: 23914 - protein, 7 aa, Artificial Sequence
  Synthetic construct
WWIPYCF

SEQ ID NO: 23915 - protein, 7 aa, Artificial Sequence
  Synthetic construct
WWIPYCY

SEQ ID NO: 23916 - protein, 7 aa, Artificial Sequence
  Synthetic construct
WWIPYLF

SEQ ID NO: 23917 - protein, 7 aa, Artificial Sequence
  Synthetic construct
WWIPYLY

SEQ ID NO: 23918 - protein, 7 aa, Artificial Sequence
  Synthetic construct
WWIPYAF

SEQ ID NO: 23919 - protein, 7 aa, Artificial Sequence
  Synthetic construct
WWIPYAY

SEQ ID NO: 23920 - protein, 7 aa, Artificial Sequence
  Synthetic construct
WWIPYQF

SEQ ID NO: 23921 - protein, 7 aa, Artificial Sequence
  Synthetic construct
WWIPYQY

SEQ ID NO: 23922 - protein, 7 aa, Artificial Sequence
  Synthetic construct
WWIPYDF

SEQ ID NO: 23923 - protein, 7 aa, Artificial Sequence
  Synthetic construct
WWIPYDY

SEQ ID NO: 23924 - protein, 7 aa, Artificial Sequence
  Synthetic construct
WWIPYVF

SEQ ID NO: 23925 - protein, 7 aa, Artificial Sequence
  Synthetic construct
WWIPYVY

SEQ ID NO: 23926 - protein, 7 aa, Artificial Sequence
  Synthetic construct
WWIPFFF

SEQ ID NO: 23927 - protein, 7 aa, Artificial Sequence
  Synthetic construct
WWIPFFY

SEQ ID NO: 23928 - protein, 7 aa, Artificial Sequence
  Synthetic construct
WWIPFRF

SEQ ID NO: 23929 - protein, 7 aa, Artificial Sequence
  Synthetic construct
WWIPFRY

SEQ ID NO: 23930 - protein, 7 aa, Artificial Sequence
  Synthetic construct
WWIPFCF

SEQ ID NO: 23931 - protein, 7 aa, Artificial Sequence
  Synthetic construct
WWIPFCY

SEQ ID NO: 23932 - protein, 7 aa, Artificial Sequence
  Synthetic construct
WWIPFLF

SEQ ID NO: 23933 - protein, 7 aa, Artificial Sequence
  Synthetic construct
WWIPFLY

SEQ ID NO: 23934 - protein, 7 aa, Artificial Sequence
  Synthetic construct
WWIPFAF

SEQ ID NO: 23935 - protein, 7 aa, Artificial Sequence
  Synthetic construct
WWIPFAY

SEQ ID NO: 23936 - protein, 7 aa, Artificial Sequence
  Synthetic construct
WWIPFQF

SEQ ID NO: 23937 - protein, 7 aa, Artificial Sequence
  Synthetic construct
WWIPFQY

SEQ ID NO: 23938 - protein, 7 aa, Artificial Sequence
  Synthetic construct
WWIPFDF

SEQ ID NO: 23939 - protein, 7 aa, Artificial Sequence
  Synthetic construct
WWIPFDY

SEQ ID NO: 23940 - protein, 7 aa, Artificial Sequence
  Synthetic construct
WWIPFVF

SEQ ID NO: 23941 - protein, 7 aa, Artificial Sequence
  Synthetic construct
WWIPFVY

SEQ ID NO: 23942 - protein, 7 aa, Artificial Sequence
  Synthetic construct
WWIPVFF

SEQ ID NO: 23943 - protein, 7 aa, Artificial Sequence
  Synthetic construct
WWIPVFY

SEQ ID NO: 23944 - protein, 7 aa, Artificial Sequence
  Synthetic construct
WWIPVRF

SEQ ID NO: 23945 - protein, 7 aa, Artificial Sequence
  Synthetic construct
WWIPVRY

SEQ ID NO: 23946 - protein, 7 aa, Artificial Sequence
  Synthetic construct
WWIPVCF

SEQ ID NO: 23947 - protein, 7 aa, Artificial Sequence
  Synthetic construct
WWIPVCY

SEQ ID NO: 23948 - protein, 7 aa, Artificial Sequence
  Synthetic construct
WWIPVLF

SEQ ID NO: 23949 - protein, 7 aa, Artificial Sequence
  Synthetic construct
WWIPVLY

SEQ ID NO: 23950 - protein, 7 aa, Artificial Sequence
  Synthetic construct
WWIPVAF

SEQ ID NO: 23951 - protein, 7 aa, Artificial Sequence
  Synthetic construct
WWIPVAY

SEQ ID NO: 23952 - protein, 7 aa, Artificial Sequence
  Synthetic construct
WWIPVQF

SEQ ID NO: 23953 - protein, 7 aa, Artificial Sequence
  Synthetic construct
WWIPVQY

SEQ ID NO: 23954 - protein, 7 aa, Artificial Sequence
  Synthetic construct
WWIPVDF

SEQ ID NO: 23955 - protein, 7 aa, Artificial Sequence
  Synthetic construct
WWIPVDY

SEQ ID NO: 23956 - protein, 7 aa, Artificial Sequence
  Synthetic construct
WWIPVVF

SEQ ID NO: 23957 - protein, 7 aa, Artificial Sequence
  Synthetic construct
WWIPVVY

SEQ ID NO: 23958 - protein, 7 aa, Artificial Sequence
  Synthetic construct
WWIPTFF

SEQ ID NO: 23959 - protein, 7 aa, Artificial Sequence
  Synthetic construct
WWIPTFY

SEQ ID NO: 23960 - protein, 7 aa, Artificial Sequence
  Synthetic construct
WWIPTRF

SEQ ID NO: 23961 - protein, 7 aa, Artificial Sequence
  Synthetic construct
WWIPTRY

SEQ ID NO: 23962 - protein, 7 aa, Artificial Sequence
  Synthetic construct
WWIPTCF

SEQ ID NO: 23963 - protein, 7 aa, Artificial Sequence
  Synthetic construct
WWIPTCY

SEQ ID NO: 23964 - protein, 7 aa, Artificial Sequence
  Synthetic construct
WWIPTLF

SEQ ID NO: 23965 - protein, 7 aa, Artificial Sequence
  Synthetic construct
WWIPTLY

SEQ ID NO: 23966 - protein, 7 aa, Artificial Sequence
  Synthetic construct
WWIPTAF

SEQ ID NO: 23967 - protein, 7 aa, Artificial Sequence
  Synthetic construct
WWIPTAY

SEQ ID NO: 23968 - protein, 7 aa, Artificial Sequence
  Synthetic construct
WWIPTQF

SEQ ID NO: 23969 - protein, 7 aa, Artificial Sequence
  Synthetic construct
WWIPTQY

SEQ ID NO: 23970 - protein, 7 aa, Artificial Sequence
  Synthetic construct
WWIPTDF

SEQ ID NO: 23971 - protein, 7 aa, Artificial Sequence
  Synthetic construct
WWIPTDY

SEQ ID NO: 23972 - protein, 7 aa, Artificial Sequence
  Synthetic construct
WWIPTVF

SEQ ID NO: 23973 - protein, 7 aa, Artificial Sequence
  Synthetic construct
WWIPTVY

SEQ ID NO: 23974 - protein, 7 aa, Artificial Sequence
  Synthetic construct
WWIPGFF

SEQ ID NO: 23975 - protein, 7 aa, Artificial Sequence
  Synthetic construct
WWIPGFY

SEQ ID NO: 23976 - protein, 7 aa, Artificial Sequence
  Synthetic construct
WWIPGRF

SEQ ID NO: 23977 - protein, 7 aa, Artificial Sequence
  Synthetic construct
WWIPGRY

SEQ ID NO: 23978 - protein, 7 aa, Artificial Sequence
  Synthetic construct
WWIPGCF

SEQ ID NO: 23979 - protein, 7 aa, Artificial Sequence
  Synthetic construct
WWIPGCY

SEQ ID NO: 23980 - protein, 7 aa, Artificial Sequence
  Synthetic construct
WWIPGLF

SEQ ID NO: 23981 - protein, 7 aa, Artificial Sequence
  Synthetic construct
WWIPGLY

SEQ ID NO: 23982 - protein, 7 aa, Artificial Sequence
  Synthetic construct
WWIPGAF

SEQ ID NO: 23983 - protein, 7 aa, Artificial Sequence
  Synthetic construct
WWIPGAY

SEQ ID NO: 23984 - protein, 7 aa, Artificial Sequence
  Synthetic construct
WWIPGQF

SEQ ID NO: 23985 - protein, 7 aa, Artificial Sequence
  Synthetic construct
WWIPGQY

SEQ ID NO: 23986 - protein, 7 aa, Artificial Sequence
  Synthetic construct
WWIPGDF

SEQ ID NO: 23987 - protein, 7 aa, Artificial Sequence
  Synthetic construct
WWIPGDY

SEQ ID NO: 23988 - protein, 7 aa, Artificial Sequence
  Synthetic construct
WWIPGVF

SEQ ID NO: 23989 - protein, 7 aa, Artificial Sequence
  Synthetic construct
WWIPGVY

SEQ ID NO: 23990 - protein, 7 aa, Artificial Sequence
  Synthetic construct
WWIPAFF

SEQ ID NO: 23991 - protein, 7 aa, Artificial Sequence
  Synthetic construct
WWIPAFY

SEQ ID NO: 23992 - protein, 7 aa, Artificial Sequence
  Synthetic construct
WWIPARF

SEQ ID NO: 23993 - protein, 7 aa, Artificial Sequence
  Synthetic construct
WWIPARY

SEQ ID NO: 23994 - protein, 7 aa, Artificial Sequence
  Synthetic construct
WWIPACF

SEQ ID NO: 23995 - protein, 7 aa, Artificial Sequence
  Synthetic construct
WWIPACY

SEQ ID NO: 23996 - protein, 7 aa, Artificial Sequence
  Synthetic construct
WWIPALF

SEQ ID NO: 23997 - protein, 7 aa, Artificial Sequence
  Synthetic construct
WWIPALY

SEQ ID NO: 23998 - protein, 7 aa, Artificial Sequence
  Synthetic construct
WWIPAAF

SEQ ID NO: 23999 - protein, 7 aa, Artificial Sequence
  Synthetic construct
WWIPAAY

SEQ ID NO: 24000 - protein, 7 aa, Artificial Sequence
  Synthetic construct
WWIPAQF

SEQ ID NO: 24001 - protein, 7 aa, Artificial Sequence
  Synthetic construct
WWIPAQY

SEQ ID NO: 24002 - protein, 7 aa, Artificial Sequence
  Synthetic construct
WWIPADF

SEQ ID NO: 24003 - protein, 7 aa, Artificial Sequence
  Synthetic construct
WWIPADY

SEQ ID NO: 24004 - protein, 7 aa, Artificial Sequence
  Synthetic construct
WWIPAVF

SEQ ID NO: 24005 - protein, 7 aa, Artificial Sequence
  Synthetic construct
WWIPAVY

SEQ ID NO: 24006 - protein, 7 aa, Artificial Sequence
  Synthetic construct
WWIPQFF

SEQ ID NO: 24007 - protein, 7 aa, Artificial Sequence
  Synthetic construct
WWIPQFY

SEQ ID NO: 24008 - protein, 7 aa, Artificial Sequence
  Synthetic construct
WWIPQRF

SEQ ID NO: 24009 - protein, 7 aa, Artificial Sequence
  Synthetic construct
WWIPQRY

SEQ ID NO: 24010 - protein, 7 aa, Artificial Sequence
  Synthetic construct
WWIPQCF

SEQ ID NO: 24011 - protein, 7 aa, Artificial Sequence
  Synthetic construct
WWIPQCY

SEQ ID NO: 24012 - protein, 7 aa, Artificial Sequence
  Synthetic construct
WWIPQLF

SEQ ID NO: 24013 - protein, 7 aa, Artificial Sequence
  Synthetic construct
WWIPQLY

SEQ ID NO: 24014 - protein, 7 aa, Artificial Sequence
  Synthetic construct
WWIPQAF

SEQ ID NO: 24015 - protein, 7 aa, Artificial Sequence
  Synthetic construct
WWIPQAY

SEQ ID NO: 24016 - protein, 7 aa, Artificial Sequence
  Synthetic construct
WWIPQQF

SEQ ID NO: 24017 - protein, 7 aa, Artificial Sequence
  Synthetic construct
WWIPQQY

SEQ ID NO: 24018 - protein, 7 aa, Artificial Sequence
  Synthetic construct
WWIPQDF

SEQ ID NO: 24019 - protein, 7 aa, Artificial Sequence
  Synthetic construct
WWIPQDY

SEQ ID NO: 24020 - protein, 7 aa, Artificial Sequence
  Synthetic construct
WWIPQVF

SEQ ID NO: 24021 - protein, 7 aa, Artificial Sequence
  Synthetic construct
WWIPQVY

SEQ ID NO: 24022 - protein, 7 aa, Artificial Sequence
  Synthetic construct
WWIHIFF

SEQ ID NO: 24023 - protein, 7 aa, Artificial Sequence
  Synthetic construct
WWIHIFY

SEQ ID NO: 24024 - protein, 7 aa, Artificial Sequence
  Synthetic construct
WWIHIRF

SEQ ID NO: 24025 - protein, 7 aa, Artificial Sequence
  Synthetic construct
WWIHIRY

SEQ ID NO: 24026 - protein, 7 aa, Artificial Sequence
  Synthetic construct
WWIHICF

SEQ ID NO: 24027 - protein, 7 aa, Artificial Sequence
  Synthetic construct
WWIHICY

SEQ ID NO: 24028 - protein, 7 aa, Artificial Sequence
  Synthetic construct
WWIHILF

SEQ ID NO: 24029 - protein, 7 aa, Artificial Sequence
  Synthetic construct
WWIHILY

SEQ ID NO: 24030 - protein, 7 aa, Artificial Sequence
  Synthetic construct
WWIHIAF

SEQ ID NO: 24031 - protein, 7 aa, Artificial Sequence
  Synthetic construct
WWIHIAY

SEQ ID NO: 24032 - protein, 7 aa, Artificial Sequence
  Synthetic construct
WWIHIQF

SEQ ID NO: 24033 - protein, 7 aa, Artificial Sequence
  Synthetic construct
WWIHIQY

SEQ ID NO: 24034 - protein, 7 aa, Artificial Sequence
  Synthetic construct
WWIHIDF

SEQ ID NO: 24035 - protein, 7 aa, Artificial Sequence
  Synthetic construct
WWIHIDY

SEQ ID NO: 24036 - protein, 7 aa, Artificial Sequence
  Synthetic construct
WWIHIVF

SEQ ID NO: 24037 - protein, 7 aa, Artificial Sequence
  Synthetic construct
WWIHIVY

SEQ ID NO: 24038 - protein, 7 aa, Artificial Sequence
  Synthetic construct
WWIHDFF

SEQ ID NO: 24039 - protein, 7 aa, Artificial Sequence
  Synthetic construct
WWIHDFY

SEQ ID NO: 24040 - protein, 7 aa, Artificial Sequence
  Synthetic construct
WWIHDRF

SEQ ID NO: 24041 - protein, 7 aa, Artificial Sequence
  Synthetic construct
WWIHDRY

SEQ ID NO: 24042 - protein, 7 aa, Artificial Sequence
  Synthetic construct
WWIHDCF

SEQ ID NO: 24043 - protein, 7 aa, Artificial Sequence
  Synthetic construct
WWIHDCY

SEQ ID NO: 24044 - protein, 7 aa, Artificial Sequence
  Synthetic construct
WWIHDLF

SEQ ID NO: 24045 - protein, 7 aa, Artificial Sequence
  Synthetic construct
WWIHDLY

SEQ ID NO: 24046 - protein, 7 aa, Artificial Sequence
  Synthetic construct
WWIHDAF

SEQ ID NO: 24047 - protein, 7 aa, Artificial Sequence
  Synthetic construct
WWIHDAY

SEQ ID NO: 24048 - protein, 7 aa, Artificial Sequence
  Synthetic construct
WWIHDQF

SEQ ID NO: 24049 - protein, 7 aa, Artificial Sequence
  Synthetic construct
WWIHDQY

SEQ ID NO: 24050 - protein, 7 aa, Artificial Sequence
  Synthetic construct
WWIHDDF

SEQ ID NO: 24051 - protein, 7 aa, Artificial Sequence
  Synthetic construct
WWIHDDY

SEQ ID NO: 24052 - protein, 7 aa, Artificial Sequence
  Synthetic construct
WWIHDVF

SEQ ID NO: 24053 - protein, 7 aa, Artificial Sequence
  Synthetic construct
WWIHDVY

SEQ ID NO: 24054 - protein, 7 aa, Artificial Sequence
  Synthetic construct
WWIHYFF

SEQ ID NO: 24055 - protein, 7 aa, Artificial Sequence
  Synthetic construct
WWIHYFY

SEQ ID NO: 24056 - protein, 7 aa, Artificial Sequence
  Synthetic construct
WWIHYRF

SEQ ID NO: 24057 - protein, 7 aa, Artificial Sequence
  Synthetic construct
WWIHYRY

SEQ ID NO: 24058 - protein, 7 aa, Artificial Sequence
  Synthetic construct
WWIHYCF

SEQ ID NO: 24059 - protein, 7 aa, Artificial Sequence
  Synthetic construct
WWIHYCY

SEQ ID NO: 24060 - protein, 7 aa, Artificial Sequence
  Synthetic construct
WWIHYLF

SEQ ID NO: 24061 - protein, 7 aa, Artificial Sequence
  Synthetic construct
WWIHYLY

SEQ ID NO: 24062 - protein, 7 aa, Artificial Sequence
  Synthetic construct
WWIHYAF

SEQ ID NO: 24063 - protein, 7 aa, Artificial Sequence
  Synthetic construct
WWIHYAY

SEQ ID NO: 24064 - protein, 7 aa, Artificial Sequence
  Synthetic construct
WWIHYQF

SEQ ID NO: 24065 - protein, 7 aa, Artificial Sequence
  Synthetic construct
WWIHYQY

SEQ ID NO: 24066 - protein, 7 aa, Artificial Sequence
  Synthetic construct
WWIHYDF

SEQ ID NO: 24067 - protein, 7 aa, Artificial Sequence
  Synthetic construct
WWIHYDY

SEQ ID NO: 24068 - protein, 7 aa, Artificial Sequence
  Synthetic construct
WWIHYVF

SEQ ID NO: 24069 - protein, 7 aa, Artificial Sequence
  Synthetic construct
WWIHYVY

SEQ ID NO: 24070 - protein, 7 aa, Artificial Sequence
  Synthetic construct
WWIHFFF

SEQ ID NO: 24071 - protein, 7 aa, Artificial Sequence
  Synthetic construct
WWIHFFY

SEQ ID NO: 24072 - protein, 7 aa, Artificial Sequence
  Synthetic construct
WWIHFRF

SEQ ID NO: 24073 - protein, 7 aa, Artificial Sequence
  Synthetic construct
WWIHFRY

SEQ ID NO: 24074 - protein, 7 aa, Artificial Sequence
  Synthetic construct
WWIHFCF

SEQ ID NO: 24075 - protein, 7 aa, Artificial Sequence
  Synthetic construct
WWIHFCY

SEQ ID NO: 24076 - protein, 7 aa, Artificial Sequence
  Synthetic construct
WWIHFLF

SEQ ID NO: 24077 - protein, 7 aa, Artificial Sequence
  Synthetic construct
WWIHFLY

SEQ ID NO: 24078 - protein, 7 aa, Artificial Sequence
  Synthetic construct
WWIHFAF

SEQ ID NO: 24079 - protein, 7 aa, Artificial Sequence
  Synthetic construct
WWIHFAY

SEQ ID NO: 24080 - protein, 7 aa, Artificial Sequence
  Synthetic construct
WWIHFQF

SEQ ID NO: 24081 - protein, 7 aa, Artificial Sequence
  Synthetic construct
WWIHFQY

SEQ ID NO: 24082 - protein, 7 aa, Artificial Sequence
  Synthetic construct
WWIHFDF

SEQ ID NO: 24083 - protein, 7 aa, Artificial Sequence
  Synthetic construct
WWIHFDY

SEQ ID NO: 24084 - protein, 7 aa, Artificial Sequence
  Synthetic construct
WWIHFVF

SEQ ID NO: 24085 - protein, 7 aa, Artificial Sequence
  Synthetic construct
WWIHFVY

SEQ ID NO: 24086 - protein, 7 aa, Artificial Sequence
  Synthetic construct
WWIHVFF

SEQ ID NO: 24087 - protein, 7 aa, Artificial Sequence
  Synthetic construct
WWIHVFY

SEQ ID NO: 24088 - protein, 7 aa, Artificial Sequence
  Synthetic construct
WWIHVRF

SEQ ID NO: 24089 - protein, 7 aa, Artificial Sequence
  Synthetic construct
WWIHVRY

SEQ ID NO: 24090 - protein, 7 aa, Artificial Sequence
  Synthetic construct
WWIHVCF

SEQ ID NO: 24091 - protein, 7 aa, Artificial Sequence
  Synthetic construct
WWIHVCY

SEQ ID NO: 24092 - protein, 7 aa, Artificial Sequence
  Synthetic construct
WWIHVLF

SEQ ID NO: 24093 - protein, 7 aa, Artificial Sequence
  Synthetic construct
WWIHVLY

SEQ ID NO: 24094 - protein, 7 aa, Artificial Sequence
  Synthetic construct
WWIHVAF

SEQ ID NO: 24095 - protein, 7 aa, Artificial Sequence
  Synthetic construct
WWIHVAY

SEQ ID NO: 24096 - protein, 7 aa, Artificial Sequence
  Synthetic construct
WWIHVQF

SEQ ID NO: 24097 - protein, 7 aa, Artificial Sequence
  Synthetic construct
WWIHVQY

SEQ ID NO: 24098 - protein, 7 aa, Artificial Sequence
  Synthetic construct
WWIHVDF

SEQ ID NO: 24099 - protein, 7 aa, Artificial Sequence
  Synthetic construct
WWIHVDY

SEQ ID NO: 24100 - protein, 7 aa, Artificial Sequence
  Synthetic construct
WWIHVVF

SEQ ID NO: 24101 - protein, 7 aa, Artificial Sequence
  Synthetic construct
WWIHVVY

SEQ ID NO: 24102 - protein, 7 aa, Artificial Sequence
  Synthetic construct
WWIHTFF

SEQ ID NO: 24103 - protein, 7 aa, Artificial Sequence
  Synthetic construct
WWIHTFY

SEQ ID NO: 24104 - protein, 7 aa, Artificial Sequence
  Synthetic construct
WWIHTRF

SEQ ID NO: 24105 - protein, 7 aa, Artificial Sequence
  Synthetic construct
WWIHTRY

SEQ ID NO: 24106 - protein, 7 aa, Artificial Sequence
  Synthetic construct
WWIHTCF

SEQ ID NO: 24107 - protein, 7 aa, Artificial Sequence
  Synthetic construct
WWIHTCY

SEQ ID NO: 24108 - protein, 7 aa, Artificial Sequence
  Synthetic construct
WWIHTLF

SEQ ID NO: 24109 - protein, 7 aa, Artificial Sequence
  Synthetic construct
WWIHTLY

SEQ ID NO: 24110 - protein, 7 aa, Artificial Sequence
  Synthetic construct
WWIHTAF

SEQ ID NO: 24111 - protein, 7 aa, Artificial Sequence
  Synthetic construct
WWIHTAY

SEQ ID NO: 24112 - protein, 7 aa, Artificial Sequence
  Synthetic construct
WWIHTQF

SEQ ID NO: 24113 - protein, 7 aa, Artificial Sequence
  Synthetic construct
WWIHTQY

SEQ ID NO: 24114 - protein, 7 aa, Artificial Sequence
  Synthetic construct
WWIHTDF

SEQ ID NO: 24115 - protein, 7 aa, Artificial Sequence
  Synthetic construct
WWIHTDY

SEQ ID NO: 24116 - protein, 7 aa, Artificial Sequence
  Synthetic construct
WWIHTVF

SEQ ID NO: 24117 - protein, 7 aa, Artificial Sequence
  Synthetic construct
WWIHTVY

SEQ ID NO: 24118 - protein, 7 aa, Artificial Sequence
  Synthetic construct
WWIHGFF

SEQ ID NO: 24119 - protein, 7 aa, Artificial Sequence
  Synthetic construct
WWIHGFY

SEQ ID NO: 24120 - protein, 7 aa, Artificial Sequence
  Synthetic construct
WWIHGRF

SEQ ID NO: 24121 - protein, 7 aa, Artificial Sequence
  Synthetic construct
WWIHGRY

SEQ ID NO: 24122 - protein, 7 aa, Artificial Sequence
  Synthetic construct
WWIHGCF

SEQ ID NO: 24123 - protein, 7 aa, Artificial Sequence
  Synthetic construct
WWIHGCY

SEQ ID NO: 24124 - protein, 7 aa, Artificial Sequence
  Synthetic construct
WWIHGLF

SEQ ID NO: 24125 - protein, 7 aa, Artificial Sequence
  Synthetic construct
WWIHGLY

SEQ ID NO: 24126 - protein, 7 aa, Artificial Sequence
  Synthetic construct
WWIHGAF

SEQ ID NO: 24127 - protein, 7 aa, Artificial Sequence
  Synthetic construct
WWIHGAY

SEQ ID NO: 24128 - protein, 7 aa, Artificial Sequence
  Synthetic construct
WWIHGQF

SEQ ID NO: 24129 - protein, 7 aa, Artificial Sequence
  Synthetic construct
WWIHGQY

SEQ ID NO: 24130 - protein, 7 aa, Artificial Sequence
  Synthetic construct
WWIHGDF

SEQ ID NO: 24131 - protein, 7 aa, Artificial Sequence
  Synthetic construct
WWIHGDY

SEQ ID NO: 24132 - protein, 7 aa, Artificial Sequence
  Synthetic construct
WWIHGVF

SEQ ID NO: 24133 - protein, 7 aa, Artificial Sequence
  Synthetic construct
WWIHGVY

SEQ ID NO: 24134 - protein, 7 aa, Artificial Sequence
  Synthetic construct
WWIHAFF

SEQ ID NO: 24135 - protein, 7 aa, Artificial Sequence
  Synthetic construct
WWIHAFY

SEQ ID NO: 24136 - protein, 7 aa, Artificial Sequence
  Synthetic construct
WWIHARF

SEQ ID NO: 24137 - protein, 7 aa, Artificial Sequence
  Synthetic construct
WWIHARY

SEQ ID NO: 24138 - protein, 7 aa, Artificial Sequence
  Synthetic construct
WWIHACF

SEQ ID NO: 24139 - protein, 7 aa, Artificial Sequence
  Synthetic construct
WWIHACY

SEQ ID NO: 24140 - protein, 7 aa, Artificial Sequence
  Synthetic construct
WWIHALF

SEQ ID NO: 24141 - protein, 7 aa, Artificial Sequence
  Synthetic construct
WWIHALY

SEQ ID NO: 24142 - protein, 7 aa, Artificial Sequence
  Synthetic construct
WWIHAAF

SEQ ID NO: 24143 - protein, 7 aa, Artificial Sequence
  Synthetic construct
WWIHAAY

SEQ ID NO: 24144 - protein, 7 aa, Artificial Sequence
  Synthetic construct
WWIHAQF

SEQ ID NO: 24145 - protein, 7 aa, Artificial Sequence
  Synthetic construct
WWIHAQY

SEQ ID NO: 24146 - protein, 7 aa, Artificial Sequence
  Synthetic construct
WWIHADF

SEQ ID NO: 24147 - protein, 7 aa, Artificial Sequence
  Synthetic construct
WWIHADY

SEQ ID NO: 24148 - protein, 7 aa, Artificial Sequence
  Synthetic construct
WWIHAVF

SEQ ID NO: 24149 - protein, 7 aa, Artificial Sequence
  Synthetic construct
WWIHAVY

SEQ ID NO: 24150 - protein, 7 aa, Artificial Sequence
  Synthetic construct
WWIHQFF

SEQ ID NO: 24151 - protein, 7 aa, Artificial Sequence
  Synthetic construct
WWIHQFY

SEQ ID NO: 24152 - protein, 7 aa, Artificial Sequence
  Synthetic construct
WWIHQRF

SEQ ID NO: 24153 - protein, 7 aa, Artificial Sequence
  Synthetic construct
WWIHQRY

SEQ ID NO: 24154 - protein, 7 aa, Artificial Sequence
  Synthetic construct
WWIHQCF

SEQ ID NO: 24155 - protein, 7 aa, Artificial Sequence
  Synthetic construct
WWIHQCY

SEQ ID NO: 24156 - protein, 7 aa, Artificial Sequence
  Synthetic construct
WWIHQLF

SEQ ID NO: 24157 - protein, 7 aa, Artificial Sequence
  Synthetic construct
WWIHQLY

SEQ ID NO: 24158 - protein, 7 aa, Artificial Sequence
  Synthetic construct
WWIHQAF

SEQ ID NO: 24159 - protein, 7 aa, Artificial Sequence
  Synthetic construct
WWIHQAY

SEQ ID NO: 24160 - protein, 7 aa, Artificial Sequence
  Synthetic construct
WWIHQQF

SEQ ID NO: 24161 - protein, 7 aa, Artificial Sequence
  Synthetic construct
WWIHQQY

SEQ ID NO: 24162 - protein, 7 aa, Artificial Sequence
  Synthetic construct
WWIHQDF

SEQ ID NO: 24163 - protein, 7 aa, Artificial Sequence
  Synthetic construct
WWIHQDY

SEQ ID NO: 24164 - protein, 7 aa, Artificial Sequence
  Synthetic construct
WWIHQVF

SEQ ID NO: 24165 - protein, 7 aa, Artificial Sequence
  Synthetic construct
WWIHQVY

SEQ ID NO: 24166 - protein, 7 aa, Artificial Sequence
  Synthetic construct
WWILIFF

SEQ ID NO: 24167 - protein, 7 aa, Artificial Sequence
  Synthetic construct
WWILIFY

SEQ ID NO: 24168 - protein, 7 aa, Artificial Sequence
  Synthetic construct
WWILIRF

SEQ ID NO: 24169 - protein, 7 aa, Artificial Sequence
  Synthetic construct
WWILIRY

SEQ ID NO: 24170 - protein, 7 aa, Artificial Sequence
  Synthetic construct
WWILICF

SEQ ID NO: 24171 - protein, 7 aa, Artificial Sequence
  Synthetic construct
WWILICY

SEQ ID NO: 24172 - protein, 7 aa, Artificial Sequence
  Synthetic construct
WWILILF

SEQ ID NO: 24173 - protein, 7 aa, Artificial Sequence
  Synthetic construct
WWILILY

SEQ ID NO: 24174 - protein, 7 aa, Artificial Sequence
  Synthetic construct
WWILIAF

SEQ ID NO: 24175 - protein, 7 aa, Artificial Sequence
  Synthetic construct
WWILIAY

SEQ ID NO: 24176 - protein, 7 aa, Artificial Sequence
  Synthetic construct
WWILIQF

SEQ ID NO: 24177 - protein, 7 aa, Artificial Sequence
  Synthetic construct
WWILIQY

SEQ ID NO: 24178 - protein, 7 aa, Artificial Sequence
  Synthetic construct
WWILIDF

SEQ ID NO: 24179 - protein, 7 aa, Artificial Sequence
  Synthetic construct
WWILIDY

SEQ ID NO: 24180 - protein, 7 aa, Artificial Sequence
  Synthetic construct
WWILIVF

SEQ ID NO: 24181 - protein, 7 aa, Artificial Sequence
  Synthetic construct
WWILIVY

SEQ ID NO: 24182 - protein, 7 aa, Artificial Sequence
  Synthetic construct
WWILDFF

SEQ ID NO: 24183 - protein, 7 aa, Artificial Sequence
  Synthetic construct
WWILDFY

SEQ ID NO: 24184 - protein, 7 aa, Artificial Sequence
  Synthetic construct
WWILDRF

SEQ ID NO: 24185 - protein, 7 aa, Artificial Sequence
  Synthetic construct
WWILDRY

SEQ ID NO: 24186 - protein, 7 aa, Artificial Sequence
  Synthetic construct
WWILDCF

SEQ ID NO: 24187 - protein, 7 aa, Artificial Sequence
  Synthetic construct
WWILDCY

SEQ ID NO: 24188 - protein, 7 aa, Artificial Sequence
  Synthetic construct
WWILDLF

SEQ ID NO: 24189 - protein, 7 aa, Artificial Sequence
  Synthetic construct
WWILDLY

SEQ ID NO: 24190 - protein, 7 aa, Artificial Sequence
  Synthetic construct
WWILDAF

SEQ ID NO: 24191 - protein, 7 aa, Artificial Sequence
  Synthetic construct
WWILDAY

SEQ ID NO: 24192 - protein, 7 aa, Artificial Sequence
  Synthetic construct
WWILDQF

SEQ ID NO: 24193 - protein, 7 aa, Artificial Sequence
  Synthetic construct
WWILDQY

SEQ ID NO: 24194 - protein, 7 aa, Artificial Sequence
  Synthetic construct
WWILDDF

SEQ ID NO: 24195 - protein, 7 aa, Artificial Sequence
  Synthetic construct
WWILDDY

SEQ ID NO: 24196 - protein, 7 aa, Artificial Sequence
  Synthetic construct
WWILDVF

SEQ ID NO: 24197 - protein, 7 aa, Artificial Sequence
  Synthetic construct
WWILDVY

SEQ ID NO: 24198 - protein, 7 aa, Artificial Sequence
  Synthetic construct
WWILYFF

SEQ ID NO: 24199 - protein, 7 aa, Artificial Sequence
  Synthetic construct
WWILYFY

SEQ ID NO: 24200 - protein, 7 aa, Artificial Sequence
  Synthetic construct
WWILYRF

SEQ ID NO: 24201 - protein, 7 aa, Artificial Sequence
  Synthetic construct
WWILYRY

SEQ ID NO: 24202 - protein, 7 aa, Artificial Sequence
  Synthetic construct
WWILYCF

SEQ ID NO: 24203 - protein, 7 aa, Artificial Sequence
  Synthetic construct
WWILYCY

SEQ ID NO: 24204 - protein, 7 aa, Artificial Sequence
  Synthetic construct
WWILYLF

SEQ ID NO: 24205 - protein, 7 aa, Artificial Sequence
  Synthetic construct
WWILYLY

SEQ ID NO: 24206 - protein, 7 aa, Artificial Sequence
  Synthetic construct
WWILYAF

SEQ ID NO: 24207 - protein, 7 aa, Artificial Sequence
  Synthetic construct
WWILYAY

SEQ ID NO: 24208 - protein, 7 aa, Artificial Sequence
  Synthetic construct
WWILYQF

SEQ ID NO: 24209 - protein, 7 aa, Artificial Sequence
  Synthetic construct
WWILYQY

SEQ ID NO: 24210 - protein, 7 aa, Artificial Sequence
  Synthetic construct
WWILYDF

SEQ ID NO: 24211 - protein, 7 aa, Artificial Sequence
  Synthetic construct
WWILYDY

SEQ ID NO: 24212 - protein, 7 aa, Artificial Sequence
  Synthetic construct
WWILYVF

SEQ ID NO: 24213 - protein, 7 aa, Artificial Sequence
  Synthetic construct
WWILYVY

SEQ ID NO: 24214 - protein, 7 aa, Artificial Sequence
  Synthetic construct
WWILFFF

SEQ ID NO: 24215 - protein, 7 aa, Artificial Sequence
  Synthetic construct
WWILFFY

SEQ ID NO: 24216 - protein, 7 aa, Artificial Sequence
  Synthetic construct
WWILFRF

SEQ ID NO: 24217 - protein, 7 aa, Artificial Sequence
  Synthetic construct
WWILFRY

SEQ ID NO: 24218 - protein, 7 aa, Artificial Sequence
  Synthetic construct
WWILFCF

SEQ ID NO: 24219 - protein, 7 aa, Artificial Sequence
  Synthetic construct
WWILFCY

SEQ ID NO: 24220 - protein, 7 aa, Artificial Sequence
  Synthetic construct
WWILFLF

SEQ ID NO: 24221 - protein, 7 aa, Artificial Sequence
  Synthetic construct
WWILFLY

SEQ ID NO: 24222 - protein, 7 aa, Artificial Sequence
  Synthetic construct
WWILFAF

SEQ ID NO: 24223 - protein, 7 aa, Artificial Sequence
  Synthetic construct
WWILFAY

SEQ ID NO: 24224 - protein, 7 aa, Artificial Sequence
  Synthetic construct
WWILFQF

SEQ ID NO: 24225 - protein, 7 aa, Artificial Sequence
  Synthetic construct
WWILFQY

SEQ ID NO: 24226 - protein, 7 aa, Artificial Sequence
  Synthetic construct
WWILFDF

SEQ ID NO: 24227 - protein, 7 aa, Artificial Sequence
  Synthetic construct
WWILFDY

SEQ ID NO: 24228 - protein, 7 aa, Artificial Sequence
  Synthetic construct
WWILFVF

SEQ ID NO: 24229 - protein, 7 aa, Artificial Sequence
  Synthetic construct
WWILFVY

SEQ ID NO: 24230 - protein, 7 aa, Artificial Sequence
  Synthetic construct
WWILVFF

SEQ ID NO: 24231 - protein, 7 aa, Artificial Sequence
  Synthetic construct
WWILVFY

SEQ ID NO: 24232 - protein, 7 aa, Artificial Sequence
  Synthetic construct
WWILVRF

SEQ ID NO: 24233 - protein, 7 aa, Artificial Sequence
  Synthetic construct
WWILVRY

SEQ ID NO: 24234 - protein, 7 aa, Artificial Sequence
  Synthetic construct
WWILVCF

SEQ ID NO: 24235 - protein, 7 aa, Artificial Sequence
  Synthetic construct
WWILVCY

SEQ ID NO: 24236 - protein, 7 aa, Artificial Sequence
  Synthetic construct
WWILVLF

SEQ ID NO: 24237 - protein, 7 aa, Artificial Sequence
  Synthetic construct
WWILVLY

SEQ ID NO: 24238 - protein, 7 aa, Artificial Sequence
  Synthetic construct
WWILVAF

SEQ ID NO: 24239 - protein, 7 aa, Artificial Sequence
  Synthetic construct
WWILVAY

SEQ ID NO: 24240 - protein, 7 aa, Artificial Sequence
  Synthetic construct
WWILVQF

SEQ ID NO: 24241 - protein, 7 aa, Artificial Sequence
  Synthetic construct
WWILVQY

SEQ ID NO: 24242 - protein, 7 aa, Artificial Sequence
  Synthetic construct
WWILVDF

SEQ ID NO: 24243 - protein, 7 aa, Artificial Sequence
  Synthetic construct
WWILVDY

SEQ ID NO: 24244 - protein, 7 aa, Artificial Sequence
  Synthetic construct
WWILVVF

SEQ ID NO: 24245 - protein, 7 aa, Artificial Sequence
  Synthetic construct
WWILVVY

SEQ ID NO: 24246 - protein, 7 aa, Artificial Sequence
  Synthetic construct
WWILTFF

SEQ ID NO: 24247 - protein, 7 aa, Artificial Sequence
  Synthetic construct
WWILTFY

SEQ ID NO: 24248 - protein, 7 aa, Artificial Sequence
  Synthetic construct
WWILTRF

SEQ ID NO: 24249 - protein, 7 aa, Artificial Sequence
  Synthetic construct
WWILTRY

SEQ ID NO: 24250 - protein, 7 aa, Artificial Sequence
  Synthetic construct
WWILTCF

SEQ ID NO: 24251 - protein, 7 aa, Artificial Sequence
  Synthetic construct
WWILTCY

SEQ ID NO: 24252 - protein, 7 aa, Artificial Sequence
  Synthetic construct
WWILTLF

SEQ ID NO: 24253 - protein, 7 aa, Artificial Sequence
  Synthetic construct
WWILTLY

SEQ ID NO: 24254 - protein, 7 aa, Artificial Sequence
  Synthetic construct
WWILTAF

SEQ ID NO: 24255 - protein, 7 aa, Artificial Sequence
  Synthetic construct
WWILTAY

SEQ ID NO: 24256 - protein, 7 aa, Artificial Sequence
  Synthetic construct
WWILTQF

SEQ ID NO: 24257 - protein, 7 aa, Artificial Sequence
  Synthetic construct
WWILTQY

SEQ ID NO: 24258 - protein, 7 aa, Artificial Sequence
  Synthetic construct
WWILTDF

SEQ ID NO: 24259 - protein, 7 aa, Artificial Sequence
  Synthetic construct
WWILTDY

SEQ ID NO: 24260 - protein, 7 aa, Artificial Sequence
  Synthetic construct
WWILTVF

SEQ ID NO: 24261 - protein, 7 aa, Artificial Sequence
  Synthetic construct
WWILTVY

SEQ ID NO: 24262 - protein, 7 aa, Artificial Sequence
  Synthetic construct
WWILGFF

SEQ ID NO: 24263 - protein, 7 aa, Artificial Sequence
  Synthetic construct
WWILGFY

SEQ ID NO: 24264 - protein, 7 aa, Artificial Sequence
  Synthetic construct
WWILGRF

SEQ ID NO: 24265 - protein, 7 aa, Artificial Sequence
  Synthetic construct
WWILGRY

SEQ ID NO: 24266 - protein, 7 aa, Artificial Sequence
  Synthetic construct
WWILGCF

SEQ ID NO: 24267 - protein, 7 aa, Artificial Sequence
  Synthetic construct
WWILGCY

SEQ ID NO: 24268 - protein, 7 aa, Artificial Sequence
  Synthetic construct
WWILGLF

SEQ ID NO: 24269 - protein, 7 aa, Artificial Sequence
  Synthetic construct
WWILGLY

SEQ ID NO: 24270 - protein, 7 aa, Artificial Sequence
  Synthetic construct
WWILGAF

SEQ ID NO: 24271 - protein, 7 aa, Artificial Sequence
  Synthetic construct
WWILGAY

SEQ ID NO: 24272 - protein, 7 aa, Artificial Sequence
  Synthetic construct
WWILGQF

SEQ ID NO: 24273 - protein, 7 aa, Artificial Sequence
  Synthetic construct
WWILGQY

SEQ ID NO: 24274 - protein, 7 aa, Artificial Sequence
  Synthetic construct
WWILGDF

SEQ ID NO: 24275 - protein, 7 aa, Artificial Sequence
  Synthetic construct
WWILGDY

SEQ ID NO: 24276 - protein, 7 aa, Artificial Sequence
  Synthetic construct
WWILGVF

SEQ ID NO: 24277 - protein, 7 aa, Artificial Sequence
  Synthetic construct
WWILGVY

SEQ ID NO: 24278 - protein, 7 aa, Artificial Sequence
  Synthetic construct
WWILAFF

SEQ ID NO: 24279 - protein, 7 aa, Artificial Sequence
  Synthetic construct
WWILAFY

SEQ ID NO: 24280 - protein, 7 aa, Artificial Sequence
  Synthetic construct
WWILARF

SEQ ID NO: 24281 - protein, 7 aa, Artificial Sequence
  Synthetic construct
WWILARY

SEQ ID NO: 24282 - protein, 7 aa, Artificial Sequence
  Synthetic construct
WWILACF

SEQ ID NO: 24283 - protein, 7 aa, Artificial Sequence
  Synthetic construct
WWILACY

SEQ ID NO: 24284 - protein, 7 aa, Artificial Sequence
  Synthetic construct
WWILALF

SEQ ID NO: 24285 - protein, 7 aa, Artificial Sequence
  Synthetic construct
WWILALY

SEQ ID NO: 24286 - protein, 7 aa, Artificial Sequence
  Synthetic construct
WWILAAF

SEQ ID NO: 24287 - protein, 7 aa, Artificial Sequence
  Synthetic construct
WWILAAY

SEQ ID NO: 24288 - protein, 7 aa, Artificial Sequence
  Synthetic construct
WWILAQF

SEQ ID NO: 24289 - protein, 7 aa, Artificial Sequence
  Synthetic construct
WWILAQY

SEQ ID NO: 24290 - protein, 7 aa, Artificial Sequence
  Synthetic construct
WWILADF

SEQ ID NO: 24291 - protein, 7 aa, Artificial Sequence
  Synthetic construct
WWILADY

SEQ ID NO: 24292 - protein, 7 aa, Artificial Sequence
  Synthetic construct
WWILAVF

SEQ ID NO: 24293 - protein, 7 aa, Artificial Sequence
  Synthetic construct
WWILAVY

SEQ ID NO: 24294 - protein, 7 aa, Artificial Sequence
  Synthetic construct
WWILQFF

SEQ ID NO: 24295 - protein, 7 aa, Artificial Sequence
  Synthetic construct
WWILQFY

SEQ ID NO: 24296 - protein, 7 aa, Artificial Sequence
  Synthetic construct
WWILQRF

SEQ ID NO: 24297 - protein, 7 aa, Artificial Sequence
  Synthetic construct
WWILQRY

SEQ ID NO: 24298 - protein, 7 aa, Artificial Sequence
  Synthetic construct
WWILQCF

SEQ ID NO: 24299 - protein, 7 aa, Artificial Sequence
  Synthetic construct
WWILQCY

SEQ ID NO: 24300 - protein, 7 aa, Artificial Sequence
  Synthetic construct
WWILQLF

SEQ ID NO: 24301 - protein, 7 aa, Artificial Sequence
  Synthetic construct
WWILQLY

SEQ ID NO: 24302 - protein, 7 aa, Artificial Sequence
  Synthetic construct
WWILQAF

SEQ ID NO: 24303 - protein, 7 aa, Artificial Sequence
  Synthetic construct
WWILQAY

SEQ ID NO: 24304 - protein, 7 aa, Artificial Sequence
  Synthetic construct
WWILQQF

SEQ ID NO: 24305 - protein, 7 aa, Artificial Sequence
  Synthetic construct
WWILQQY

SEQ ID NO: 24306 - protein, 7 aa, Artificial Sequence
  Synthetic construct
WWILQDF

SEQ ID NO: 24307 - protein, 7 aa, Artificial Sequence
  Synthetic construct
WWILQDY

SEQ ID NO: 24308 - protein, 7 aa, Artificial Sequence
  Synthetic construct
WWILQVF

SEQ ID NO: 24309 - protein, 7 aa, Artificial Sequence
  Synthetic construct
WWILQVY

SEQ ID NO: 24310 - protein, 7 aa, Artificial Sequence
  Synthetic construct
WWIFIFF

SEQ ID NO: 24311 - protein, 7 aa, Artificial Sequence
  Synthetic construct
WWIFIFY

SEQ ID NO: 24312 - protein, 7 aa, Artificial Sequence
  Synthetic construct
WWIFIRF

SEQ ID NO: 24313 - protein, 7 aa, Artificial Sequence
  Synthetic construct
WWIFIRY

SEQ ID NO: 24314 - protein, 7 aa, Artificial Sequence
  Synthetic construct
WWIFICF

SEQ ID NO: 24315 - protein, 7 aa, Artificial Sequence
  Synthetic construct
WWIFICY

SEQ ID NO: 24316 - protein, 7 aa, Artificial Sequence
  Synthetic construct
WWIFILF

SEQ ID NO: 24317 - protein, 7 aa, Artificial Sequence
  Synthetic construct
WWIFILY

SEQ ID NO: 24318 - protein, 7 aa, Artificial Sequence
  Synthetic construct
WWIFIAF

SEQ ID NO: 24319 - protein, 7 aa, Artificial Sequence
  Synthetic construct
WWIFIAY

SEQ ID NO: 24320 - protein, 7 aa, Artificial Sequence
  Synthetic construct
WWIFIQF

SEQ ID NO: 24321 - protein, 7 aa, Artificial Sequence
  Synthetic construct
WWIFIQY

SEQ ID NO: 24322 - protein, 7 aa, Artificial Sequence
  Synthetic construct
WWIFIDF

SEQ ID NO: 24323 - protein, 7 aa, Artificial Sequence
  Synthetic construct
WWIFIDY

SEQ ID NO: 24324 - protein, 7 aa, Artificial Sequence
  Synthetic construct
WWIFIVF

SEQ ID NO: 24325 - protein, 7 aa, Artificial Sequence
  Synthetic construct
WWIFIVY

SEQ ID NO: 24326 - protein, 7 aa, Artificial Sequence
  Synthetic construct
WWIFDFF

SEQ ID NO: 24327 - protein, 7 aa, Artificial Sequence
  Synthetic construct
WWIFDFY

SEQ ID NO: 24328 - protein, 7 aa, Artificial Sequence
  Synthetic construct
WWIFDRF

SEQ ID NO: 24329 - protein, 7 aa, Artificial Sequence
  Synthetic construct
WWIFDRY

SEQ ID NO: 24330 - protein, 7 aa, Artificial Sequence
  Synthetic construct
WWIFDCF

SEQ ID NO: 24331 - protein, 7 aa, Artificial Sequence
  Synthetic construct
WWIFDCY

SEQ ID NO: 24332 - protein, 7 aa, Artificial Sequence
  Synthetic construct
WWIFDLF

SEQ ID NO: 24333 - protein, 7 aa, Artificial Sequence
  Synthetic construct
WWIFDLY

SEQ ID NO: 24334 - protein, 7 aa, Artificial Sequence
  Synthetic construct
WWIFDAF

SEQ ID NO: 24335 - protein, 7 aa, Artificial Sequence
  Synthetic construct
WWIFDAY

SEQ ID NO: 24336 - protein, 7 aa, Artificial Sequence
  Synthetic construct
WWIFDQF

SEQ ID NO: 24337 - protein, 7 aa, Artificial Sequence
  Synthetic construct
WWIFDQY

SEQ ID NO: 24338 - protein, 7 aa, Artificial Sequence
  Synthetic construct
WWIFDDF

SEQ ID NO: 24339 - protein, 7 aa, Artificial Sequence
  Synthetic construct
WWIFDDY

SEQ ID NO: 24340 - protein, 7 aa, Artificial Sequence
  Synthetic construct
WWIFDVF

SEQ ID NO: 24341 - protein, 7 aa, Artificial Sequence
  Synthetic construct
WWIFDVY

SEQ ID NO: 24342 - protein, 7 aa, Artificial Sequence
  Synthetic construct
WWIFYFF

SEQ ID NO: 24343 - protein, 7 aa, Artificial Sequence
  Synthetic construct
WWIFYFY

SEQ ID NO: 24344 - protein, 7 aa, Artificial Sequence
  Synthetic construct
WWIFYRF

SEQ ID NO: 24345 - protein, 7 aa, Artificial Sequence
  Synthetic construct
WWIFYRY

SEQ ID NO: 24346 - protein, 7 aa, Artificial Sequence
  Synthetic construct
WWIFYCF

SEQ ID NO: 24347 - protein, 7 aa, Artificial Sequence
  Synthetic construct
WWIFYCY

SEQ ID NO: 24348 - protein, 7 aa, Artificial Sequence
  Synthetic construct
WWIFYLF

SEQ ID NO: 24349 - protein, 7 aa, Artificial Sequence
  Synthetic construct
WWIFYLY

SEQ ID NO: 24350 - protein, 7 aa, Artificial Sequence
  Synthetic construct
WWIFYAF

SEQ ID NO: 24351 - protein, 7 aa, Artificial Sequence
  Synthetic construct
WWIFYAY

SEQ ID NO: 24352 - protein, 7 aa, Artificial Sequence
  Synthetic construct
WWIFYQF

SEQ ID NO: 24353 - protein, 7 aa, Artificial Sequence
  Synthetic construct
WWIFYQY

SEQ ID NO: 24354 - protein, 7 aa, Artificial Sequence
  Synthetic construct
WWIFYDF

SEQ ID NO: 24355 - protein, 7 aa, Artificial Sequence
  Synthetic construct
WWIFYDY

SEQ ID NO: 24356 - protein, 7 aa, Artificial Sequence
  Synthetic construct
WWIFYVF

SEQ ID NO: 24357 - protein, 7 aa, Artificial Sequence
  Synthetic construct
WWIFYVY

SEQ ID NO: 24358 - protein, 7 aa, Artificial Sequence
  Synthetic construct
WWIFFFF

SEQ ID NO: 24359 - protein, 7 aa, Artificial Sequence
  Synthetic construct
WWIFFFY

SEQ ID NO: 24360 - protein, 7 aa, Artificial Sequence
  Synthetic construct
WWIFFRF

SEQ ID NO: 24361 - protein, 7 aa, Artificial Sequence
  Synthetic construct
WWIFFRY

SEQ ID NO: 24362 - protein, 7 aa, Artificial Sequence
  Synthetic construct
WWIFFCF

SEQ ID NO: 24363 - protein, 7 aa, Artificial Sequence
  Synthetic construct
WWIFFCY

SEQ ID NO: 24364 - protein, 7 aa, Artificial Sequence
  Synthetic construct
WWIFFLF

SEQ ID NO: 24365 - protein, 7 aa, Artificial Sequence
  Synthetic construct
WWIFFLY

SEQ ID NO: 24366 - protein, 7 aa, Artificial Sequence
  Synthetic construct
WWIFFAF

SEQ ID NO: 24367 - protein, 7 aa, Artificial Sequence
  Synthetic construct
WWIFFAY

SEQ ID NO: 24368 - protein, 7 aa, Artificial Sequence
  Synthetic construct
WWIFFQF

SEQ ID NO: 24369 - protein, 7 aa, Artificial Sequence
  Synthetic construct
WWIFFQY

SEQ ID NO: 24370 - protein, 7 aa, Artificial Sequence
  Synthetic construct
WWIFFDF

SEQ ID NO: 24371 - protein, 7 aa, Artificial Sequence
  Synthetic construct
WWIFFDY

SEQ ID NO: 24372 - protein, 7 aa, Artificial Sequence
  Synthetic construct
WWIFFVF

SEQ ID NO: 24373 - protein, 7 aa, Artificial Sequence
  Synthetic construct
WWIFFVY

SEQ ID NO: 24374 - protein, 7 aa, Artificial Sequence
  Synthetic construct
WWIFVFF

SEQ ID NO: 24375 - protein, 7 aa, Artificial Sequence
  Synthetic construct
WWIFVFY

SEQ ID NO: 24376 - protein, 7 aa, Artificial Sequence
  Synthetic construct
WWIFVRF

SEQ ID NO: 24377 - protein, 7 aa, Artificial Sequence
  Synthetic construct
WWIFVRY

SEQ ID NO: 24378 - protein, 7 aa, Artificial Sequence
  Synthetic construct
WWIFVCF

SEQ ID NO: 24379 - protein, 7 aa, Artificial Sequence
  Synthetic construct
WWIFVCY

SEQ ID NO: 24380 - protein, 7 aa, Artificial Sequence
  Synthetic construct
WWIFVLF

SEQ ID NO: 24381 - protein, 7 aa, Artificial Sequence
  Synthetic construct
WWIFVLY

SEQ ID NO: 24382 - protein, 7 aa, Artificial Sequence
  Synthetic construct
WWIFVAF

SEQ ID NO: 24383 - protein, 7 aa, Artificial Sequence
  Synthetic construct
WWIFVAY

SEQ ID NO: 24384 - protein, 7 aa, Artificial Sequence
  Synthetic construct
WWIFVQF

SEQ ID NO: 24385 - protein, 7 aa, Artificial Sequence
  Synthetic construct
WWIFVQY

SEQ ID NO: 24386 - protein, 7 aa, Artificial Sequence
  Synthetic construct
WWIFVDF

SEQ ID NO: 24387 - protein, 7 aa, Artificial Sequence
  Synthetic construct
WWIFVDY

SEQ ID NO: 24388 - protein, 7 aa, Artificial Sequence
  Synthetic construct
WWIFVVF

SEQ ID NO: 24389 - protein, 7 aa, Artificial Sequence
  Synthetic construct
WWIFVVY

SEQ ID NO: 24390 - protein, 7 aa, Artificial Sequence
  Synthetic construct
WWIFTFF

SEQ ID NO: 24391 - protein, 7 aa, Artificial Sequence
  Synthetic construct
WWIFTFY

SEQ ID NO: 24392 - protein, 7 aa, Artificial Sequence
  Synthetic construct
WWIFTRF

SEQ ID NO: 24393 - protein, 7 aa, Artificial Sequence
  Synthetic construct
WWIFTRY

SEQ ID NO: 24394 - protein, 7 aa, Artificial Sequence
  Synthetic construct
WWIFTCF

SEQ ID NO: 24395 - protein, 7 aa, Artificial Sequence
  Synthetic construct
WWIFTCY

SEQ ID NO: 24396 - protein, 7 aa, Artificial Sequence
  Synthetic construct
WWIFTLF

SEQ ID NO: 24397 - protein, 7 aa, Artificial Sequence
  Synthetic construct
WWIFTLY

SEQ ID NO: 24398 - protein, 7 aa, Artificial Sequence
  Synthetic construct
WWIFTAF

SEQ ID NO: 24399 - protein, 7 aa, Artificial Sequence
  Synthetic construct
WWIFTAY

SEQ ID NO: 24400 - protein, 7 aa, Artificial Sequence
  Synthetic construct
WWIFTQF

SEQ ID NO: 24401 - protein, 7 aa, Artificial Sequence
  Synthetic construct
WWIFTQY

SEQ ID NO: 24402 - protein, 7 aa, Artificial Sequence
  Synthetic construct
WWIFTDF

SEQ ID NO: 24403 - protein, 7 aa, Artificial Sequence
  Synthetic construct
WWIFTDY

SEQ ID NO: 24404 - protein, 7 aa, Artificial Sequence
  Synthetic construct
WWIFTVF

SEQ ID NO: 24405 - protein, 7 aa, Artificial Sequence
  Synthetic construct
WWIFTVY

SEQ ID NO: 24406 - protein, 7 aa, Artificial Sequence
  Synthetic construct
WWIFGFF

SEQ ID NO: 24407 - protein, 7 aa, Artificial Sequence
  Synthetic construct
WWIFGFY

SEQ ID NO: 24408 - protein, 7 aa, Artificial Sequence
  Synthetic construct
WWIFGRF

SEQ ID NO: 24409 - protein, 7 aa, Artificial Sequence
  Synthetic construct
WWIFGRY

SEQ ID NO: 24410 - protein, 7 aa, Artificial Sequence
  Synthetic construct
WWIFGCF

SEQ ID NO: 24411 - protein, 7 aa, Artificial Sequence
  Synthetic construct
WWIFGCY

SEQ ID NO: 24412 - protein, 7 aa, Artificial Sequence
  Synthetic construct
WWIFGLF

SEQ ID NO: 24413 - protein, 7 aa, Artificial Sequence
  Synthetic construct
WWIFGLY

SEQ ID NO: 24414 - protein, 7 aa, Artificial Sequence
  Synthetic construct
WWIFGAF

SEQ ID NO: 24415 - protein, 7 aa, Artificial Sequence
  Synthetic construct
WWIFGAY

SEQ ID NO: 24416 - protein, 7 aa, Artificial Sequence
  Synthetic construct
WWIFGQF

SEQ ID NO: 24417 - protein, 7 aa, Artificial Sequence
  Synthetic construct
WWIFGQY

SEQ ID NO: 24418 - protein, 7 aa, Artificial Sequence
  Synthetic construct
WWIFGDF

SEQ ID NO: 24419 - protein, 7 aa, Artificial Sequence
  Synthetic construct
WWIFGDY

SEQ ID NO: 24420 - protein, 7 aa, Artificial Sequence
  Synthetic construct
WWIFGVF

SEQ ID NO: 24421 - protein, 7 aa, Artificial Sequence
  Synthetic construct
WWIFGVY

SEQ ID NO: 24422 - protein, 7 aa, Artificial Sequence
  Synthetic construct
WWIFAFF

SEQ ID NO: 24423 - protein, 7 aa, Artificial Sequence
  Synthetic construct
WWIFAFY

SEQ ID NO: 24424 - protein, 7 aa, Artificial Sequence
  Synthetic construct
WWIFARF

SEQ ID NO: 24425 - protein, 7 aa, Artificial Sequence
  Synthetic construct
WWIFARY

SEQ ID NO: 24426 - protein, 7 aa, Artificial Sequence
  Synthetic construct
WWIFACF

SEQ ID NO: 24427 - protein, 7 aa, Artificial Sequence
  Synthetic construct
WWIFACY

SEQ ID NO: 24428 - protein, 7 aa, Artificial Sequence
  Synthetic construct
WWIFALF

SEQ ID NO: 24429 - protein, 7 aa, Artificial Sequence
  Synthetic construct
WWIFALY

SEQ ID NO: 24430 - protein, 7 aa, Artificial Sequence
  Synthetic construct
WWIFAAF

SEQ ID NO: 24431 - protein, 7 aa, Artificial Sequence
  Synthetic construct
WWIFAAY

SEQ ID NO: 24432 - protein, 7 aa, Artificial Sequence
  Synthetic construct
WWIFAQF

SEQ ID NO: 24433 - protein, 7 aa, Artificial Sequence
  Synthetic construct
WWIFAQY

SEQ ID NO: 24434 - protein, 7 aa, Artificial Sequence
  Synthetic construct
WWIFADF

SEQ ID NO: 24435 - protein, 7 aa, Artificial Sequence
  Synthetic construct
WWIFADY

SEQ ID NO: 24436 - protein, 7 aa, Artificial Sequence
  Synthetic construct
WWIFAVF

SEQ ID NO: 24437 - protein, 7 aa, Artificial Sequence
  Synthetic construct
WWIFAVY

SEQ ID NO: 24438 - protein, 7 aa, Artificial Sequence
  Synthetic construct
WWIFQFF

SEQ ID NO: 24439 - protein, 7 aa, Artificial Sequence
  Synthetic construct
WWIFQFY

SEQ ID NO: 24440 - protein, 7 aa, Artificial Sequence
  Synthetic construct
WWIFQRF

SEQ ID NO: 24441 - protein, 7 aa, Artificial Sequence
  Synthetic construct
WWIFQRY

SEQ ID NO: 24442 - protein, 7 aa, Artificial Sequence
  Synthetic construct
WWIFQCF

SEQ ID NO: 24443 - protein, 7 aa, Artificial Sequence
  Synthetic construct
WWIFQCY

SEQ ID NO: 24444 - protein, 7 aa, Artificial Sequence
  Synthetic construct
WWIFQLF

SEQ ID NO: 24445 - protein, 7 aa, Artificial Sequence
  Synthetic construct
WWIFQLY

SEQ ID NO: 24446 - protein, 7 aa, Artificial Sequence
  Synthetic construct
WWIFQAF

SEQ ID NO: 24447 - protein, 7 aa, Artificial Sequence
  Synthetic construct
WWIFQAY

SEQ ID NO: 24448 - protein, 7 aa, Artificial Sequence
  Synthetic construct
WWIFQQF

SEQ ID NO: 24449 - protein, 7 aa, Artificial Sequence
  Synthetic construct
WWIFQQY

SEQ ID NO: 24450 - protein, 7 aa, Artificial Sequence
  Synthetic construct
WWIFQDF

SEQ ID NO: 24451 - protein, 7 aa, Artificial Sequence
  Synthetic construct
WWIFQDY

SEQ ID NO: 24452 - protein, 7 aa, Artificial Sequence
  Synthetic construct
WWIFQVF

SEQ ID NO: 24453 - protein, 7 aa, Artificial Sequence
  Synthetic construct
WWIFQVY

SEQ ID NO: 24454 - protein, 7 aa, Artificial Sequence
  Synthetic construct
WWGYIFF

SEQ ID NO: 24455 - protein, 7 aa, Artificial Sequence
  Synthetic construct
WWGYIFY

SEQ ID NO: 24456 - protein, 7 aa, Artificial Sequence
  Synthetic construct
WWGYIRF

SEQ ID NO: 24457 - protein, 7 aa, Artificial Sequence
  Synthetic construct
WWGYIRY

SEQ ID NO: 24458 - protein, 7 aa, Artificial Sequence
  Synthetic construct
WWGYICF

SEQ ID NO: 24459 - protein, 7 aa, Artificial Sequence
  Synthetic construct
WWGYICY

SEQ ID NO: 24460 - protein, 7 aa, Artificial Sequence
  Synthetic construct
WWGYILF

SEQ ID NO: 24461 - protein, 7 aa, Artificial Sequence
  Synthetic construct
WWGYILY

SEQ ID NO: 24462 - protein, 7 aa, Artificial Sequence
  Synthetic construct
WWGYIAF

SEQ ID NO: 24463 - protein, 7 aa, Artificial Sequence
  Synthetic construct
WWGYIAY

SEQ ID NO: 24464 - protein, 7 aa, Artificial Sequence
  Synthetic construct
WWGYIQF

SEQ ID NO: 24465 - protein, 7 aa, Artificial Sequence
  Synthetic construct
WWGYIQY

SEQ ID NO: 24466 - protein, 7 aa, Artificial Sequence
  Synthetic construct
WWGYIDF

SEQ ID NO: 24467 - protein, 7 aa, Artificial Sequence
  Synthetic construct
WWGYIDY

SEQ ID NO: 24468 - protein, 7 aa, Artificial Sequence
  Synthetic construct
WWGYIVF

SEQ ID NO: 24469 - protein, 7 aa, Artificial Sequence
  Synthetic construct
WWGYIVY

SEQ ID NO: 24470 - protein, 7 aa, Artificial Sequence
  Synthetic construct
WWGYDFF

SEQ ID NO: 24471 - protein, 7 aa, Artificial Sequence
  Synthetic construct
WWGYDFY

SEQ ID NO: 24472 - protein, 7 aa, Artificial Sequence
  Synthetic construct
WWGYDRF

SEQ ID NO: 24473 - protein, 7 aa, Artificial Sequence
  Synthetic construct
WWGYDRY

SEQ ID NO: 24474 - protein, 7 aa, Artificial Sequence
  Synthetic construct
WWGYDCF

SEQ ID NO: 24475 - protein, 7 aa, Artificial Sequence
  Synthetic construct
WWGYDCY

SEQ ID NO: 24476 - protein, 7 aa, Artificial Sequence
  Synthetic construct
WWGYDLF

SEQ ID NO: 24477 - protein, 7 aa, Artificial Sequence
  Synthetic construct
WWGYDLY

SEQ ID NO: 24478 - protein, 7 aa, Artificial Sequence
  Synthetic construct
WWGYDAF

SEQ ID NO: 24479 - protein, 7 aa, Artificial Sequence
  Synthetic construct
WWGYDAY

SEQ ID NO: 24480 - protein, 7 aa, Artificial Sequence
  Synthetic construct
WWGYDQF

SEQ ID NO: 24481 - protein, 7 aa, Artificial Sequence
  Synthetic construct
WWGYDQY

SEQ ID NO: 24482 - protein, 7 aa, Artificial Sequence
  Synthetic construct
WWGYDDF

SEQ ID NO: 24483 - protein, 7 aa, Artificial Sequence
  Synthetic construct
WWGYDDY

SEQ ID NO: 24484 - protein, 7 aa, Artificial Sequence
  Synthetic construct
WWGYDVF

SEQ ID NO: 24485 - protein, 7 aa, Artificial Sequence
  Synthetic construct
WWGYDVY

SEQ ID NO: 24486 - protein, 7 aa, Artificial Sequence
  Synthetic construct
WWGYYFF

SEQ ID NO: 24487 - protein, 7 aa, Artificial Sequence
  Synthetic construct
WWGYYFY

SEQ ID NO: 24488 - protein, 7 aa, Artificial Sequence
  Synthetic construct
WWGYYRF

SEQ ID NO: 24489 - protein, 7 aa, Artificial Sequence
  Synthetic construct
WWGYYRY

SEQ ID NO: 24490 - protein, 7 aa, Artificial Sequence
  Synthetic construct
WWGYYCF

SEQ ID NO: 24491 - protein, 7 aa, Artificial Sequence
  Synthetic construct
WWGYYCY

SEQ ID NO: 24492 - protein, 7 aa, Artificial Sequence
  Synthetic construct
WWGYYLF

SEQ ID NO: 24493 - protein, 7 aa, Artificial Sequence
  Synthetic construct
WWGYYLY

SEQ ID NO: 24494 - protein, 7 aa, Artificial Sequence
  Synthetic construct
WWGYYAF

SEQ ID NO: 24495 - protein, 7 aa, Artificial Sequence
  Synthetic construct
WWGYYAY

SEQ ID NO: 24496 - protein, 7 aa, Artificial Sequence
  Synthetic construct
WWGYYQF

SEQ ID NO: 24497 - protein, 7 aa, Artificial Sequence
  Synthetic construct
WWGYYQY

SEQ ID NO: 24498 - protein, 7 aa, Artificial Sequence
  Synthetic construct
WWGYYDF

SEQ ID NO: 24499 - protein, 7 aa, Artificial Sequence
  Synthetic construct
WWGYYDY

SEQ ID NO: 24500 - protein, 7 aa, Artificial Sequence
  Synthetic construct
WWGYYVF

SEQ ID NO: 24501 - protein, 7 aa, Artificial Sequence
  Synthetic construct
WWGYYVY

SEQ ID NO: 24502 - protein, 7 aa, Artificial Sequence
  Synthetic construct
WWGYFFF

SEQ ID NO: 24503 - protein, 7 aa, Artificial Sequence
  Synthetic construct
WWGYFFY

SEQ ID NO: 24504 - protein, 7 aa, Artificial Sequence
  Synthetic construct
WWGYFRF

SEQ ID NO: 24505 - protein, 7 aa, Artificial Sequence
  Synthetic construct
WWGYFRY

SEQ ID NO: 24506 - protein, 7 aa, Artificial Sequence
  Synthetic construct
WWGYFCF

SEQ ID NO: 24507 - protein, 7 aa, Artificial Sequence
  Synthetic construct
WWGYFCY

SEQ ID NO: 24508 - protein, 7 aa, Artificial Sequence
  Synthetic construct
WWGYFLF

SEQ ID NO: 24509 - protein, 7 aa, Artificial Sequence
  Synthetic construct
WWGYFLY

SEQ ID NO: 24510 - protein, 7 aa, Artificial Sequence
  Synthetic construct
WWGYFAF

SEQ ID NO: 24511 - protein, 7 aa, Artificial Sequence
  Synthetic construct
WWGYFAY

SEQ ID NO: 24512 - protein, 7 aa, Artificial Sequence
  Synthetic construct
WWGYFQF

SEQ ID NO: 24513 - protein, 7 aa, Artificial Sequence
  Synthetic construct
WWGYFQY

SEQ ID NO: 24514 - protein, 7 aa, Artificial Sequence
  Synthetic construct
WWGYFDF

SEQ ID NO: 24515 - protein, 7 aa, Artificial Sequence
  Synthetic construct
WWGYFDY

SEQ ID NO: 24516 - protein, 7 aa, Artificial Sequence
  Synthetic construct
WWGYFVF

SEQ ID NO: 24517 - protein, 7 aa, Artificial Sequence
  Synthetic construct
WWGYFVY

SEQ ID NO: 24518 - protein, 7 aa, Artificial Sequence
  Synthetic construct
WWGYVFF

SEQ ID NO: 24519 - protein, 7 aa, Artificial Sequence
  Synthetic construct
WWGYVFY

SEQ ID NO: 24520 - protein, 7 aa, Artificial Sequence
  Synthetic construct
WWGYVRF

SEQ ID NO: 24521 - protein, 7 aa, Artificial Sequence
  Synthetic construct
WWGYVRY

SEQ ID NO: 24522 - protein, 7 aa, Artificial Sequence
  Synthetic construct
WWGYVCF

SEQ ID NO: 24523 - protein, 7 aa, Artificial Sequence
  Synthetic construct
WWGYVCY

SEQ ID NO: 24524 - protein, 7 aa, Artificial Sequence
  Synthetic construct
WWGYVLF

SEQ ID NO: 24525 - protein, 7 aa, Artificial Sequence
  Synthetic construct
WWGYVLY

SEQ ID NO: 24526 - protein, 7 aa, Artificial Sequence
  Synthetic construct
WWGYVAF

SEQ ID NO: 24527 - protein, 7 aa, Artificial Sequence
  Synthetic construct
WWGYVAY

SEQ ID NO: 24528 - protein, 7 aa, Artificial Sequence
  Synthetic construct
WWGYVQF

SEQ ID NO: 24529 - protein, 7 aa, Artificial Sequence
  Synthetic construct
WWGYVQY

SEQ ID NO: 24530 - protein, 7 aa, Artificial Sequence
  Synthetic construct
WWGYVDF

SEQ ID NO: 24531 - protein, 7 aa, Artificial Sequence
  Synthetic construct
WWGYVDY

SEQ ID NO: 24532 - protein, 7 aa, Artificial Sequence
  Synthetic construct
WWGYVVF

SEQ ID NO: 24533 - protein, 7 aa, Artificial Sequence
  Synthetic construct
WWGYVVY

SEQ ID NO: 24534 - protein, 7 aa, Artificial Sequence
  Synthetic construct
WWGYTFF

SEQ ID NO: 24535 - protein, 7 aa, Artificial Sequence
  Synthetic construct
WWGYTFY

SEQ ID NO: 24536 - protein, 7 aa, Artificial Sequence
  Synthetic construct
WWGYTRF

SEQ ID NO: 24537 - protein, 7 aa, Artificial Sequence
  Synthetic construct
WWGYTRY

SEQ ID NO: 24538 - protein, 7 aa, Artificial Sequence
  Synthetic construct
WWGYTCF

SEQ ID NO: 24539 - protein, 7 aa, Artificial Sequence
  Synthetic construct
WWGYTCY

SEQ ID NO: 24540 - protein, 7 aa, Artificial Sequence
  Synthetic construct
WWGYTLF

SEQ ID NO: 24541 - protein, 7 aa, Artificial Sequence
  Synthetic construct
WWGYTLY

SEQ ID NO: 24542 - protein, 7 aa, Artificial Sequence
  Synthetic construct
WWGYTAF

SEQ ID NO: 24543 - protein, 7 aa, Artificial Sequence
  Synthetic construct
WWGYTAY

SEQ ID NO: 24544 - protein, 7 aa, Artificial Sequence
  Synthetic construct
WWGYTQF

SEQ ID NO: 24545 - protein, 7 aa, Artificial Sequence
  Synthetic construct
WWGYTQY

SEQ ID NO: 24546 - protein, 7 aa, Artificial Sequence
  Synthetic construct
WWGYTDF

SEQ ID NO: 24547 - protein, 7 aa, Artificial Sequence
  Synthetic construct
WWGYTDY

SEQ ID NO: 24548 - protein, 7 aa, Artificial Sequence
  Synthetic construct
WWGYTVF

SEQ ID NO: 24549 - protein, 7 aa, Artificial Sequence
  Synthetic construct
WWGYTVY

SEQ ID NO: 24550 - protein, 7 aa, Artificial Sequence
  Synthetic construct
WWGYGFF

SEQ ID NO: 24551 - protein, 7 aa, Artificial Sequence
  Synthetic construct
WWGYGFY

SEQ ID NO: 24552 - protein, 7 aa, Artificial Sequence
  Synthetic construct
WWGYGRF

SEQ ID NO: 24553 - protein, 7 aa, Artificial Sequence
  Synthetic construct
WWGYGRY

SEQ ID NO: 24554 - protein, 7 aa, Artificial Sequence
  Synthetic construct
WWGYGCF

SEQ ID NO: 24555 - protein, 7 aa, Artificial Sequence
  Synthetic construct
WWGYGCY

SEQ ID NO: 24556 - protein, 7 aa, Artificial Sequence
  Synthetic construct
WWGYGLF

SEQ ID NO: 24557 - protein, 7 aa, Artificial Sequence
  Synthetic construct
WWGYGLY

SEQ ID NO: 24558 - protein, 7 aa, Artificial Sequence
  Synthetic construct
WWGYGAF

SEQ ID NO: 24559 - protein, 7 aa, Artificial Sequence
  Synthetic construct
WWGYGAY

SEQ ID NO: 24560 - protein, 7 aa, Artificial Sequence
  Synthetic construct
WWGYGQF

SEQ ID NO: 24561 - protein, 7 aa, Artificial Sequence
  Synthetic construct
WWGYGQY

SEQ ID NO: 24562 - protein, 7 aa, Artificial Sequence
  Synthetic construct
WWGYGDF

SEQ ID NO: 24563 - protein, 7 aa, Artificial Sequence
  Synthetic construct
WWGYGDY

SEQ ID NO: 24564 - protein, 7 aa, Artificial Sequence
  Synthetic construct
WWGYGVF

SEQ ID NO: 24565 - protein, 7 aa, Artificial Sequence
  Synthetic construct
WWGYGVY

SEQ ID NO: 24566 - protein, 7 aa, Artificial Sequence
  Synthetic construct
WWGYAFF

SEQ ID NO: 24567 - protein, 7 aa, Artificial Sequence
  Synthetic construct
WWGYAFY

SEQ ID NO: 24568 - protein, 7 aa, Artificial Sequence
  Synthetic construct
WWGYARF

SEQ ID NO: 24569 - protein, 7 aa, Artificial Sequence
  Synthetic construct
WWGYARY

SEQ ID NO: 24570 - protein, 7 aa, Artificial Sequence
  Synthetic construct
WWGYACF

SEQ ID NO: 24571 - protein, 7 aa, Artificial Sequence
  Synthetic construct
WWGYACY

SEQ ID NO: 24572 - protein, 7 aa, Artificial Sequence
  Synthetic construct
WWGYALF

SEQ ID NO: 24573 - protein, 7 aa, Artificial Sequence
  Synthetic construct
WWGYALY

SEQ ID NO: 24574 - protein, 7 aa, Artificial Sequence
  Synthetic construct
WWGYAAF

SEQ ID NO: 24575 - protein, 7 aa, Artificial Sequence
  Synthetic construct
WWGYAAY

SEQ ID NO: 24576 - protein, 7 aa, Artificial Sequence
  Synthetic construct
WWGYAQF

SEQ ID NO: 24577 - protein, 7 aa, Artificial Sequence
  Synthetic construct
WWGYAQY

SEQ ID NO: 24578 - protein, 7 aa, Artificial Sequence
  Synthetic construct
WWGYADF

SEQ ID NO: 24579 - protein, 7 aa, Artificial Sequence
  Synthetic construct
WWGYADY

SEQ ID NO: 24580 - protein, 7 aa, Artificial Sequence
  Synthetic construct
WWGYAVF

SEQ ID NO: 24581 - protein, 7 aa, Artificial Sequence
  Synthetic construct
WWGYAVY

SEQ ID NO: 24582 - protein, 7 aa, Artificial Sequence
  Synthetic construct
WWGYQFF

SEQ ID NO: 24583 - protein, 7 aa, Artificial Sequence
  Synthetic construct
WWGYQFY

SEQ ID NO: 24584 - protein, 7 aa, Artificial Sequence
  Synthetic construct
WWGYQRF

SEQ ID NO: 24585 - protein, 7 aa, Artificial Sequence
  Synthetic construct
WWGYQRY

SEQ ID NO: 24586 - protein, 7 aa, Artificial Sequence
  Synthetic construct
WWGYQCF

SEQ ID NO: 24587 - protein, 7 aa, Artificial Sequence
  Synthetic construct
WWGYQCY

SEQ ID NO: 24588 - protein, 7 aa, Artificial Sequence
  Synthetic construct
WWGYQLF

SEQ ID NO: 24589 - protein, 7 aa, Artificial Sequence
  Synthetic construct
WWGYQLY

SEQ ID NO: 24590 - protein, 7 aa, Artificial Sequence
  Synthetic construct
WWGYQAF

SEQ ID NO: 24591 - protein, 7 aa, Artificial Sequence
  Synthetic construct
WWGYQAY

SEQ ID NO: 24592 - protein, 7 aa, Artificial Sequence
  Synthetic construct
WWGYQQF

SEQ ID NO: 24593 - protein, 7 aa, Artificial Sequence
  Synthetic construct
WWGYQQY

SEQ ID NO: 24594 - protein, 7 aa, Artificial Sequence
  Synthetic construct
WWGYQDF

SEQ ID NO: 24595 - protein, 7 aa, Artificial Sequence
  Synthetic construct
WWGYQDY

SEQ ID NO: 24596 - protein, 7 aa, Artificial Sequence
  Synthetic construct
WWGYQVF

SEQ ID NO: 24597 - protein, 7 aa, Artificial Sequence
  Synthetic construct
WWGYQVY

SEQ ID NO: 24598 - protein, 7 aa, Artificial Sequence
  Synthetic construct
WWGPIFF

SEQ ID NO: 24599 - protein, 7 aa, Artificial Sequence
  Synthetic construct
WWGPIFY

SEQ ID NO: 24600 - protein, 7 aa, Artificial Sequence
  Synthetic construct
WWGPIRF

SEQ ID NO: 24601 - protein, 7 aa, Artificial Sequence
  Synthetic construct
WWGPIRY

SEQ ID NO: 24602 - protein, 7 aa, Artificial Sequence
  Synthetic construct
WWGPICF

SEQ ID NO: 24603 - protein, 7 aa, Artificial Sequence
  Synthetic construct
WWGPICY

SEQ ID NO: 24604 - protein, 7 aa, Artificial Sequence
  Synthetic construct
WWGPILF

SEQ ID NO: 24605 - protein, 7 aa, Artificial Sequence
  Synthetic construct
WWGPILY

SEQ ID NO: 24606 - protein, 7 aa, Artificial Sequence
  Synthetic construct
WWGPIAF

SEQ ID NO: 24607 - protein, 7 aa, Artificial Sequence
  Synthetic construct
WWGPIAY

SEQ ID NO: 24608 - protein, 7 aa, Artificial Sequence
  Synthetic construct
WWGPIQF

SEQ ID NO: 24609 - protein, 7 aa, Artificial Sequence
  Synthetic construct
WWGPIQY

SEQ ID NO: 24610 - protein, 7 aa, Artificial Sequence
  Synthetic construct
WWGPIDF

SEQ ID NO: 24611 - protein, 7 aa, Artificial Sequence
  Synthetic construct
WWGPIDY

SEQ ID NO: 24612 - protein, 7 aa, Artificial Sequence
  Synthetic construct
WWGPIVF

SEQ ID NO: 24613 - protein, 7 aa, Artificial Sequence
  Synthetic construct
WWGPIVY

SEQ ID NO: 24614 - protein, 7 aa, Artificial Sequence
  Synthetic construct
WWGPDFF

SEQ ID NO: 24615 - protein, 7 aa, Artificial Sequence
  Synthetic construct
WWGPDFY

SEQ ID NO: 24616 - protein, 7 aa, Artificial Sequence
  Synthetic construct
WWGPDRF

SEQ ID NO: 24617 - protein, 7 aa, Artificial Sequence
  Synthetic construct
WWGPDRY

SEQ ID NO: 24618 - protein, 7 aa, Artificial Sequence
  Synthetic construct
WWGPDCF

SEQ ID NO: 24619 - protein, 7 aa, Artificial Sequence
  Synthetic construct
WWGPDCY

SEQ ID NO: 24620 - protein, 7 aa, Artificial Sequence
  Synthetic construct
WWGPDLF

SEQ ID NO: 24621 - protein, 7 aa, Artificial Sequence
  Synthetic construct
WWGPDLY

SEQ ID NO: 24622 - protein, 7 aa, Artificial Sequence
  Synthetic construct
WWGPDAF

SEQ ID NO: 24623 - protein, 7 aa, Artificial Sequence
  Synthetic construct
WWGPDAY

SEQ ID NO: 24624 - protein, 7 aa, Artificial Sequence
  Synthetic construct
WWGPDQF

SEQ ID NO: 24625 - protein, 7 aa, Artificial Sequence
  Synthetic construct
WWGPDQY

SEQ ID NO: 24626 - protein, 7 aa, Artificial Sequence
  Synthetic construct
WWGPDDF

SEQ ID NO: 24627 - protein, 7 aa, Artificial Sequence
  Synthetic construct
WWGPDDY

SEQ ID NO: 24628 - protein, 7 aa, Artificial Sequence
  Synthetic construct
WWGPDVF

SEQ ID NO: 24629 - protein, 7 aa, Artificial Sequence
  Synthetic construct
WWGPDVY

SEQ ID NO: 24630 - protein, 7 aa, Artificial Sequence
  Synthetic construct
WWGPYFF

SEQ ID NO: 24631 - protein, 7 aa, Artificial Sequence
  Synthetic construct
WWGPYFY

SEQ ID NO: 24632 - protein, 7 aa, Artificial Sequence
  Synthetic construct
WWGPYRF

SEQ ID NO: 24633 - protein, 7 aa, Artificial Sequence
  Synthetic construct
WWGPYRY

SEQ ID NO: 24634 - protein, 7 aa, Artificial Sequence
  Synthetic construct
WWGPYCF

SEQ ID NO: 24635 - protein, 7 aa, Artificial Sequence
  Synthetic construct
WWGPYCY

SEQ ID NO: 24636 - protein, 7 aa, Artificial Sequence
  Synthetic construct
WWGPYLF

SEQ ID NO: 24637 - protein, 7 aa, Artificial Sequence
  Synthetic construct
WWGPYLY

SEQ ID NO: 24638 - protein, 7 aa, Artificial Sequence
  Synthetic construct
WWGPYAF

SEQ ID NO: 24639 - protein, 7 aa, Artificial Sequence
  Synthetic construct
WWGPYAY

SEQ ID NO: 24640 - protein, 7 aa, Artificial Sequence
  Synthetic construct
WWGPYQF

SEQ ID NO: 24641 - protein, 7 aa, Artificial Sequence
  Synthetic construct
WWGPYQY

SEQ ID NO: 24642 - protein, 7 aa, Artificial Sequence
  Synthetic construct
WWGPYDF

SEQ ID NO: 24643 - protein, 7 aa, Artificial Sequence
  Synthetic construct
WWGPYDY

SEQ ID NO: 24644 - protein, 7 aa, Artificial Sequence
  Synthetic construct
WWGPYVF

SEQ ID NO: 24645 - protein, 7 aa, Artificial Sequence
  Synthetic construct
WWGPYVY

SEQ ID NO: 24646 - protein, 7 aa, Artificial Sequence
  Synthetic construct
WWGPFFF

SEQ ID NO: 24647 - protein, 7 aa, Artificial Sequence
  Synthetic construct
WWGPFFY

SEQ ID NO: 24648 - protein, 7 aa, Artificial Sequence
  Synthetic construct
WWGPFRF

SEQ ID NO: 24649 - protein, 7 aa, Artificial Sequence
  Synthetic construct
WWGPFRY

SEQ ID NO: 24650 - protein, 7 aa, Artificial Sequence
  Synthetic construct
WWGPFCF

SEQ ID NO: 24651 - protein, 7 aa, Artificial Sequence
  Synthetic construct
WWGPFCY

SEQ ID NO: 24652 - protein, 7 aa, Artificial Sequence
  Synthetic construct
WWGPFLF

SEQ ID NO: 24653 - protein, 7 aa, Artificial Sequence
  Synthetic construct
WWGPFLY

SEQ ID NO: 24654 - protein, 7 aa, Artificial Sequence
  Synthetic construct
WWGPFAF

SEQ ID NO: 24655 - protein, 7 aa, Artificial Sequence
  Synthetic construct
WWGPFAY

SEQ ID NO: 24656 - protein, 7 aa, Artificial Sequence
  Synthetic construct
WWGPFQF

SEQ ID NO: 24657 - protein, 7 aa, Artificial Sequence
  Synthetic construct
WWGPFQY

SEQ ID NO: 24658 - protein, 7 aa, Artificial Sequence
  Synthetic construct
WWGPFDF

SEQ ID NO: 24659 - protein, 7 aa, Artificial Sequence
  Synthetic construct
WWGPFDY

SEQ ID NO: 24660 - protein, 7 aa, Artificial Sequence
  Synthetic construct
WWGPFVF

SEQ ID NO: 24661 - protein, 7 aa, Artificial Sequence
  Synthetic construct
WWGPFVY

SEQ ID NO: 24662 - protein, 7 aa, Artificial Sequence
  Synthetic construct
WWGPVFF

SEQ ID NO: 24663 - protein, 7 aa, Artificial Sequence
  Synthetic construct
WWGPVFY

SEQ ID NO: 24664 - protein, 7 aa, Artificial Sequence
  Synthetic construct
WWGPVRF

SEQ ID NO: 24665 - protein, 7 aa, Artificial Sequence
  Synthetic construct
WWGPVRY

SEQ ID NO: 24666 - protein, 7 aa, Artificial Sequence
  Synthetic construct
WWGPVCF

SEQ ID NO: 24667 - protein, 7 aa, Artificial Sequence
  Synthetic construct
WWGPVCY

SEQ ID NO: 24668 - protein, 7 aa, Artificial Sequence
  Synthetic construct
WWGPVLF

SEQ ID NO: 24669 - protein, 7 aa, Artificial Sequence
  Synthetic construct
WWGPVLY

SEQ ID NO: 24670 - protein, 7 aa, Artificial Sequence
  Synthetic construct
WWGPVAF

SEQ ID NO: 24671 - protein, 7 aa, Artificial Sequence
  Synthetic construct
WWGPVAY

SEQ ID NO: 24672 - protein, 7 aa, Artificial Sequence
  Synthetic construct
WWGPVQF

SEQ ID NO: 24673 - protein, 7 aa, Artificial Sequence
  Synthetic construct
WWGPVQY

SEQ ID NO: 24674 - protein, 7 aa, Artificial Sequence
  Synthetic construct
WWGPVDF

SEQ ID NO: 24675 - protein, 7 aa, Artificial Sequence
  Synthetic construct
WWGPVDY

SEQ ID NO: 24676 - protein, 7 aa, Artificial Sequence
  Synthetic construct
WWGPVVF

SEQ ID NO: 24677 - protein, 7 aa, Artificial Sequence
  Synthetic construct
WWGPVVY

SEQ ID NO: 24678 - protein, 7 aa, Artificial Sequence
  Synthetic construct
WWGPTFF

SEQ ID NO: 24679 - protein, 7 aa, Artificial Sequence
  Synthetic construct
WWGPTFY

SEQ ID NO: 24680 - protein, 7 aa, Artificial Sequence
  Synthetic construct
WWGPTRF

SEQ ID NO: 24681 - protein, 7 aa, Artificial Sequence
  Synthetic construct
WWGPTRY

SEQ ID NO: 24682 - protein, 7 aa, Artificial Sequence
  Synthetic construct
WWGPTCF

SEQ ID NO: 24683 - protein, 7 aa, Artificial Sequence
  Synthetic construct
WWGPTCY

SEQ ID NO: 24684 - protein, 7 aa, Artificial Sequence
  Synthetic construct
WWGPTLF

SEQ ID NO: 24685 - protein, 7 aa, Artificial Sequence
  Synthetic construct
WWGPTLY

SEQ ID NO: 24686 - protein, 7 aa, Artificial Sequence
  Synthetic construct
WWGPTAF

SEQ ID NO: 24687 - protein, 7 aa, Artificial Sequence
  Synthetic construct
WWGPTAY

SEQ ID NO: 24688 - protein, 7 aa, Artificial Sequence
  Synthetic construct
WWGPTQF

SEQ ID NO: 24689 - protein, 7 aa, Artificial Sequence
  Synthetic construct
WWGPTQY

SEQ ID NO: 24690 - protein, 7 aa, Artificial Sequence
  Synthetic construct
WWGPTDF

SEQ ID NO: 24691 - protein, 7 aa, Artificial Sequence
  Synthetic construct
WWGPTDY

SEQ ID NO: 24692 - protein, 7 aa, Artificial Sequence
  Synthetic construct
WWGPTVF

SEQ ID NO: 24693 - protein, 7 aa, Artificial Sequence
  Synthetic construct
WWGPTVY

SEQ ID NO: 24694 - protein, 7 aa, Artificial Sequence
  Synthetic construct
WWGPGFF

SEQ ID NO: 24695 - protein, 7 aa, Artificial Sequence
  Synthetic construct
WWGPGFY

SEQ ID NO: 24696 - protein, 7 aa, Artificial Sequence
  Synthetic construct
WWGPGRF

SEQ ID NO: 24697 - protein, 7 aa, Artificial Sequence
  Synthetic construct
WWGPGRY

SEQ ID NO: 24698 - protein, 7 aa, Artificial Sequence
  Synthetic construct
WWGPGCF

SEQ ID NO: 24699 - protein, 7 aa, Artificial Sequence
  Synthetic construct
WWGPGCY

SEQ ID NO: 24700 - protein, 7 aa, Artificial Sequence
  Synthetic construct
WWGPGLF

SEQ ID NO: 24701 - protein, 7 aa, Artificial Sequence
  Synthetic construct
WWGPGLY

SEQ ID NO: 24702 - protein, 7 aa, Artificial Sequence
  Synthetic construct
WWGPGAF

SEQ ID NO: 24703 - protein, 7 aa, Artificial Sequence
  Synthetic construct
WWGPGAY

SEQ ID NO: 24704 - protein, 7 aa, Artificial Sequence
  Synthetic construct
WWGPGQF

SEQ ID NO: 24705 - protein, 7 aa, Artificial Sequence
  Synthetic construct
WWGPGQY

SEQ ID NO: 24706 - protein, 7 aa, Artificial Sequence
  Synthetic construct
WWGPGDF

SEQ ID NO: 24707 - protein, 7 aa, Artificial Sequence
  Synthetic construct
WWGPGDY

SEQ ID NO: 24708 - protein, 7 aa, Artificial Sequence
  Synthetic construct
WWGPGVF

SEQ ID NO: 24709 - protein, 7 aa, Artificial Sequence
  Synthetic construct
WWGPGVY

SEQ ID NO: 24710 - protein, 7 aa, Artificial Sequence
  Synthetic construct
WWGPAFF

SEQ ID NO: 24711 - protein, 7 aa, Artificial Sequence
  Synthetic construct
WWGPAFY

SEQ ID NO: 24712 - protein, 7 aa, Artificial Sequence
  Synthetic construct
WWGPARF

SEQ ID NO: 24713 - protein, 7 aa, Artificial Sequence
  Synthetic construct
WWGPARY

SEQ ID NO: 24714 - protein, 7 aa, Artificial Sequence
  Synthetic construct
WWGPACF

SEQ ID NO: 24715 - protein, 7 aa, Artificial Sequence
  Synthetic construct
WWGPACY

SEQ ID NO: 24716 - protein, 7 aa, Artificial Sequence
  Synthetic construct
WWGPALF

SEQ ID NO: 24717 - protein, 7 aa, Artificial Sequence
  Synthetic construct
WWGPALY

SEQ ID NO: 24718 - protein, 7 aa, Artificial Sequence
  Synthetic construct
WWGPAAF

SEQ ID NO: 24719 - protein, 7 aa, Artificial Sequence
  Synthetic construct
WWGPAAY

SEQ ID NO: 24720 - protein, 7 aa, Artificial Sequence
  Synthetic construct
WWGPAQF

SEQ ID NO: 24721 - protein, 7 aa, Artificial Sequence
  Synthetic construct
WWGPAQY

SEQ ID NO: 24722 - protein, 7 aa, Artificial Sequence
  Synthetic construct
WWGPADF

SEQ ID NO: 24723 - protein, 7 aa, Artificial Sequence
  Synthetic construct
WWGPADY

SEQ ID NO: 24724 - protein, 7 aa, Artificial Sequence
  Synthetic construct
WWGPAVF

SEQ ID NO: 24725 - protein, 7 aa, Artificial Sequence
  Synthetic construct
WWGPAVY

SEQ ID NO: 24726 - protein, 7 aa, Artificial Sequence
  Synthetic construct
WWGPQFF

SEQ ID NO: 24727 - protein, 7 aa, Artificial Sequence
  Synthetic construct
WWGPQFY

SEQ ID NO: 24728 - protein, 7 aa, Artificial Sequence
  Synthetic construct
WWGPQRF

SEQ ID NO: 24729 - protein, 7 aa, Artificial Sequence
  Synthetic construct
WWGPQRY

SEQ ID NO: 24730 - protein, 7 aa, Artificial Sequence
  Synthetic construct
WWGPQCF

SEQ ID NO: 24731 - protein, 7 aa, Artificial Sequence
  Synthetic construct
WWGPQCY

SEQ ID NO: 24732 - protein, 7 aa, Artificial Sequence
  Synthetic construct
WWGPQLF

SEQ ID NO: 24733 - protein, 7 aa, Artificial Sequence
  Synthetic construct
WWGPQLY

SEQ ID NO: 24734 - protein, 7 aa, Artificial Sequence
  Synthetic construct
WWGPQAF

SEQ ID NO: 24735 - protein, 7 aa, Artificial Sequence
  Synthetic construct
WWGPQAY

SEQ ID NO: 24736 - protein, 7 aa, Artificial Sequence
  Synthetic construct
WWGPQQF

SEQ ID NO: 24737 - protein, 7 aa, Artificial Sequence
  Synthetic construct
WWGPQQY

SEQ ID NO: 24738 - protein, 7 aa, Artificial Sequence
  Synthetic construct
WWGPQDF

SEQ ID NO: 24739 - protein, 7 aa, Artificial Sequence
  Synthetic construct
WWGPQDY

SEQ ID NO: 24740 - protein, 7 aa, Artificial Sequence
  Synthetic construct
WWGPQVF

SEQ ID NO: 24741 - protein, 7 aa, Artificial Sequence
  Synthetic construct
WWGPQVY

SEQ ID NO: 24742 - protein, 7 aa, Artificial Sequence
  Synthetic construct
WWGHIFF

SEQ ID NO: 24743 - protein, 7 aa, Artificial Sequence
  Synthetic construct
WWGHIFY

SEQ ID NO: 24744 - protein, 7 aa, Artificial Sequence
  Synthetic construct
WWGHIRF

SEQ ID NO: 24745 - protein, 7 aa, Artificial Sequence
  Synthetic construct
WWGHIRY

SEQ ID NO: 24746 - protein, 7 aa, Artificial Sequence
  Synthetic construct
WWGHICF

SEQ ID NO: 24747 - protein, 7 aa, Artificial Sequence
  Synthetic construct
WWGHICY

SEQ ID NO: 24748 - protein, 7 aa, Artificial Sequence
  Synthetic construct
WWGHILF

SEQ ID NO: 24749 - protein, 7 aa, Artificial Sequence
  Synthetic construct
WWGHILY

SEQ ID NO: 24750 - protein, 7 aa, Artificial Sequence
  Synthetic construct
WWGHIAF

SEQ ID NO: 24751 - protein, 7 aa, Artificial Sequence
  Synthetic construct
WWGHIAY

SEQ ID NO: 24752 - protein, 7 aa, Artificial Sequence
  Synthetic construct
WWGHIQF

SEQ ID NO: 24753 - protein, 7 aa, Artificial Sequence
  Synthetic construct
WWGHIQY

SEQ ID NO: 24754 - protein, 7 aa, Artificial Sequence
  Synthetic construct
WWGHIDF

SEQ ID NO: 24755 - protein, 7 aa, Artificial Sequence
  Synthetic construct
WWGHIDY

SEQ ID NO: 24756 - protein, 7 aa, Artificial Sequence
  Synthetic construct
WWGHIVF

SEQ ID NO: 24757 - protein, 7 aa, Artificial Sequence
  Synthetic construct
WWGHIVY

SEQ ID NO: 24758 - protein, 7 aa, Artificial Sequence
  Synthetic construct
WWGHDFF

SEQ ID NO: 24759 - protein, 7 aa, Artificial Sequence
  Synthetic construct
WWGHDFY

SEQ ID NO: 24760 - protein, 7 aa, Artificial Sequence
  Synthetic construct
WWGHDRF

SEQ ID NO: 24761 - protein, 7 aa, Artificial Sequence
  Synthetic construct
WWGHDRY

SEQ ID NO: 24762 - protein, 7 aa, Artificial Sequence
  Synthetic construct
WWGHDCF

SEQ ID NO: 24763 - protein, 7 aa, Artificial Sequence
  Synthetic construct
WWGHDCY

SEQ ID NO: 24764 - protein, 7 aa, Artificial Sequence
  Synthetic construct
WWGHDLF

SEQ ID NO: 24765 - protein, 7 aa, Artificial Sequence
  Synthetic construct
WWGHDLY

SEQ ID NO: 24766 - protein, 7 aa, Artificial Sequence
  Synthetic construct
WWGHDAF

SEQ ID NO: 24767 - protein, 7 aa, Artificial Sequence
  Synthetic construct
WWGHDAY

SEQ ID NO: 24768 - protein, 7 aa, Artificial Sequence
  Synthetic construct
WWGHDQF

SEQ ID NO: 24769 - protein, 7 aa, Artificial Sequence
  Synthetic construct
WWGHDQY

SEQ ID NO: 24770 - protein, 7 aa, Artificial Sequence
  Synthetic construct
WWGHDDF

SEQ ID NO: 24771 - protein, 7 aa, Artificial Sequence
  Synthetic construct
WWGHDDY

SEQ ID NO: 24772 - protein, 7 aa, Artificial Sequence
  Synthetic construct
WWGHDVF

SEQ ID NO: 24773 - protein, 7 aa, Artificial Sequence
  Synthetic construct
WWGHDVY

SEQ ID NO: 24774 - protein, 7 aa, Artificial Sequence
  Synthetic construct
WWGHYFF

SEQ ID NO: 24775 - protein, 7 aa, Artificial Sequence
  Synthetic construct
WWGHYFY

SEQ ID NO: 24776 - protein, 7 aa, Artificial Sequence
  Synthetic construct
WWGHYRF

SEQ ID NO: 24777 - protein, 7 aa, Artificial Sequence
  Synthetic construct
WWGHYRY

SEQ ID NO: 24778 - protein, 7 aa, Artificial Sequence
  Synthetic construct
WWGHYCF

SEQ ID NO: 24779 - protein, 7 aa, Artificial Sequence
  Synthetic construct
WWGHYCY

SEQ ID NO: 24780 - protein, 7 aa, Artificial Sequence
  Synthetic construct
WWGHYLF

SEQ ID NO: 24781 - protein, 7 aa, Artificial Sequence
  Synthetic construct
WWGHYLY

SEQ ID NO: 24782 - protein, 7 aa, Artificial Sequence
  Synthetic construct
WWGHYAF

SEQ ID NO: 24783 - protein, 7 aa, Artificial Sequence
  Synthetic construct
WWGHYAY

SEQ ID NO: 24784 - protein, 7 aa, Artificial Sequence
  Synthetic construct
WWGHYQF

SEQ ID NO: 24785 - protein, 7 aa, Artificial Sequence
  Synthetic construct
WWGHYQY

SEQ ID NO: 24786 - protein, 7 aa, Artificial Sequence
  Synthetic construct
WWGHYDF

SEQ ID NO: 24787 - protein, 7 aa, Artificial Sequence
  Synthetic construct
WWGHYDY

SEQ ID NO: 24788 - protein, 7 aa, Artificial Sequence
  Synthetic construct
WWGHYVF

SEQ ID NO: 24789 - protein, 7 aa, Artificial Sequence
  Synthetic construct
WWGHYVY

SEQ ID NO: 24790 - protein, 7 aa, Artificial Sequence
  Synthetic construct
WWGHFFF

SEQ ID NO: 24791 - protein, 7 aa, Artificial Sequence
  Synthetic construct
WWGHFFY

SEQ ID NO: 24792 - protein, 7 aa, Artificial Sequence
  Synthetic construct
WWGHFRF

SEQ ID NO: 24793 - protein, 7 aa, Artificial Sequence
  Synthetic construct
WWGHFRY

SEQ ID NO: 24794 - protein, 7 aa, Artificial Sequence
  Synthetic construct
WWGHFCF

SEQ ID NO: 24795 - protein, 7 aa, Artificial Sequence
  Synthetic construct
WWGHFCY

SEQ ID NO: 24796 - protein, 7 aa, Artificial Sequence
  Synthetic construct
WWGHFLF

SEQ ID NO: 24797 - protein, 7 aa, Artificial Sequence
  Synthetic construct
WWGHFLY

SEQ ID NO: 24798 - protein, 7 aa, Artificial Sequence
  Synthetic construct
WWGHFAF

SEQ ID NO: 24799 - protein, 7 aa, Artificial Sequence
  Synthetic construct
WWGHFAY

SEQ ID NO: 24800 - protein, 7 aa, Artificial Sequence
  Synthetic construct
WWGHFQF

SEQ ID NO: 24801 - protein, 7 aa, Artificial Sequence
  Synthetic construct
WWGHFQY

SEQ ID NO: 24802 - protein, 7 aa, Artificial Sequence
  Synthetic construct
WWGHFDF

SEQ ID NO: 24803 - protein, 7 aa, Artificial Sequence
  Synthetic construct
WWGHFDY

SEQ ID NO: 24804 - protein, 7 aa, Artificial Sequence
  Synthetic construct
WWGHFVF

SEQ ID NO: 24805 - protein, 7 aa, Artificial Sequence
  Synthetic construct
WWGHFVY

SEQ ID NO: 24806 - protein, 7 aa, Artificial Sequence
  Synthetic construct
WWGHVFF

SEQ ID NO: 24807 - protein, 7 aa, Artificial Sequence
  Synthetic construct
WWGHVFY

SEQ ID NO: 24808 - protein, 7 aa, Artificial Sequence
  Synthetic construct
WWGHVRF

SEQ ID NO: 24809 - protein, 7 aa, Artificial Sequence
  Synthetic construct
WWGHVRY

SEQ ID NO: 24810 - protein, 7 aa, Artificial Sequence
  Synthetic construct
WWGHVCF

SEQ ID NO: 24811 - protein, 7 aa, Artificial Sequence
  Synthetic construct
WWGHVCY

SEQ ID NO: 24812 - protein, 7 aa, Artificial Sequence
  Synthetic construct
WWGHVLF

SEQ ID NO: 24813 - protein, 7 aa, Artificial Sequence
  Synthetic construct
WWGHVLY

SEQ ID NO: 24814 - protein, 7 aa, Artificial Sequence
  Synthetic construct
WWGHVAF

SEQ ID NO: 24815 - protein, 7 aa, Artificial Sequence
  Synthetic construct
WWGHVAY

SEQ ID NO: 24816 - protein, 7 aa, Artificial Sequence
  Synthetic construct
WWGHVQF

SEQ ID NO: 24817 - protein, 7 aa, Artificial Sequence
  Synthetic construct
WWGHVQY

SEQ ID NO: 24818 - protein, 7 aa, Artificial Sequence
  Synthetic construct
WWGHVDF

SEQ ID NO: 24819 - protein, 7 aa, Artificial Sequence
  Synthetic construct
WWGHVDY

SEQ ID NO: 24820 - protein, 7 aa, Artificial Sequence
  Synthetic construct
WWGHVVF

SEQ ID NO: 24821 - protein, 7 aa, Artificial Sequence
  Synthetic construct
WWGHVVY

SEQ ID NO: 24822 - protein, 7 aa, Artificial Sequence
  Synthetic construct
WWGHTFF

SEQ ID NO: 24823 - protein, 7 aa, Artificial Sequence
  Synthetic construct
WWGHTFY

SEQ ID NO: 24824 - protein, 7 aa, Artificial Sequence
  Synthetic construct
WWGHTRF

SEQ ID NO: 24825 - protein, 7 aa, Artificial Sequence
  Synthetic construct
WWGHTRY

SEQ ID NO: 24826 - protein, 7 aa, Artificial Sequence
  Synthetic construct
WWGHTCF

SEQ ID NO: 24827 - protein, 7 aa, Artificial Sequence
  Synthetic construct
WWGHTCY

SEQ ID NO: 24828 - protein, 7 aa, Artificial Sequence
  Synthetic construct
WWGHTLF

SEQ ID NO: 24829 - protein, 7 aa, Artificial Sequence
  Synthetic construct
WWGHTLY

SEQ ID NO: 24830 - protein, 7 aa, Artificial Sequence
  Synthetic construct
WWGHTAF

SEQ ID NO: 24831 - protein, 7 aa, Artificial Sequence
  Synthetic construct
WWGHTAY

SEQ ID NO: 24832 - protein, 7 aa, Artificial Sequence
  Synthetic construct
WWGHTQF

SEQ ID NO: 24833 - protein, 7 aa, Artificial Sequence
  Synthetic construct
WWGHTQY

SEQ ID NO: 24834 - protein, 7 aa, Artificial Sequence
  Synthetic construct
WWGHTDF

SEQ ID NO: 24835 - protein, 7 aa, Artificial Sequence
  Synthetic construct
WWGHTDY

SEQ ID NO: 24836 - protein, 7 aa, Artificial Sequence
  Synthetic construct
WWGHTVF

SEQ ID NO: 24837 - protein, 7 aa, Artificial Sequence
  Synthetic construct
WWGHTVY

SEQ ID NO: 24838 - protein, 7 aa, Artificial Sequence
  Synthetic construct
WWGHGFF

SEQ ID NO: 24839 - protein, 7 aa, Artificial Sequence
  Synthetic construct
WWGHGFY

SEQ ID NO: 24840 - protein, 7 aa, Artificial Sequence
  Synthetic construct
WWGHGRF

SEQ ID NO: 24841 - protein, 7 aa, Artificial Sequence
  Synthetic construct
WWGHGRY

SEQ ID NO: 24842 - protein, 7 aa, Artificial Sequence
  Synthetic construct
WWGHGCF

SEQ ID NO: 24843 - protein, 7 aa, Artificial Sequence
  Synthetic construct
WWGHGCY

SEQ ID NO: 24844 - protein, 7 aa, Artificial Sequence
  Synthetic construct
WWGHGLF

SEQ ID NO: 24845 - protein, 7 aa, Artificial Sequence
  Synthetic construct
WWGHGLY

SEQ ID NO: 24846 - protein, 7 aa, Artificial Sequence
  Synthetic construct
WWGHGAF

SEQ ID NO: 24847 - protein, 7 aa, Artificial Sequence
  Synthetic construct
WWGHGAY

SEQ ID NO: 24848 - protein, 7 aa, Artificial Sequence
  Synthetic construct
WWGHGQF

SEQ ID NO: 24849 - protein, 7 aa, Artificial Sequence
  Synthetic construct
WWGHGQY

SEQ ID NO: 24850 - protein, 7 aa, Artificial Sequence
  Synthetic construct
WWGHGDF

SEQ ID NO: 24851 - protein, 7 aa, Artificial Sequence
  Synthetic construct
WWGHGDY

SEQ ID NO: 24852 - protein, 7 aa, Artificial Sequence
  Synthetic construct
WWGHGVF

SEQ ID NO: 24853 - protein, 7 aa, Artificial Sequence
  Synthetic construct
WWGHGVY

SEQ ID NO: 24854 - protein, 7 aa, Artificial Sequence
  Synthetic construct
WWGHAFF

SEQ ID NO: 24855 - protein, 7 aa, Artificial Sequence
  Synthetic construct
WWGHAFY

SEQ ID NO: 24856 - protein, 7 aa, Artificial Sequence
  Synthetic construct
WWGHARF

SEQ ID NO: 24857 - protein, 7 aa, Artificial Sequence
  Synthetic construct
WWGHARY

SEQ ID NO: 24858 - protein, 7 aa, Artificial Sequence
  Synthetic construct
WWGHACF

SEQ ID NO: 24859 - protein, 7 aa, Artificial Sequence
  Synthetic construct
WWGHACY

SEQ ID NO: 24860 - protein, 7 aa, Artificial Sequence
  Synthetic construct
WWGHALF

SEQ ID NO: 24861 - protein, 7 aa, Artificial Sequence
  Synthetic construct
WWGHALY

SEQ ID NO: 24862 - protein, 7 aa, Artificial Sequence
  Synthetic construct
WWGHAAF

SEQ ID NO: 24863 - protein, 7 aa, Artificial Sequence
  Synthetic construct
WWGHAAY

SEQ ID NO: 24864 - protein, 7 aa, Artificial Sequence
  Synthetic construct
WWGHAQF

SEQ ID NO: 24865 - protein, 7 aa, Artificial Sequence
  Synthetic construct
WWGHAQY

SEQ ID NO: 24866 - protein, 7 aa, Artificial Sequence
  Synthetic construct
WWGHADF

SEQ ID NO: 24867 - protein, 7 aa, Artificial Sequence
  Synthetic construct
WWGHADY

SEQ ID NO: 24868 - protein, 7 aa, Artificial Sequence
  Synthetic construct
WWGHAVF

SEQ ID NO: 24869 - protein, 7 aa, Artificial Sequence
  Synthetic construct
WWGHAVY

SEQ ID NO: 24870 - protein, 7 aa, Artificial Sequence
  Synthetic construct
WWGHQFF

SEQ ID NO: 24871 - protein, 7 aa, Artificial Sequence
  Synthetic construct
WWGHQFY

SEQ ID NO: 24872 - protein, 7 aa, Artificial Sequence
  Synthetic construct
WWGHQRF

SEQ ID NO: 24873 - protein, 7 aa, Artificial Sequence
  Synthetic construct
WWGHQRY

SEQ ID NO: 24874 - protein, 7 aa, Artificial Sequence
  Synthetic construct
WWGHQCF

SEQ ID NO: 24875 - protein, 7 aa, Artificial Sequence
  Synthetic construct
WWGHQCY

SEQ ID NO: 24876 - protein, 7 aa, Artificial Sequence
  Synthetic construct
WWGHQLF

SEQ ID NO: 24877 - protein, 7 aa, Artificial Sequence
  Synthetic construct
WWGHQLY

SEQ ID NO: 24878 - protein, 7 aa, Artificial Sequence
  Synthetic construct
WWGHQAF

SEQ ID NO: 24879 - protein, 7 aa, Artificial Sequence
  Synthetic construct
WWGHQAY

SEQ ID NO: 24880 - protein, 7 aa, Artificial Sequence
  Synthetic construct
WWGHQQF

SEQ ID NO: 24881 - protein, 7 aa, Artificial Sequence
  Synthetic construct
WWGHQQY

SEQ ID NO: 24882 - protein, 7 aa, Artificial Sequence
  Synthetic construct
WWGHQDF

SEQ ID NO: 24883 - protein, 7 aa, Artificial Sequence
  Synthetic construct
WWGHQDY

SEQ ID NO: 24884 - protein, 7 aa, Artificial Sequence
  Synthetic construct
WWGHQVF

SEQ ID NO: 24885 - protein, 7 aa, Artificial Sequence
  Synthetic construct
WWGHQVY

SEQ ID NO: 24886 - protein, 7 aa, Artificial Sequence
  Synthetic construct
WWGLIFF

SEQ ID NO: 24887 - protein, 7 aa, Artificial Sequence
  Synthetic construct
WWGLIFY

SEQ ID NO: 24888 - protein, 7 aa, Artificial Sequence
  Synthetic construct
WWGLIRF

SEQ ID NO: 24889 - protein, 7 aa, Artificial Sequence
  Synthetic construct
WWGLIRY

SEQ ID NO: 24890 - protein, 7 aa, Artificial Sequence
  Synthetic construct
WWGLICF

SEQ ID NO: 24891 - protein, 7 aa, Artificial Sequence
  Synthetic construct
WWGLICY

SEQ ID NO: 24892 - protein, 7 aa, Artificial Sequence
  Synthetic construct
WWGLILF

SEQ ID NO: 24893 - protein, 7 aa, Artificial Sequence
  Synthetic construct
WWGLILY

SEQ ID NO: 24894 - protein, 7 aa, Artificial Sequence
  Synthetic construct
WWGLIAF

SEQ ID NO: 24895 - protein, 7 aa, Artificial Sequence
  Synthetic construct
WWGLIAY

SEQ ID NO: 24896 - protein, 7 aa, Artificial Sequence
  Synthetic construct
WWGLIQF

SEQ ID NO: 24897 - protein, 7 aa, Artificial Sequence
  Synthetic construct
WWGLIQY

SEQ ID NO: 24898 - protein, 7 aa, Artificial Sequence
  Synthetic construct
WWGLIDF

SEQ ID NO: 24899 - protein, 7 aa, Artificial Sequence
  Synthetic construct
WWGLIDY

SEQ ID NO: 24900 - protein, 7 aa, Artificial Sequence
  Synthetic construct
WWGLIVF

SEQ ID NO: 24901 - protein, 7 aa, Artificial Sequence
  Synthetic construct
WWGLIVY

SEQ ID NO: 24902 - protein, 7 aa, Artificial Sequence
  Synthetic construct
WWGLDFF

SEQ ID NO: 24903 - protein, 7 aa, Artificial Sequence
  Synthetic construct
WWGLDFY

SEQ ID NO: 24904 - protein, 7 aa, Artificial Sequence
  Synthetic construct
WWGLDRF

SEQ ID NO: 24905 - protein, 7 aa, Artificial Sequence
  Synthetic construct
WWGLDRY

SEQ ID NO: 24906 - protein, 7 aa, Artificial Sequence
  Synthetic construct
WWGLDCF

SEQ ID NO: 24907 - protein, 7 aa, Artificial Sequence
  Synthetic construct
WWGLDCY

SEQ ID NO: 24908 - protein, 7 aa, Artificial Sequence
  Synthetic construct
WWGLDLF

SEQ ID NO: 24909 - protein, 7 aa, Artificial Sequence
  Synthetic construct
WWGLDLY

SEQ ID NO: 24910 - protein, 7 aa, Artificial Sequence
  Synthetic construct
WWGLDAF

SEQ ID NO: 24911 - protein, 7 aa, Artificial Sequence
  Synthetic construct
WWGLDAY

SEQ ID NO: 24912 - protein, 7 aa, Artificial Sequence
  Synthetic construct
WWGLDQF

SEQ ID NO: 24913 - protein, 7 aa, Artificial Sequence
  Synthetic construct
WWGLDQY

SEQ ID NO: 24914 - protein, 7 aa, Artificial Sequence
  Synthetic construct
WWGLDDF

SEQ ID NO: 24915 - protein, 7 aa, Artificial Sequence
  Synthetic construct
WWGLDDY

SEQ ID NO: 24916 - protein, 7 aa, Artificial Sequence
  Synthetic construct
WWGLDVF

SEQ ID NO: 24917 - protein, 7 aa, Artificial Sequence
  Synthetic construct
WWGLDVY

SEQ ID NO: 24918 - protein, 7 aa, Artificial Sequence
  Synthetic construct
WWGLYFF

SEQ ID NO: 24919 - protein, 7 aa, Artificial Sequence
  Synthetic construct
WWGLYFY

SEQ ID NO: 24920 - protein, 7 aa, Artificial Sequence
  Synthetic construct
WWGLYRF

SEQ ID NO: 24921 - protein, 7 aa, Artificial Sequence
  Synthetic construct
WWGLYRY

SEQ ID NO: 24922 - protein, 7 aa, Artificial Sequence
  Synthetic construct
WWGLYCF

SEQ ID NO: 24923 - protein, 7 aa, Artificial Sequence
  Synthetic construct
WWGLYCY

SEQ ID NO: 24924 - protein, 7 aa, Artificial Sequence
  Synthetic construct
WWGLYLF

SEQ ID NO: 24925 - protein, 7 aa, Artificial Sequence
  Synthetic construct
WWGLYLY

SEQ ID NO: 24926 - protein, 7 aa, Artificial Sequence
  Synthetic construct
WWGLYAF

SEQ ID NO: 24927 - protein, 7 aa, Artificial Sequence
  Synthetic construct
WWGLYAY

SEQ ID NO: 24928 - protein, 7 aa, Artificial Sequence
  Synthetic construct
WWGLYQF

SEQ ID NO: 24929 - protein, 7 aa, Artificial Sequence
  Synthetic construct
WWGLYQY

SEQ ID NO: 24930 - protein, 7 aa, Artificial Sequence
  Synthetic construct
WWGLYDF

SEQ ID NO: 24931 - protein, 7 aa, Artificial Sequence
  Synthetic construct
WWGLYDY

SEQ ID NO: 24932 - protein, 7 aa, Artificial Sequence
  Synthetic construct
WWGLYVF

SEQ ID NO: 24933 - protein, 7 aa, Artificial Sequence
  Synthetic construct
WWGLYVY

SEQ ID NO: 24934 - protein, 7 aa, Artificial Sequence
  Synthetic construct
WWGLFFF

SEQ ID NO: 24935 - protein, 7 aa, Artificial Sequence
  Synthetic construct
WWGLFFY

SEQ ID NO: 24936 - protein, 7 aa, Artificial Sequence
  Synthetic construct
WWGLFRF

SEQ ID NO: 24937 - protein, 7 aa, Artificial Sequence
  Synthetic construct
WWGLFRY

SEQ ID NO: 24938 - protein, 7 aa, Artificial Sequence
  Synthetic construct
WWGLFCF

SEQ ID NO: 24939 - protein, 7 aa, Artificial Sequence
  Synthetic construct
WWGLFCY

SEQ ID NO: 24940 - protein, 7 aa, Artificial Sequence
  Synthetic construct
WWGLFLF

SEQ ID NO: 24941 - protein, 7 aa, Artificial Sequence
  Synthetic construct
WWGLFLY

SEQ ID NO: 24942 - protein, 7 aa, Artificial Sequence
  Synthetic construct
WWGLFAF

SEQ ID NO: 24943 - protein, 7 aa, Artificial Sequence
  Synthetic construct
WWGLFAY

SEQ ID NO: 24944 - protein, 7 aa, Artificial Sequence
  Synthetic construct
WWGLFQF

SEQ ID NO: 24945 - protein, 7 aa, Artificial Sequence
  Synthetic construct
WWGLFQY

SEQ ID NO: 24946 - protein, 7 aa, Artificial Sequence
  Synthetic construct
WWGLFDF

SEQ ID NO: 24947 - protein, 7 aa, Artificial Sequence
  Synthetic construct
WWGLFDY

SEQ ID NO: 24948 - protein, 7 aa, Artificial Sequence
  Synthetic construct
WWGLFVF

SEQ ID NO: 24949 - protein, 7 aa, Artificial Sequence
  Synthetic construct
WWGLFVY

SEQ ID NO: 24950 - protein, 7 aa, Artificial Sequence
  Synthetic construct
WWGLVFF

SEQ ID NO: 24951 - protein, 7 aa, Artificial Sequence
  Synthetic construct
WWGLVFY

SEQ ID NO: 24952 - protein, 7 aa, Artificial Sequence
  Synthetic construct
WWGLVRF

SEQ ID NO: 24953 - protein, 7 aa, Artificial Sequence
  Synthetic construct
WWGLVRY

SEQ ID NO: 24954 - protein, 7 aa, Artificial Sequence
  Synthetic construct
WWGLVCF

SEQ ID NO: 24955 - protein, 7 aa, Artificial Sequence
  Synthetic construct
WWGLVCY

SEQ ID NO: 24956 - protein, 7 aa, Artificial Sequence
  Synthetic construct
WWGLVLF

SEQ ID NO: 24957 - protein, 7 aa, Artificial Sequence
  Synthetic construct
WWGLVLY

SEQ ID NO: 24958 - protein, 7 aa, Artificial Sequence
  Synthetic construct
WWGLVAF

SEQ ID NO: 24959 - protein, 7 aa, Artificial Sequence
  Synthetic construct
WWGLVAY

SEQ ID NO: 24960 - protein, 7 aa, Artificial Sequence
  Synthetic construct
WWGLVQF

SEQ ID NO: 24961 - protein, 7 aa, Artificial Sequence
  Synthetic construct
WWGLVQY

SEQ ID NO: 24962 - protein, 7 aa, Artificial Sequence
  Synthetic construct
WWGLVDF

SEQ ID NO: 24963 - protein, 7 aa, Artificial Sequence
  Synthetic construct
WWGLVDY

SEQ ID NO: 24964 - protein, 7 aa, Artificial Sequence
  Synthetic construct
WWGLVVF

SEQ ID NO: 24965 - protein, 7 aa, Artificial Sequence
  Synthetic construct
WWGLVVY

SEQ ID NO: 24966 - protein, 7 aa, Artificial Sequence
  Synthetic construct
WWGLTFF

SEQ ID NO: 24967 - protein, 7 aa, Artificial Sequence
  Synthetic construct
WWGLTFY

SEQ ID NO: 24968 - protein, 7 aa, Artificial Sequence
  Synthetic construct
WWGLTRF

SEQ ID NO: 24969 - protein, 7 aa, Artificial Sequence
  Synthetic construct
WWGLTRY

SEQ ID NO: 24970 - protein, 7 aa, Artificial Sequence
  Synthetic construct
WWGLTCF

SEQ ID NO: 24971 - protein, 7 aa, Artificial Sequence
  Synthetic construct
WWGLTCY

SEQ ID NO: 24972 - protein, 7 aa, Artificial Sequence
  Synthetic construct
WWGLTLF

SEQ ID NO: 24973 - protein, 7 aa, Artificial Sequence
  Synthetic construct
WWGLTLY

SEQ ID NO: 24974 - protein, 7 aa, Artificial Sequence
  Synthetic construct
WWGLTAF

SEQ ID NO: 24975 - protein, 7 aa, Artificial Sequence
  Synthetic construct
WWGLTAY

SEQ ID NO: 24976 - protein, 7 aa, Artificial Sequence
  Synthetic construct
WWGLTQF

SEQ ID NO: 24977 - protein, 7 aa, Artificial Sequence
  Synthetic construct
WWGLTQY

SEQ ID NO: 24978 - protein, 7 aa, Artificial Sequence
  Synthetic construct
WWGLTDF

SEQ ID NO: 24979 - protein, 7 aa, Artificial Sequence
  Synthetic construct
WWGLTDY

SEQ ID NO: 24980 - protein, 7 aa, Artificial Sequence
  Synthetic construct
WWGLTVF

SEQ ID NO: 24981 - protein, 7 aa, Artificial Sequence
  Synthetic construct
WWGLTVY

SEQ ID NO: 24982 - protein, 7 aa, Artificial Sequence
  Synthetic construct
WWGLGFF

SEQ ID NO: 24983 - protein, 7 aa, Artificial Sequence
  Synthetic construct
WWGLGFY

SEQ ID NO: 24984 - protein, 7 aa, Artificial Sequence
  Synthetic construct
WWGLGRF

SEQ ID NO: 24985 - protein, 7 aa, Artificial Sequence
  Synthetic construct
WWGLGRY

SEQ ID NO: 24986 - protein, 7 aa, Artificial Sequence
  Synthetic construct
WWGLGCF

SEQ ID NO: 24987 - protein, 7 aa, Artificial Sequence
  Synthetic construct
WWGLGCY

SEQ ID NO: 24988 - protein, 7 aa, Artificial Sequence
  Synthetic construct
WWGLGLF

SEQ ID NO: 24989 - protein, 7 aa, Artificial Sequence
  Synthetic construct
WWGLGLY

SEQ ID NO: 24990 - protein, 7 aa, Artificial Sequence
  Synthetic construct
WWGLGAF

SEQ ID NO: 24991 - protein, 7 aa, Artificial Sequence
  Synthetic construct
WWGLGAY

SEQ ID NO: 24992 - protein, 7 aa, Artificial Sequence
  Synthetic construct
WWGLGQF

SEQ ID NO: 24993 - protein, 7 aa, Artificial Sequence
  Synthetic construct
WWGLGQY

SEQ ID NO: 24994 - protein, 7 aa, Artificial Sequence
  Synthetic construct
WWGLGDF

SEQ ID NO: 24995 - protein, 7 aa, Artificial Sequence
  Synthetic construct
WWGLGDY

SEQ ID NO: 24996 - protein, 7 aa, Artificial Sequence
  Synthetic construct
WWGLGVF

SEQ ID NO: 24997 - protein, 7 aa, Artificial Sequence
  Synthetic construct
WWGLGVY

SEQ ID NO: 24998 - protein, 7 aa, Artificial Sequence
  Synthetic construct
WWGLAFF

SEQ ID NO: 24999 - protein, 7 aa, Artificial Sequence
  Synthetic construct
WWGLAFY

SEQ ID NO: 25000 - protein, 7 aa, Artificial Sequence
  Synthetic construct
WWGLARF

SEQ ID NO: 25001 - protein, 7 aa, Artificial Sequence
  Synthetic construct
WWGLARY

SEQ ID NO: 25002 - protein, 7 aa, Artificial Sequence
  Synthetic construct
WWGLACF

SEQ ID NO: 25003 - protein, 7 aa, Artificial Sequence
  Synthetic construct
WWGLACY

SEQ ID NO: 25004 - protein, 7 aa, Artificial Sequence
  Synthetic construct
WWGLALF

SEQ ID NO: 25005 - protein, 7 aa, Artificial Sequence
  Synthetic construct
WWGLALY

SEQ ID NO: 25006 - protein, 7 aa, Artificial Sequence
  Synthetic construct
WWGLAAF

SEQ ID NO: 25007 - protein, 7 aa, Artificial Sequence
  Synthetic construct
WWGLAAY

SEQ ID NO: 25008 - protein, 7 aa, Artificial Sequence
  Synthetic construct
WWGLAQF

SEQ ID NO: 25009 - protein, 7 aa, Artificial Sequence
  Synthetic construct
WWGLAQY

SEQ ID NO: 25010 - protein, 7 aa, Artificial Sequence
  Synthetic construct
WWGLADF

SEQ ID NO: 25011 - protein, 7 aa, Artificial Sequence
  Synthetic construct
WWGLADY

SEQ ID NO: 25012 - protein, 7 aa, Artificial Sequence
  Synthetic construct
WWGLAVF

SEQ ID NO: 25013 - protein, 7 aa, Artificial Sequence
  Synthetic construct
WWGLAVY

SEQ ID NO: 25014 - protein, 7 aa, Artificial Sequence
  Synthetic construct
WWGLQFF

SEQ ID NO: 25015 - protein, 7 aa, Artificial Sequence
  Synthetic construct
WWGLQFY

SEQ ID NO: 25016 - protein, 7 aa, Artificial Sequence
  Synthetic construct
WWGLQRF

SEQ ID NO: 25017 - protein, 7 aa, Artificial Sequence
  Synthetic construct
WWGLQRY

SEQ ID NO: 25018 - protein, 7 aa, Artificial Sequence
  Synthetic construct
WWGLQCF

SEQ ID NO: 25019 - protein, 7 aa, Artificial Sequence
  Synthetic construct
WWGLQCY

SEQ ID NO: 25020 - protein, 7 aa, Artificial Sequence
  Synthetic construct
WWGLQLF

SEQ ID NO: 25021 - protein, 7 aa, Artificial Sequence
  Synthetic construct
WWGLQLY

SEQ ID NO: 25022 - protein, 7 aa, Artificial Sequence
  Synthetic construct
WWGLQAF

SEQ ID NO: 25023 - protein, 7 aa, Artificial Sequence
  Synthetic construct
WWGLQAY

SEQ ID NO: 25024 - protein, 7 aa, Artificial Sequence
  Synthetic construct
WWGLQQF

SEQ ID NO: 25025 - protein, 7 aa, Artificial Sequence
  Synthetic construct
WWGLQQY

SEQ ID NO: 25026 - protein, 7 aa, Artificial Sequence
  Synthetic construct
WWGLQDF

SEQ ID NO: 25027 - protein, 7 aa, Artificial Sequence
  Synthetic construct
WWGLQDY

SEQ ID NO: 25028 - protein, 7 aa, Artificial Sequence
  Synthetic construct
WWGLQVF

SEQ ID NO: 25029 - protein, 7 aa, Artificial Sequence
  Synthetic construct
WWGLQVY

SEQ ID NO: 25030 - protein, 7 aa, Artificial Sequence
  Synthetic construct
WWGFIFF

SEQ ID NO: 25031 - protein, 7 aa, Artificial Sequence
  Synthetic construct
WWGFIFY

SEQ ID NO: 25032 - protein, 7 aa, Artificial Sequence
  Synthetic construct
WWGFIRF

SEQ ID NO: 25033 - protein, 7 aa, Artificial Sequence
  Synthetic construct
WWGFIRY

SEQ ID NO: 25034 - protein, 7 aa, Artificial Sequence
  Synthetic construct
WWGFICF

SEQ ID NO: 25035 - protein, 7 aa, Artificial Sequence
  Synthetic construct
WWGFICY

SEQ ID NO: 25036 - protein, 7 aa, Artificial Sequence
  Synthetic construct
WWGFILF

SEQ ID NO: 25037 - protein, 7 aa, Artificial Sequence
  Synthetic construct
WWGFILY

SEQ ID NO: 25038 - protein, 7 aa, Artificial Sequence
  Synthetic construct
WWGFIAF

SEQ ID NO: 25039 - protein, 7 aa, Artificial Sequence
  Synthetic construct
WWGFIAY

SEQ ID NO: 25040 - protein, 7 aa, Artificial Sequence
  Synthetic construct
WWGFIQF

SEQ ID NO: 25041 - protein, 7 aa, Artificial Sequence
  Synthetic construct
WWGFIQY

SEQ ID NO: 25042 - protein, 7 aa, Artificial Sequence
  Synthetic construct
WWGFIDF

SEQ ID NO: 25043 - protein, 7 aa, Artificial Sequence
  Synthetic construct
WWGFIDY

SEQ ID NO: 25044 - protein, 7 aa, Artificial Sequence
  Synthetic construct
WWGFIVF

SEQ ID NO: 25045 - protein, 7 aa, Artificial Sequence
  Synthetic construct
WWGFIVY

SEQ ID NO: 25046 - protein, 7 aa, Artificial Sequence
  Synthetic construct
WWGFDFF

SEQ ID NO: 25047 - protein, 7 aa, Artificial Sequence
  Synthetic construct
WWGFDFY

SEQ ID NO: 25048 - protein, 7 aa, Artificial Sequence
  Synthetic construct
WWGFDRF

SEQ ID NO: 25049 - protein, 7 aa, Artificial Sequence
  Synthetic construct
WWGFDRY

SEQ ID NO: 25050 - protein, 7 aa, Artificial Sequence
  Synthetic construct
WWGFDCF

SEQ ID NO: 25051 - protein, 7 aa, Artificial Sequence
  Synthetic construct
WWGFDCY

SEQ ID NO: 25052 - protein, 7 aa, Artificial Sequence
  Synthetic construct
WWGFDLF

SEQ ID NO: 25053 - protein, 7 aa, Artificial Sequence
  Synthetic construct
WWGFDLY

SEQ ID NO: 25054 - protein, 7 aa, Artificial Sequence
  Synthetic construct
WWGFDAF

SEQ ID NO: 25055 - protein, 7 aa, Artificial Sequence
  Synthetic construct
WWGFDAY

SEQ ID NO: 25056 - protein, 7 aa, Artificial Sequence
  Synthetic construct
WWGFDQF

SEQ ID NO: 25057 - protein, 7 aa, Artificial Sequence
  Synthetic construct
WWGFDQY

SEQ ID NO: 25058 - protein, 7 aa, Artificial Sequence
  Synthetic construct
WWGFDDF

SEQ ID NO: 25059 - protein, 7 aa, Artificial Sequence
  Synthetic construct
WWGFDDY

SEQ ID NO: 25060 - protein, 7 aa, Artificial Sequence
  Synthetic construct
WWGFDVF

SEQ ID NO: 25061 - protein, 7 aa, Artificial Sequence
  Synthetic construct
WWGFDVY

SEQ ID NO: 25062 - protein, 7 aa, Artificial Sequence
  Synthetic construct
WWGFYFF

SEQ ID NO: 25063 - protein, 7 aa, Artificial Sequence
  Synthetic construct
WWGFYFY

SEQ ID NO: 25064 - protein, 7 aa, Artificial Sequence
  Synthetic construct
WWGFYRF

SEQ ID NO: 25065 - protein, 7 aa, Artificial Sequence
  Synthetic construct
WWGFYRY

SEQ ID NO: 25066 - protein, 7 aa, Artificial Sequence
  Synthetic construct
WWGFYCF

SEQ ID NO: 25067 - protein, 7 aa, Artificial Sequence
  Synthetic construct
WWGFYCY

SEQ ID NO: 25068 - protein, 7 aa, Artificial Sequence
  Synthetic construct
WWGFYLF

SEQ ID NO: 25069 - protein, 7 aa, Artificial Sequence
  Synthetic construct
WWGFYLY

SEQ ID NO: 25070 - protein, 7 aa, Artificial Sequence
  Synthetic construct
WWGFYAF

SEQ ID NO: 25071 - protein, 7 aa, Artificial Sequence
  Synthetic construct
WWGFYAY

SEQ ID NO: 25072 - protein, 7 aa, Artificial Sequence
  Synthetic construct
WWGFYQF

SEQ ID NO: 25073 - protein, 7 aa, Artificial Sequence
  Synthetic construct
WWGFYQY

SEQ ID NO: 25074 - protein, 7 aa, Artificial Sequence
  Synthetic construct
WWGFYDF

SEQ ID NO: 25075 - protein, 7 aa, Artificial Sequence
  Synthetic construct
WWGFYDY

SEQ ID NO: 25076 - protein, 7 aa, Artificial Sequence
  Synthetic construct
WWGFYVF

SEQ ID NO: 25077 - protein, 7 aa, Artificial Sequence
  Synthetic construct
WWGFYVY

SEQ ID NO: 25078 - protein, 7 aa, Artificial Sequence
  Synthetic construct
WWGFFFF

SEQ ID NO: 25079 - protein, 7 aa, Artificial Sequence
  Synthetic construct
WWGFFFY

SEQ ID NO: 25080 - protein, 7 aa, Artificial Sequence
  Synthetic construct
WWGFFRF

SEQ ID NO: 25081 - protein, 7 aa, Artificial Sequence
  Synthetic construct
WWGFFRY

SEQ ID NO: 25082 - protein, 7 aa, Artificial Sequence
  Synthetic construct
WWGFFCF

SEQ ID NO: 25083 - protein, 7 aa, Artificial Sequence
  Synthetic construct
WWGFFCY

SEQ ID NO: 25084 - protein, 7 aa, Artificial Sequence
  Synthetic construct
WWGFFLF

SEQ ID NO: 25085 - protein, 7 aa, Artificial Sequence
  Synthetic construct
WWGFFLY

SEQ ID NO: 25086 - protein, 7 aa, Artificial Sequence
  Synthetic construct
WWGFFAF

SEQ ID NO: 25087 - protein, 7 aa, Artificial Sequence
  Synthetic construct
WWGFFAY

SEQ ID NO: 25088 - protein, 7 aa, Artificial Sequence
  Synthetic construct
WWGFFQF

SEQ ID NO: 25089 - protein, 7 aa, Artificial Sequence
  Synthetic construct
WWGFFQY

SEQ ID NO: 25090 - protein, 7 aa, Artificial Sequence
  Synthetic construct
WWGFFDF

SEQ ID NO: 25091 - protein, 7 aa, Artificial Sequence
  Synthetic construct
WWGFFDY

SEQ ID NO: 25092 - protein, 7 aa, Artificial Sequence
  Synthetic construct
WWGFFVF

SEQ ID NO: 25093 - protein, 7 aa, Artificial Sequence
  Synthetic construct
WWGFFVY

SEQ ID NO: 25094 - protein, 7 aa, Artificial Sequence
  Synthetic construct
WWGFVFF

SEQ ID NO: 25095 - protein, 7 aa, Artificial Sequence
  Synthetic construct
WWGFVFY

SEQ ID NO: 25096 - protein, 7 aa, Artificial Sequence
  Synthetic construct
WWGFVRF

SEQ ID NO: 25097 - protein, 7 aa, Artificial Sequence
  Synthetic construct
WWGFVRY

SEQ ID NO: 25098 - protein, 7 aa, Artificial Sequence
  Synthetic construct
WWGFVCF

SEQ ID NO: 25099 - protein, 7 aa, Artificial Sequence
  Synthetic construct
WWGFVCY

SEQ ID NO: 25100 - protein, 7 aa, Artificial Sequence
  Synthetic construct
WWGFVLF

SEQ ID NO: 25101 - protein, 7 aa, Artificial Sequence
  Synthetic construct
WWGFVLY

SEQ ID NO: 25102 - protein, 7 aa, Artificial Sequence
  Synthetic construct
WWGFVAF

SEQ ID NO: 25103 - protein, 7 aa, Artificial Sequence
  Synthetic construct
WWGFVAY

SEQ ID NO: 25104 - protein, 7 aa, Artificial Sequence
  Synthetic construct
WWGFVQF

SEQ ID NO: 25105 - protein, 7 aa, Artificial Sequence
  Synthetic construct
WWGFVQY

SEQ ID NO: 25106 - protein, 7 aa, Artificial Sequence
  Synthetic construct
WWGFVDF

SEQ ID NO: 25107 - protein, 7 aa, Artificial Sequence
  Synthetic construct
WWGFVDY

SEQ ID NO: 25108 - protein, 7 aa, Artificial Sequence
  Synthetic construct
WWGFVVF

SEQ ID NO: 25109 - protein, 7 aa, Artificial Sequence
  Synthetic construct
WWGFVVY

SEQ ID NO: 25110 - protein, 7 aa, Artificial Sequence
  Synthetic construct
WWGFTFF

SEQ ID NO: 25111 - protein, 7 aa, Artificial Sequence
  Synthetic construct
WWGFTFY

SEQ ID NO: 25112 - protein, 7 aa, Artificial Sequence
  Synthetic construct
WWGFTRF

SEQ ID NO: 25113 - protein, 7 aa, Artificial Sequence
  Synthetic construct
WWGFTRY

SEQ ID NO: 25114 - protein, 7 aa, Artificial Sequence
  Synthetic construct
WWGFTCF

SEQ ID NO: 25115 - protein, 7 aa, Artificial Sequence
  Synthetic construct
WWGFTCY

SEQ ID NO: 25116 - protein, 7 aa, Artificial Sequence
  Synthetic construct
WWGFTLF

SEQ ID NO: 25117 - protein, 7 aa, Artificial Sequence
  Synthetic construct
WWGFTLY

SEQ ID NO: 25118 - protein, 7 aa, Artificial Sequence
  Synthetic construct
WWGFTAF

SEQ ID NO: 25119 - protein, 7 aa, Artificial Sequence
  Synthetic construct
WWGFTAY

SEQ ID NO: 25120 - protein, 7 aa, Artificial Sequence
  Synthetic construct
WWGFTQF

SEQ ID NO: 25121 - protein, 7 aa, Artificial Sequence
  Synthetic construct
WWGFTQY

SEQ ID NO: 25122 - protein, 7 aa, Artificial Sequence
  Synthetic construct
WWGFTDF

SEQ ID NO: 25123 - protein, 7 aa, Artificial Sequence
  Synthetic construct
WWGFTDY

SEQ ID NO: 25124 - protein, 7 aa, Artificial Sequence
  Synthetic construct
WWGFTVF

SEQ ID NO: 25125 - protein, 7 aa, Artificial Sequence
  Synthetic construct
WWGFTVY

SEQ ID NO: 25126 - protein, 7 aa, Artificial Sequence
  Synthetic construct
WWGFGFF

SEQ ID NO: 25127 - protein, 7 aa, Artificial Sequence
  Synthetic construct
WWGFGFY

SEQ ID NO: 25128 - protein, 7 aa, Artificial Sequence
  Synthetic construct
WWGFGRF

SEQ ID NO: 25129 - protein, 7 aa, Artificial Sequence
  Synthetic construct
WWGFGRY

SEQ ID NO: 25130 - protein, 7 aa, Artificial Sequence
  Synthetic construct
WWGFGCF

SEQ ID NO: 25131 - protein, 7 aa, Artificial Sequence
  Synthetic construct
WWGFGCY

SEQ ID NO: 25132 - protein, 7 aa, Artificial Sequence
  Synthetic construct
WWGFGLF

SEQ ID NO: 25133 - protein, 7 aa, Artificial Sequence
  Synthetic construct
WWGFGLY

SEQ ID NO: 25134 - protein, 7 aa, Artificial Sequence
  Synthetic construct
WWGFGAF

SEQ ID NO: 25135 - protein, 7 aa, Artificial Sequence
  Synthetic construct
WWGFGAY

SEQ ID NO: 25136 - protein, 7 aa, Artificial Sequence
  Synthetic construct
WWGFGQF

SEQ ID NO: 25137 - protein, 7 aa, Artificial Sequence
  Synthetic construct
WWGFGQY

SEQ ID NO: 25138 - protein, 7 aa, Artificial Sequence
  Synthetic construct
WWGFGDF

SEQ ID NO: 25139 - protein, 7 aa, Artificial Sequence
  Synthetic construct
WWGFGDY

SEQ ID NO: 25140 - protein, 7 aa, Artificial Sequence
  Synthetic construct
WWGFGVF

SEQ ID NO: 25141 - protein, 7 aa, Artificial Sequence
  Synthetic construct
WWGFGVY

SEQ ID NO: 25142 - protein, 7 aa, Artificial Sequence
  Synthetic construct
WWGFAFF

SEQ ID NO: 25143 - protein, 7 aa, Artificial Sequence
  Synthetic construct
WWGFAFY

SEQ ID NO: 25144 - protein, 7 aa, Artificial Sequence
  Synthetic construct
WWGFARF

SEQ ID NO: 25145 - protein, 7 aa, Artificial Sequence
  Synthetic construct
WWGFARY

SEQ ID NO: 25146 - protein, 7 aa, Artificial Sequence
  Synthetic construct
WWGFACF

SEQ ID NO: 25147 - protein, 7 aa, Artificial Sequence
  Synthetic construct
WWGFACY

SEQ ID NO: 25148 - protein, 7 aa, Artificial Sequence
  Synthetic construct
WWGFALF

SEQ ID NO: 25149 - protein, 7 aa, Artificial Sequence
  Synthetic construct
WWGFALY

SEQ ID NO: 25150 - protein, 7 aa, Artificial Sequence
  Synthetic construct
WWGFAAF

SEQ ID NO: 25151 - protein, 7 aa, Artificial Sequence
  Synthetic construct
WWGFAAY

SEQ ID NO: 25152 - protein, 7 aa, Artificial Sequence
  Synthetic construct
WWGFAQF

SEQ ID NO: 25153 - protein, 7 aa, Artificial Sequence
  Synthetic construct
WWGFAQY

SEQ ID NO: 25154 - protein, 7 aa, Artificial Sequence
  Synthetic construct
WWGFADF

SEQ ID NO: 25155 - protein, 7 aa, Artificial Sequence
  Synthetic construct
WWGFADY

SEQ ID NO: 25156 - protein, 7 aa, Artificial Sequence
  Synthetic construct
WWGFAVF

SEQ ID NO: 25157 - protein, 7 aa, Artificial Sequence
  Synthetic construct
WWGFAVY

SEQ ID NO: 25158 - protein, 7 aa, Artificial Sequence
  Synthetic construct
WWGFQFF

SEQ ID NO: 25159 - protein, 7 aa, Artificial Sequence
  Synthetic construct
WWGFQFY

SEQ ID NO: 25160 - protein, 7 aa, Artificial Sequence
  Synthetic construct
WWGFQRF

SEQ ID NO: 25161 - protein, 7 aa, Artificial Sequence
  Synthetic construct
WWGFQRY

SEQ ID NO: 25162 - protein, 7 aa, Artificial Sequence
  Synthetic construct
WWGFQCF

SEQ ID NO: 25163 - protein, 7 aa, Artificial Sequence
  Synthetic construct
WWGFQCY

SEQ ID NO: 25164 - protein, 7 aa, Artificial Sequence
  Synthetic construct
WWGFQLF

SEQ ID NO: 25165 - protein, 7 aa, Artificial Sequence
  Synthetic construct
WWGFQLY

SEQ ID NO: 25166 - protein, 7 aa, Artificial Sequence
  Synthetic construct
WWGFQAF

SEQ ID NO: 25167 - protein, 7 aa, Artificial Sequence
  Synthetic construct
WWGFQAY

SEQ ID NO: 25168 - protein, 7 aa, Artificial Sequence
  Synthetic construct
WWGFQQF

SEQ ID NO: 25169 - protein, 7 aa, Artificial Sequence
  Synthetic construct
WWGFQQY

SEQ ID NO: 25170 - protein, 7 aa, Artificial Sequence
  Synthetic construct
WWGFQDF

SEQ ID NO: 25171 - protein, 7 aa, Artificial Sequence
  Synthetic construct
WWGFQDY

SEQ ID NO: 25172 - protein, 7 aa, Artificial Sequence
  Synthetic construct
WWGFQVF

SEQ ID NO: 25173 - protein, 7 aa, Artificial Sequence
  Synthetic construct
WWGFQVY

SEQ ID NO: 25174 - protein, 7 aa, Artificial Sequence
  Synthetic construct
WVIYIFF

SEQ ID NO: 25175 - protein, 7 aa, Artificial Sequence
  Synthetic construct
WVIYIFY

SEQ ID NO: 25176 - protein, 7 aa, Artificial Sequence
  Synthetic construct
WVIYIRF

SEQ ID NO: 25177 - protein, 7 aa, Artificial Sequence
  Synthetic construct
WVIYIRY

SEQ ID NO: 25178 - protein, 7 aa, Artificial Sequence
  Synthetic construct
WVIYICF

SEQ ID NO: 25179 - protein, 7 aa, Artificial Sequence
  Synthetic construct
WVIYICY

SEQ ID NO: 25180 - protein, 7 aa, Artificial Sequence
  Synthetic construct
WVIYILF

SEQ ID NO: 25181 - protein, 7 aa, Artificial Sequence
  Synthetic construct
WVIYILY

SEQ ID NO: 25182 - protein, 7 aa, Artificial Sequence
  Synthetic construct
WVIYIAF

SEQ ID NO: 25183 - protein, 7 aa, Artificial Sequence
  Synthetic construct
WVIYIAY

SEQ ID NO: 25184 - protein, 7 aa, Artificial Sequence
  Synthetic construct
WVIYIQF

SEQ ID NO: 25185 - protein, 7 aa, Artificial Sequence
  Synthetic construct
WVIYIQY

SEQ ID NO: 25186 - protein, 7 aa, Artificial Sequence
  Synthetic construct
WVIYIDF

SEQ ID NO: 25187 - protein, 7 aa, Artificial Sequence
  Synthetic construct
WVIYIDY

SEQ ID NO: 25188 - protein, 7 aa, Artificial Sequence
  Synthetic construct
WVIYIVF

SEQ ID NO: 25189 - protein, 7 aa, Artificial Sequence
  Synthetic construct
WVIYIVY

SEQ ID NO: 25190 - protein, 7 aa, Artificial Sequence
  Synthetic construct
WVIYDFF

SEQ ID NO: 25191 - protein, 7 aa, Artificial Sequence
  Synthetic construct
WVIYDFY

SEQ ID NO: 25192 - protein, 7 aa, Artificial Sequence
  Synthetic construct
WVIYDRF

SEQ ID NO: 25193 - protein, 7 aa, Artificial Sequence
  Synthetic construct
WVIYDRY

SEQ ID NO: 25194 - protein, 7 aa, Artificial Sequence
  Synthetic construct
WVIYDCF

SEQ ID NO: 25195 - protein, 7 aa, Artificial Sequence
  Synthetic construct
WVIYDCY

SEQ ID NO: 25196 - protein, 7 aa, Artificial Sequence
  Synthetic construct
WVIYDLF

SEQ ID NO: 25197 - protein, 7 aa, Artificial Sequence
  Synthetic construct
WVIYDLY

SEQ ID NO: 25198 - protein, 7 aa, Artificial Sequence
  Synthetic construct
WVIYDAF

SEQ ID NO: 25199 - protein, 7 aa, Artificial Sequence
  Synthetic construct
WVIYDAY

SEQ ID NO: 25200 - protein, 7 aa, Artificial Sequence
  Synthetic construct
WVIYDQF

SEQ ID NO: 25201 - protein, 7 aa, Artificial Sequence
  Synthetic construct
WVIYDQY

SEQ ID NO: 25202 - protein, 7 aa, Artificial Sequence
  Synthetic construct
WVIYDDF

SEQ ID NO: 25203 - protein, 7 aa, Artificial Sequence
  Synthetic construct
WVIYDDY

SEQ ID NO: 25204 - protein, 7 aa, Artificial Sequence
  Synthetic construct
WVIYDVF

SEQ ID NO: 25205 - protein, 7 aa, Artificial Sequence
  Synthetic construct
WVIYDVY

SEQ ID NO: 25206 - protein, 7 aa, Artificial Sequence
  Synthetic construct
WVIYYFF

SEQ ID NO: 25207 - protein, 7 aa, Artificial Sequence
  Synthetic construct
WVIYYFY

SEQ ID NO: 25208 - protein, 7 aa, Artificial Sequence
  Synthetic construct
WVIYYRF

SEQ ID NO: 25209 - protein, 7 aa, Artificial Sequence
  Synthetic construct
WVIYYRY

SEQ ID NO: 25210 - protein, 7 aa, Artificial Sequence
  Synthetic construct
WVIYYCF

SEQ ID NO: 25211 - protein, 7 aa, Artificial Sequence
  Synthetic construct
WVIYYCY

SEQ ID NO: 25212 - protein, 7 aa, Artificial Sequence
  Synthetic construct
WVIYYLF

SEQ ID NO: 25213 - protein, 7 aa, Artificial Sequence
  Synthetic construct
WVIYYLY

SEQ ID NO: 25214 - protein, 7 aa, Artificial Sequence
  Synthetic construct
WVIYYAF

SEQ ID NO: 25215 - protein, 7 aa, Artificial Sequence
  Synthetic construct
WVIYYAY

SEQ ID NO: 25216 - protein, 7 aa, Artificial Sequence
  Synthetic construct
WVIYYQF

SEQ ID NO: 25217 - protein, 7 aa, Artificial Sequence
  Synthetic construct
WVIYYQY

SEQ ID NO: 25218 - protein, 7 aa, Artificial Sequence
  Synthetic construct
WVIYYDF

SEQ ID NO: 25219 - protein, 7 aa, Artificial Sequence
  Synthetic construct
WVIYYDY

SEQ ID NO: 25220 - protein, 7 aa, Artificial Sequence
  Synthetic construct
WVIYYVF

SEQ ID NO: 25221 - protein, 7 aa, Artificial Sequence
  Synthetic construct
WVIYYVY

SEQ ID NO: 25222 - protein, 7 aa, Artificial Sequence
  Synthetic construct
WVIYFFF

SEQ ID NO: 25223 - protein, 7 aa, Artificial Sequence
  Synthetic construct
WVIYFFY

SEQ ID NO: 25224 - protein, 7 aa, Artificial Sequence
  Synthetic construct
WVIYFRF

SEQ ID NO: 25225 - protein, 7 aa, Artificial Sequence
  Synthetic construct
WVIYFRY

SEQ ID NO: 25226 - protein, 7 aa, Artificial Sequence
  Synthetic construct
WVIYFCF

SEQ ID NO: 25227 - protein, 7 aa, Artificial Sequence
  Synthetic construct
WVIYFCY

SEQ ID NO: 25228 - protein, 7 aa, Artificial Sequence
  Synthetic construct
WVIYFLF

SEQ ID NO: 25229 - protein, 7 aa, Artificial Sequence
  Synthetic construct
WVIYFLY

SEQ ID NO: 25230 - protein, 7 aa, Artificial Sequence
  Synthetic construct
WVIYFAF

SEQ ID NO: 25231 - protein, 7 aa, Artificial Sequence
  Synthetic construct
WVIYFAY

SEQ ID NO: 25232 - protein, 7 aa, Artificial Sequence
  Synthetic construct
WVIYFQF

SEQ ID NO: 25233 - protein, 7 aa, Artificial Sequence
  Synthetic construct
WVIYFQY

SEQ ID NO: 25234 - protein, 7 aa, Artificial Sequence
  Synthetic construct
WVIYFDF

SEQ ID NO: 25235 - protein, 7 aa, Artificial Sequence
  Synthetic construct
WVIYFDY

SEQ ID NO: 25236 - protein, 7 aa, Artificial Sequence
  Synthetic construct
WVIYFVF

SEQ ID NO: 25237 - protein, 7 aa, Artificial Sequence
  Synthetic construct
WVIYFVY

SEQ ID NO: 25238 - protein, 7 aa, Artificial Sequence
  Synthetic construct
WVIYVFF

SEQ ID NO: 25239 - protein, 7 aa, Artificial Sequence
  Synthetic construct
WVIYVFY

SEQ ID NO: 25240 - protein, 7 aa, Artificial Sequence
  Synthetic construct
WVIYVRF

SEQ ID NO: 25241 - protein, 7 aa, Artificial Sequence
  Synthetic construct
WVIYVRY

SEQ ID NO: 25242 - protein, 7 aa, Artificial Sequence
  Synthetic construct
WVIYVCF

SEQ ID NO: 25243 - protein, 7 aa, Artificial Sequence
  Synthetic construct
WVIYVCY

SEQ ID NO: 25244 - protein, 7 aa, Artificial Sequence
  Synthetic construct
WVIYVLF

SEQ ID NO: 25245 - protein, 7 aa, Artificial Sequence
  Synthetic construct
WVIYVLY

SEQ ID NO: 25246 - protein, 7 aa, Artificial Sequence
  Synthetic construct
WVIYVAF

SEQ ID NO: 25247 - protein, 7 aa, Artificial Sequence
  Synthetic construct
WVIYVAY

SEQ ID NO: 25248 - protein, 7 aa, Artificial Sequence
  Synthetic construct
WVIYVQF

SEQ ID NO: 25249 - protein, 7 aa, Artificial Sequence
  Synthetic construct
WVIYVQY

SEQ ID NO: 25250 - protein, 7 aa, Artificial Sequence
  Synthetic construct
WVIYVDF

SEQ ID NO: 25251 - protein, 7 aa, Artificial Sequence
  Synthetic construct
WVIYVDY

SEQ ID NO: 25252 - protein, 7 aa, Artificial Sequence
  Synthetic construct
WVIYVVF

SEQ ID NO: 25253 - protein, 7 aa, Artificial Sequence
  Synthetic construct
WVIYVVY

SEQ ID NO: 25254 - protein, 7 aa, Artificial Sequence
  Synthetic construct
WVIYTFF

SEQ ID NO: 25255 - protein, 7 aa, Artificial Sequence
  Synthetic construct
WVIYTFY

SEQ ID NO: 25256 - protein, 7 aa, Artificial Sequence
  Synthetic construct
WVIYTRF

SEQ ID NO: 25257 - protein, 7 aa, Artificial Sequence
  Synthetic construct
WVIYTRY

SEQ ID NO: 25258 - protein, 7 aa, Artificial Sequence
  Synthetic construct
WVIYTCF

SEQ ID NO: 25259 - protein, 7 aa, Artificial Sequence
  Synthetic construct
WVIYTCY

SEQ ID NO: 25260 - protein, 7 aa, Artificial Sequence
  Synthetic construct
WVIYTLF

SEQ ID NO: 25261 - protein, 7 aa, Artificial Sequence
  Synthetic construct
WVIYTLY

SEQ ID NO: 25262 - protein, 7 aa, Artificial Sequence
  Synthetic construct
WVIYTAF

SEQ ID NO: 25263 - protein, 7 aa, Artificial Sequence
  Synthetic construct
WVIYTAY

SEQ ID NO: 25264 - protein, 7 aa, Artificial Sequence
  Synthetic construct
WVIYTQF

SEQ ID NO: 25265 - protein, 7 aa, Artificial Sequence
  Synthetic construct
WVIYTQY

SEQ ID NO: 25266 - protein, 7 aa, Artificial Sequence
  Synthetic construct
WVIYTDF

SEQ ID NO: 25267 - protein, 7 aa, Artificial Sequence
  Synthetic construct
WVIYTDY

SEQ ID NO: 25268 - protein, 7 aa, Artificial Sequence
  Synthetic construct
WVIYTVF

SEQ ID NO: 25269 - protein, 7 aa, Artificial Sequence
  Synthetic construct
WVIYTVY

SEQ ID NO: 25270 - protein, 7 aa, Artificial Sequence
  Synthetic construct
WVIYGFF

SEQ ID NO: 25271 - protein, 7 aa, Artificial Sequence
  Synthetic construct
WVIYGFY

SEQ ID NO: 25272 - protein, 7 aa, Artificial Sequence
  Synthetic construct
WVIYGRF

SEQ ID NO: 25273 - protein, 7 aa, Artificial Sequence
  Synthetic construct
WVIYGRY

SEQ ID NO: 25274 - protein, 7 aa, Artificial Sequence
  Synthetic construct
WVIYGCF

SEQ ID NO: 25275 - protein, 7 aa, Artificial Sequence
  Synthetic construct
WVIYGCY

SEQ ID NO: 25276 - protein, 7 aa, Artificial Sequence
  Synthetic construct
WVIYGLF

SEQ ID NO: 25277 - protein, 7 aa, Artificial Sequence
  Synthetic construct
WVIYGLY

SEQ ID NO: 25278 - protein, 7 aa, Artificial Sequence
  Synthetic construct
WVIYGAF

SEQ ID NO: 25279 - protein, 7 aa, Artificial Sequence
  Synthetic construct
WVIYGAY

SEQ ID NO: 25280 - protein, 7 aa, Artificial Sequence
  Synthetic construct
WVIYGQF

SEQ ID NO: 25281 - protein, 7 aa, Artificial Sequence
  Synthetic construct
WVIYGQY

SEQ ID NO: 25282 - protein, 7 aa, Artificial Sequence
  Synthetic construct
WVIYGDF

SEQ ID NO: 25283 - protein, 7 aa, Artificial Sequence
  Synthetic construct
WVIYGDY

SEQ ID NO: 25284 - protein, 7 aa, Artificial Sequence
  Synthetic construct
WVIYGVF

SEQ ID NO: 25285 - protein, 7 aa, Artificial Sequence
  Synthetic construct
WVIYGVY

SEQ ID NO: 25286 - protein, 7 aa, Artificial Sequence
  Synthetic construct
WVIYAFF

SEQ ID NO: 25287 - protein, 7 aa, Artificial Sequence
  Synthetic construct
WVIYAFY

SEQ ID NO: 25288 - protein, 7 aa, Artificial Sequence
  Synthetic construct
WVIYARF

SEQ ID NO: 25289 - protein, 7 aa, Artificial Sequence
  Synthetic construct
WVIYARY

SEQ ID NO: 25290 - protein, 7 aa, Artificial Sequence
  Synthetic construct
WVIYACF

SEQ ID NO: 25291 - protein, 7 aa, Artificial Sequence
  Synthetic construct
WVIYACY

SEQ ID NO: 25292 - protein, 7 aa, Artificial Sequence
  Synthetic construct
WVIYALF

SEQ ID NO: 25293 - protein, 7 aa, Artificial Sequence
  Synthetic construct
WVIYALY

SEQ ID NO: 25294 - protein, 7 aa, Artificial Sequence
  Synthetic construct
WVIYAAF

SEQ ID NO: 25295 - protein, 7 aa, Artificial Sequence
  Synthetic construct
WVIYAAY

SEQ ID NO: 25296 - protein, 7 aa, Artificial Sequence
  Synthetic construct
WVIYAQF

SEQ ID NO: 25297 - protein, 7 aa, Artificial Sequence
  Synthetic construct
WVIYAQY

SEQ ID NO: 25298 - protein, 7 aa, Artificial Sequence
  Synthetic construct
WVIYADF

SEQ ID NO: 25299 - protein, 7 aa, Artificial Sequence
  Synthetic construct
WVIYADY

SEQ ID NO: 25300 - protein, 7 aa, Artificial Sequence
  Synthetic construct
WVIYAVF

SEQ ID NO: 25301 - protein, 7 aa, Artificial Sequence
  Synthetic construct
WVIYAVY

SEQ ID NO: 25302 - protein, 7 aa, Artificial Sequence
  Synthetic construct
WVIYQFF

SEQ ID NO: 25303 - protein, 7 aa, Artificial Sequence
  Synthetic construct
WVIYQFY

SEQ ID NO: 25304 - protein, 7 aa, Artificial Sequence
  Synthetic construct
WVIYQRF

SEQ ID NO: 25305 - protein, 7 aa, Artificial Sequence
  Synthetic construct
WVIYQRY

SEQ ID NO: 25306 - protein, 7 aa, Artificial Sequence
  Synthetic construct
WVIYQCF

SEQ ID NO: 25307 - protein, 7 aa, Artificial Sequence
  Synthetic construct
WVIYQCY

SEQ ID NO: 25308 - protein, 7 aa, Artificial Sequence
  Synthetic construct
WVIYQLF

SEQ ID NO: 25309 - protein, 7 aa, Artificial Sequence
  Synthetic construct
WVIYQLY

SEQ ID NO: 25310 - protein, 7 aa, Artificial Sequence
  Synthetic construct
WVIYQAF

SEQ ID NO: 25311 - protein, 7 aa, Artificial Sequence
  Synthetic construct
WVIYQAY

SEQ ID NO: 25312 - protein, 7 aa, Artificial Sequence
  Synthetic construct
WVIYQQF

SEQ ID NO: 25313 - protein, 7 aa, Artificial Sequence
  Synthetic construct
WVIYQQY

SEQ ID NO: 25314 - protein, 7 aa, Artificial Sequence
  Synthetic construct
WVIYQDF

SEQ ID NO: 25315 - protein, 7 aa, Artificial Sequence
  Synthetic construct
WVIYQDY

SEQ ID NO: 25316 - protein, 7 aa, Artificial Sequence
  Synthetic construct
WVIYQVF

SEQ ID NO: 25317 - protein, 7 aa, Artificial Sequence
  Synthetic construct
WVIYQVY

SEQ ID NO: 25318 - protein, 7 aa, Artificial Sequence
  Synthetic construct
WVIPIFF

SEQ ID NO: 25319 - protein, 7 aa, Artificial Sequence
  Synthetic construct
WVIPIFY

SEQ ID NO: 25320 - protein, 7 aa, Artificial Sequence
  Synthetic construct
WVIPIRF

SEQ ID NO: 25321 - protein, 7 aa, Artificial Sequence
  Synthetic construct
WVIPIRY

SEQ ID NO: 25322 - protein, 7 aa, Artificial Sequence
  Synthetic construct
WVIPICF

SEQ ID NO: 25323 - protein, 7 aa, Artificial Sequence
  Synthetic construct
WVIPICY

SEQ ID NO: 25324 - protein, 7 aa, Artificial Sequence
  Synthetic construct
WVIPILF

SEQ ID NO: 25325 - protein, 7 aa, Artificial Sequence
  Synthetic construct
WVIPILY

SEQ ID NO: 25326 - protein, 7 aa, Artificial Sequence
  Synthetic construct
WVIPIAF

SEQ ID NO: 25327 - protein, 7 aa, Artificial Sequence
  Synthetic construct
WVIPIAY

SEQ ID NO: 25328 - protein, 7 aa, Artificial Sequence
  Synthetic construct
WVIPIQF

SEQ ID NO: 25329 - protein, 7 aa, Artificial Sequence
  Synthetic construct
WVIPIQY

SEQ ID NO: 25330 - protein, 7 aa, Artificial Sequence
  Synthetic construct
WVIPIDF

SEQ ID NO: 25331 - protein, 7 aa, Artificial Sequence
  Synthetic construct
WVIPIDY

SEQ ID NO: 25332 - protein, 7 aa, Artificial Sequence
  Synthetic construct
WVIPIVF

SEQ ID NO: 25333 - protein, 7 aa, Artificial Sequence
  Synthetic construct
WVIPIVY

SEQ ID NO: 25334 - protein, 7 aa, Artificial Sequence
  Synthetic construct
WVIPDFF

SEQ ID NO: 25335 - protein, 7 aa, Artificial Sequence
  Synthetic construct
WVIPDFY

SEQ ID NO: 25336 - protein, 7 aa, Artificial Sequence
  Synthetic construct
WVIPDRF

SEQ ID NO: 25337 - protein, 7 aa, Artificial Sequence
  Synthetic construct
WVIPDRY

SEQ ID NO: 25338 - protein, 7 aa, Artificial Sequence
  Synthetic construct
WVIPDCF

SEQ ID NO: 25339 - protein, 7 aa, Artificial Sequence
  Synthetic construct
WVIPDCY

SEQ ID NO: 25340 - protein, 7 aa, Artificial Sequence
  Synthetic construct
WVIPDLF

SEQ ID NO: 25341 - protein, 7 aa, Artificial Sequence
  Synthetic construct
WVIPDLY

SEQ ID NO: 25342 - protein, 7 aa, Artificial Sequence
  Synthetic construct
WVIPDAF

SEQ ID NO: 25343 - protein, 7 aa, Artificial Sequence
  Synthetic construct
WVIPDAY

SEQ ID NO: 25344 - protein, 7 aa, Artificial Sequence
  Synthetic construct
WVIPDQF

SEQ ID NO: 25345 - protein, 7 aa, Artificial Sequence
  Synthetic construct
WVIPDQY

SEQ ID NO: 25346 - protein, 7 aa, Artificial Sequence
  Synthetic construct
WVIPDDF

SEQ ID NO: 25347 - protein, 7 aa, Artificial Sequence
  Synthetic construct
WVIPDDY

SEQ ID NO: 25348 - protein, 7 aa, Artificial Sequence
  Synthetic construct
WVIPDVF

SEQ ID NO: 25349 - protein, 7 aa, Artificial Sequence
  Synthetic construct
WVIPDVY

SEQ ID NO: 25350 - protein, 7 aa, Artificial Sequence
  Synthetic construct
WVIPYFF

SEQ ID NO: 25351 - protein, 7 aa, Artificial Sequence
  Synthetic construct
WVIPYFY

SEQ ID NO: 25352 - protein, 7 aa, Artificial Sequence
  Synthetic construct
WVIPYRF

SEQ ID NO: 25353 - protein, 7 aa, Artificial Sequence
  Synthetic construct
WVIPYRY

SEQ ID NO: 25354 - protein, 7 aa, Artificial Sequence
  Synthetic construct
WVIPYCF

SEQ ID NO: 25355 - protein, 7 aa, Artificial Sequence
  Synthetic construct
WVIPYCY

SEQ ID NO: 25356 - protein, 7 aa, Artificial Sequence
  Synthetic construct
WVIPYLF

SEQ ID NO: 25357 - protein, 7 aa, Artificial Sequence
  Synthetic construct
WVIPYLY

SEQ ID NO: 25358 - protein, 7 aa, Artificial Sequence
  Synthetic construct
WVIPYAF

SEQ ID NO: 25359 - protein, 7 aa, Artificial Sequence
  Synthetic construct
WVIPYAY

SEQ ID NO: 25360 - protein, 7 aa, Artificial Sequence
  Synthetic construct
WVIPYQF

SEQ ID NO: 25361 - protein, 7 aa, Artificial Sequence
  Synthetic construct
WVIPYQY

SEQ ID NO: 25362 - protein, 7 aa, Artificial Sequence
  Synthetic construct
WVIPYDF

SEQ ID NO: 25363 - protein, 7 aa, Artificial Sequence
  Synthetic construct
WVIPYDY

SEQ ID NO: 25364 - protein, 7 aa, Artificial Sequence
  Synthetic construct
WVIPYVF

SEQ ID NO: 25365 - protein, 7 aa, Artificial Sequence
  Synthetic construct
WVIPYVY

SEQ ID NO: 25366 - protein, 7 aa, Artificial Sequence
  Synthetic construct
WVIPFFF

SEQ ID NO: 25367 - protein, 7 aa, Artificial Sequence
  Synthetic construct
WVIPFFY

SEQ ID NO: 25368 - protein, 7 aa, Artificial Sequence
  Synthetic construct
WVIPFRF

SEQ ID NO: 25369 - protein, 7 aa, Artificial Sequence
  Synthetic construct
WVIPFRY

SEQ ID NO: 25370 - protein, 7 aa, Artificial Sequence
  Synthetic construct
WVIPFCF

SEQ ID NO: 25371 - protein, 7 aa, Artificial Sequence
  Synthetic construct
WVIPFCY

SEQ ID NO: 25372 - protein, 7 aa, Artificial Sequence
  Synthetic construct
WVIPFLF

SEQ ID NO: 25373 - protein, 7 aa, Artificial Sequence
  Synthetic construct
WVIPFLY

SEQ ID NO: 25374 - protein, 7 aa, Artificial Sequence
  Synthetic construct
WVIPFAF

SEQ ID NO: 25375 - protein, 7 aa, Artificial Sequence
  Synthetic construct
WVIPFAY

SEQ ID NO: 25376 - protein, 7 aa, Artificial Sequence
  Synthetic construct
WVIPFQF

SEQ ID NO: 25377 - protein, 7 aa, Artificial Sequence
  Synthetic construct
WVIPFQY

SEQ ID NO: 25378 - protein, 7 aa, Artificial Sequence
  Synthetic construct
WVIPFDF

SEQ ID NO: 25379 - protein, 7 aa, Artificial Sequence
  Synthetic construct
WVIPFDY

SEQ ID NO: 25380 - protein, 7 aa, Artificial Sequence
  Synthetic construct
WVIPFVF

SEQ ID NO: 25381 - protein, 7 aa, Artificial Sequence
  Synthetic construct
WVIPFVY

SEQ ID NO: 25382 - protein, 7 aa, Artificial Sequence
  Synthetic construct
WVIPVFF

SEQ ID NO: 25383 - protein, 7 aa, Artificial Sequence
  Synthetic construct
WVIPVFY

SEQ ID NO: 25384 - protein, 7 aa, Artificial Sequence
  Synthetic construct
WVIPVRF

SEQ ID NO: 25385 - protein, 7 aa, Artificial Sequence
  Synthetic construct
WVIPVRY

SEQ ID NO: 25386 - protein, 7 aa, Artificial Sequence
  Synthetic construct
WVIPVCF

SEQ ID NO: 25387 - protein, 7 aa, Artificial Sequence
  Synthetic construct
WVIPVCY

SEQ ID NO: 25388 - protein, 7 aa, Artificial Sequence
  Synthetic construct
WVIPVLF

SEQ ID NO: 25389 - protein, 7 aa, Artificial Sequence
  Synthetic construct
WVIPVLY

SEQ ID NO: 25390 - protein, 7 aa, Artificial Sequence
  Synthetic construct
WVIPVAF

SEQ ID NO: 25391 - protein, 7 aa, Artificial Sequence
  Synthetic construct
WVIPVAY

SEQ ID NO: 25392 - protein, 7 aa, Artificial Sequence
  Synthetic construct
WVIPVQF

SEQ ID NO: 25393 - protein, 7 aa, Artificial Sequence
  Synthetic construct
WVIPVQY

SEQ ID NO: 25394 - protein, 7 aa, Artificial Sequence
  Synthetic construct
WVIPVDF

SEQ ID NO: 25395 - protein, 7 aa, Artificial Sequence
  Synthetic construct
WVIPVDY

SEQ ID NO: 25396 - protein, 7 aa, Artificial Sequence
  Synthetic construct
WVIPVVF

SEQ ID NO: 25397 - protein, 7 aa, Artificial Sequence
  Synthetic construct
WVIPVVY

SEQ ID NO: 25398 - protein, 7 aa, Artificial Sequence
  Synthetic construct
WVIPTFF

SEQ ID NO: 25399 - protein, 7 aa, Artificial Sequence
  Synthetic construct
WVIPTFY

SEQ ID NO: 25400 - protein, 7 aa, Artificial Sequence
  Synthetic construct
WVIPTRF

SEQ ID NO: 25401 - protein, 7 aa, Artificial Sequence
  Synthetic construct
WVIPTRY

SEQ ID NO: 25402 - protein, 7 aa, Artificial Sequence
  Synthetic construct
WVIPTCF

SEQ ID NO: 25403 - protein, 7 aa, Artificial Sequence
  Synthetic construct
WVIPTCY

SEQ ID NO: 25404 - protein, 7 aa, Artificial Sequence
  Synthetic construct
WVIPTLF

SEQ ID NO: 25405 - protein, 7 aa, Artificial Sequence
  Synthetic construct
WVIPTLY

SEQ ID NO: 25406 - protein, 7 aa, Artificial Sequence
  Synthetic construct
WVIPTAF

SEQ ID NO: 25407 - protein, 7 aa, Artificial Sequence
  Synthetic construct
WVIPTAY

SEQ ID NO: 25408 - protein, 7 aa, Artificial Sequence
  Synthetic construct
WVIPTQF

SEQ ID NO: 25409 - protein, 7 aa, Artificial Sequence
  Synthetic construct
WVIPTQY

SEQ ID NO: 25410 - protein, 7 aa, Artificial Sequence
  Synthetic construct
WVIPTDF

SEQ ID NO: 25411 - protein, 7 aa, Artificial Sequence
  Synthetic construct
WVIPTDY

SEQ ID NO: 25412 - protein, 7 aa, Artificial Sequence
  Synthetic construct
WVIPTVF

SEQ ID NO: 25413 - protein, 7 aa, Artificial Sequence
  Synthetic construct
WVIPTVY

SEQ ID NO: 25414 - protein, 7 aa, Artificial Sequence
  Synthetic construct
WVIPGFF

SEQ ID NO: 25415 - protein, 7 aa, Artificial Sequence
  Synthetic construct
WVIPGFY

SEQ ID NO: 25416 - protein, 7 aa, Artificial Sequence
  Synthetic construct
WVIPGRF

SEQ ID NO: 25417 - protein, 7 aa, Artificial Sequence
  Synthetic construct
WVIPGRY

SEQ ID NO: 25418 - protein, 7 aa, Artificial Sequence
  Synthetic construct
WVIPGCF

SEQ ID NO: 25419 - protein, 7 aa, Artificial Sequence
  Synthetic construct
WVIPGCY

SEQ ID NO: 25420 - protein, 7 aa, Artificial Sequence
  Synthetic construct
WVIPGLF

SEQ ID NO: 25421 - protein, 7 aa, Artificial Sequence
  Synthetic construct
WVIPGLY

SEQ ID NO: 25422 - protein, 7 aa, Artificial Sequence
  Synthetic construct
WVIPGAF

SEQ ID NO: 25423 - protein, 7 aa, Artificial Sequence
  Synthetic construct
WVIPGAY

SEQ ID NO: 25424 - protein, 7 aa, Artificial Sequence
  Synthetic construct
WVIPGQF

SEQ ID NO: 25425 - protein, 7 aa, Artificial Sequence
  Synthetic construct
WVIPGQY

SEQ ID NO: 25426 - protein, 7 aa, Artificial Sequence
  Synthetic construct
WVIPGDF

SEQ ID NO: 25427 - protein, 7 aa, Artificial Sequence
  Synthetic construct
WVIPGDY

SEQ ID NO: 25428 - protein, 7 aa, Artificial Sequence
  Synthetic construct
WVIPGVF

SEQ ID NO: 25429 - protein, 7 aa, Artificial Sequence
  Synthetic construct
WVIPGVY

SEQ ID NO: 25430 - protein, 7 aa, Artificial Sequence
  Synthetic construct
WVIPAFF

SEQ ID NO: 25431 - protein, 7 aa, Artificial Sequence
  Synthetic construct
WVIPAFY

SEQ ID NO: 25432 - protein, 7 aa, Artificial Sequence
  Synthetic construct
WVIPARF

SEQ ID NO: 25433 - protein, 7 aa, Artificial Sequence
  Synthetic construct
WVIPARY

SEQ ID NO: 25434 - protein, 7 aa, Artificial Sequence
  Synthetic construct
WVIPACF

SEQ ID NO: 25435 - protein, 7 aa, Artificial Sequence
  Synthetic construct
WVIPACY

SEQ ID NO: 25436 - protein, 7 aa, Artificial Sequence
  Synthetic construct
WVIPALF

SEQ ID NO: 25437 - protein, 7 aa, Artificial Sequence
  Synthetic construct
WVIPALY

SEQ ID NO: 25438 - protein, 7 aa, Artificial Sequence
  Synthetic construct
WVIPAAF

SEQ ID NO: 25439 - protein, 7 aa, Artificial Sequence
  Synthetic construct
WVIPAAY

SEQ ID NO: 25440 - protein, 7 aa, Artificial Sequence
  Synthetic construct
WVIPAQF

SEQ ID NO: 25441 - protein, 7 aa, Artificial Sequence
  Synthetic construct
WVIPAQY

SEQ ID NO: 25442 - protein, 7 aa, Artificial Sequence
  Synthetic construct
WVIPADF

SEQ ID NO: 25443 - protein, 7 aa, Artificial Sequence
  Synthetic construct
WVIPADY

SEQ ID NO: 25444 - protein, 7 aa, Artificial Sequence
  Synthetic construct
WVIPAVF

SEQ ID NO: 25445 - protein, 7 aa, Artificial Sequence
  Synthetic construct
WVIPAVY

SEQ ID NO: 25446 - protein, 7 aa, Artificial Sequence
  Synthetic construct
WVIPQFF

SEQ ID NO: 25447 - protein, 7 aa, Artificial Sequence
  Synthetic construct
WVIPQFY

SEQ ID NO: 25448 - protein, 7 aa, Artificial Sequence
  Synthetic construct
WVIPQRF

SEQ ID NO: 25449 - protein, 7 aa, Artificial Sequence
  Synthetic construct
WVIPQRY

SEQ ID NO: 25450 - protein, 7 aa, Artificial Sequence
  Synthetic construct
WVIPQCF

SEQ ID NO: 25451 - protein, 7 aa, Artificial Sequence
  Synthetic construct
WVIPQCY

SEQ ID NO: 25452 - protein, 7 aa, Artificial Sequence
  Synthetic construct
WVIPQLF

SEQ ID NO: 25453 - protein, 7 aa, Artificial Sequence
  Synthetic construct
WVIPQLY

SEQ ID NO: 25454 - protein, 7 aa, Artificial Sequence
  Synthetic construct
WVIPQAF

SEQ ID NO: 25455 - protein, 7 aa, Artificial Sequence
  Synthetic construct
WVIPQAY

SEQ ID NO: 25456 - protein, 7 aa, Artificial Sequence
  Synthetic construct
WVIPQQF

SEQ ID NO: 25457 - protein, 7 aa, Artificial Sequence
  Synthetic construct
WVIPQQY

SEQ ID NO: 25458 - protein, 7 aa, Artificial Sequence
  Synthetic construct
WVIPQDF

SEQ ID NO: 25459 - protein, 7 aa, Artificial Sequence
  Synthetic construct
WVIPQDY

SEQ ID NO: 25460 - protein, 7 aa, Artificial Sequence
  Synthetic construct
WVIPQVF

SEQ ID NO: 25461 - protein, 7 aa, Artificial Sequence
  Synthetic construct
WVIPQVY

SEQ ID NO: 25462 - protein, 7 aa, Artificial Sequence
  Synthetic construct
WVIHIFF

SEQ ID NO: 25463 - protein, 7 aa, Artificial Sequence
  Synthetic construct
WVIHIFY

SEQ ID NO: 25464 - protein, 7 aa, Artificial Sequence
  Synthetic construct
WVIHIRF

SEQ ID NO: 25465 - protein, 7 aa, Artificial Sequence
  Synthetic construct
WVIHIRY

SEQ ID NO: 25466 - protein, 7 aa, Artificial Sequence
  Synthetic construct
WVIHICF

SEQ ID NO: 25467 - protein, 7 aa, Artificial Sequence
  Synthetic construct
WVIHICY

SEQ ID NO: 25468 - protein, 7 aa, Artificial Sequence
  Synthetic construct
WVIHILF

SEQ ID NO: 25469 - protein, 7 aa, Artificial Sequence
  Synthetic construct
WVIHILY

SEQ ID NO: 25470 - protein, 7 aa, Artificial Sequence
  Synthetic construct
WVIHIAF

SEQ ID NO: 25471 - protein, 7 aa, Artificial Sequence
  Synthetic construct
WVIHIAY

SEQ ID NO: 25472 - protein, 7 aa, Artificial Sequence
  Synthetic construct
WVIHIQF

SEQ ID NO: 25473 - protein, 7 aa, Artificial Sequence
  Synthetic construct
WVIHIQY

SEQ ID NO: 25474 - protein, 7 aa, Artificial Sequence
  Synthetic construct
WVIHIDF

SEQ ID NO: 25475 - protein, 7 aa, Artificial Sequence
  Synthetic construct
WVIHIDY

SEQ ID NO: 25476 - protein, 7 aa, Artificial Sequence
  Synthetic construct
WVIHIVF

SEQ ID NO: 25477 - protein, 7 aa, Artificial Sequence
  Synthetic construct
WVIHIVY

SEQ ID NO: 25478 - protein, 7 aa, Artificial Sequence
  Synthetic construct
WVIHDFF

SEQ ID NO: 25479 - protein, 7 aa, Artificial Sequence
  Synthetic construct
WVIHDFY

SEQ ID NO: 25480 - protein, 7 aa, Artificial Sequence
  Synthetic construct
WVIHDRF

SEQ ID NO: 25481 - protein, 7 aa, Artificial Sequence
  Synthetic construct
WVIHDRY

SEQ ID NO: 25482 - protein, 7 aa, Artificial Sequence
  Synthetic construct
WVIHDCF

SEQ ID NO: 25483 - protein, 7 aa, Artificial Sequence
  Synthetic construct
WVIHDCY

SEQ ID NO: 25484 - protein, 7 aa, Artificial Sequence
  Synthetic construct
WVIHDLF

SEQ ID NO: 25485 - protein, 7 aa, Artificial Sequence
  Synthetic construct
WVIHDLY

SEQ ID NO: 25486 - protein, 7 aa, Artificial Sequence
  Synthetic construct
WVIHDAF

SEQ ID NO: 25487 - protein, 7 aa, Artificial Sequence
  Synthetic construct
WVIHDAY

SEQ ID NO: 25488 - protein, 7 aa, Artificial Sequence
  Synthetic construct
WVIHDQF

SEQ ID NO: 25489 - protein, 7 aa, Artificial Sequence
  Synthetic construct
WVIHDQY

SEQ ID NO: 25490 - protein, 7 aa, Artificial Sequence
  Synthetic construct
WVIHDDF

SEQ ID NO: 25491 - protein, 7 aa, Artificial Sequence
  Synthetic construct
WVIHDDY

SEQ ID NO: 25492 - protein, 7 aa, Artificial Sequence
  Synthetic construct
WVIHDVF

SEQ ID NO: 25493 - protein, 7 aa, Artificial Sequence
  Synthetic construct
WVIHDVY

SEQ ID NO: 25494 - protein, 7 aa, Artificial Sequence
  Synthetic construct
WVIHYFF

SEQ ID NO: 25495 - protein, 7 aa, Artificial Sequence
  Synthetic construct
WVIHYFY

SEQ ID NO: 25496 - protein, 7 aa, Artificial Sequence
  Synthetic construct
WVIHYRF

SEQ ID NO: 25497 - protein, 7 aa, Artificial Sequence
  Synthetic construct
WVIHYRY

SEQ ID NO: 25498 - protein, 7 aa, Artificial Sequence
  Synthetic construct
WVIHYCF

SEQ ID NO: 25499 - protein, 7 aa, Artificial Sequence
  Synthetic construct
WVIHYCY

SEQ ID NO: 25500 - protein, 7 aa, Artificial Sequence
  Synthetic construct
WVIHYLF

SEQ ID NO: 25501 - protein, 7 aa, Artificial Sequence
  Synthetic construct
WVIHYLY

SEQ ID NO: 25502 - protein, 7 aa, Artificial Sequence
  Synthetic construct
WVIHYAF

SEQ ID NO: 25503 - protein, 7 aa, Artificial Sequence
  Synthetic construct
WVIHYAY

SEQ ID NO: 25504 - protein, 7 aa, Artificial Sequence
  Synthetic construct
WVIHYQF

SEQ ID NO: 25505 - protein, 7 aa, Artificial Sequence
  Synthetic construct
WVIHYQY

SEQ ID NO: 25506 - protein, 7 aa, Artificial Sequence
  Synthetic construct
WVIHYDF

SEQ ID NO: 25507 - protein, 7 aa, Artificial Sequence
  Synthetic construct
WVIHYDY

SEQ ID NO: 25508 - protein, 7 aa, Artificial Sequence
  Synthetic construct
WVIHYVF

SEQ ID NO: 25509 - protein, 7 aa, Artificial Sequence
  Synthetic construct
WVIHYVY

SEQ ID NO: 25510 - protein, 7 aa, Artificial Sequence
  Synthetic construct
WVIHFFF

SEQ ID NO: 25511 - protein, 7 aa, Artificial Sequence
  Synthetic construct
WVIHFFY

SEQ ID NO: 25512 - protein, 7 aa, Artificial Sequence
  Synthetic construct
WVIHFRF

SEQ ID NO: 25513 - protein, 7 aa, Artificial Sequence
  Synthetic construct
WVIHFRY

SEQ ID NO: 25514 - protein, 7 aa, Artificial Sequence
  Synthetic construct
WVIHFCF

SEQ ID NO: 25515 - protein, 7 aa, Artificial Sequence
  Synthetic construct
WVIHFCY

SEQ ID NO: 25516 - protein, 7 aa, Artificial Sequence
  Synthetic construct
WVIHFLF

SEQ ID NO: 25517 - protein, 7 aa, Artificial Sequence
  Synthetic construct
WVIHFLY

SEQ ID NO: 25518 - protein, 7 aa, Artificial Sequence
  Synthetic construct
WVIHFAF

SEQ ID NO: 25519 - protein, 7 aa, Artificial Sequence
  Synthetic construct
WVIHFAY

SEQ ID NO: 25520 - protein, 7 aa, Artificial Sequence
  Synthetic construct
WVIHFQF

SEQ ID NO: 25521 - protein, 7 aa, Artificial Sequence
  Synthetic construct
WVIHFQY

SEQ ID NO: 25522 - protein, 7 aa, Artificial Sequence
  Synthetic construct
WVIHFDF

SEQ ID NO: 25523 - protein, 7 aa, Artificial Sequence
  Synthetic construct
WVIHFDY

SEQ ID NO: 25524 - protein, 7 aa, Artificial Sequence
  Synthetic construct
WVIHFVF

SEQ ID NO: 25525 - protein, 7 aa, Artificial Sequence
  Synthetic construct
WVIHFVY

SEQ ID NO: 25526 - protein, 7 aa, Artificial Sequence
  Synthetic construct
WVIHVFF

SEQ ID NO: 25527 - protein, 7 aa, Artificial Sequence
  Synthetic construct
WVIHVFY

SEQ ID NO: 25528 - protein, 7 aa, Artificial Sequence
  Synthetic construct
WVIHVRF

SEQ ID NO: 25529 - protein, 7 aa, Artificial Sequence
  Synthetic construct
WVIHVRY

SEQ ID NO: 25530 - protein, 7 aa, Artificial Sequence
  Synthetic construct
WVIHVCF

SEQ ID NO: 25531 - protein, 7 aa, Artificial Sequence
  Synthetic construct
WVIHVCY

SEQ ID NO: 25532 - protein, 7 aa, Artificial Sequence
  Synthetic construct
WVIHVLF

SEQ ID NO: 25533 - protein, 7 aa, Artificial Sequence
  Synthetic construct
WVIHVLY

SEQ ID NO: 25534 - protein, 7 aa, Artificial Sequence
  Synthetic construct
WVIHVAF

SEQ ID NO: 25535 - protein, 7 aa, Artificial Sequence
  Synthetic construct
WVIHVAY

SEQ ID NO: 25536 - protein, 7 aa, Artificial Sequence
  Synthetic construct
WVIHVQF

SEQ ID NO: 25537 - protein, 7 aa, Artificial Sequence
  Synthetic construct
WVIHVQY

SEQ ID NO: 25538 - protein, 7 aa, Artificial Sequence
  Synthetic construct
WVIHVDF

SEQ ID NO: 25539 - protein, 7 aa, Artificial Sequence
  Synthetic construct
WVIHVDY

SEQ ID NO: 25540 - protein, 7 aa, Artificial Sequence
  Synthetic construct
WVIHVVF

SEQ ID NO: 25541 - protein, 7 aa, Artificial Sequence
  Synthetic construct
WVIHVVY

SEQ ID NO: 25542 - protein, 7 aa, Artificial Sequence
  Synthetic construct
WVIHTFF

SEQ ID NO: 25543 - protein, 7 aa, Artificial Sequence
  Synthetic construct
WVIHTFY

SEQ ID NO: 25544 - protein, 7 aa, Artificial Sequence
  Synthetic construct
WVIHTRF

SEQ ID NO: 25545 - protein, 7 aa, Artificial Sequence
  Synthetic construct
WVIHTRY

SEQ ID NO: 25546 - protein, 7 aa, Artificial Sequence
  Synthetic construct
WVIHTCF

SEQ ID NO: 25547 - protein, 7 aa, Artificial Sequence
  Synthetic construct
WVIHTCY

SEQ ID NO: 25548 - protein, 7 aa, Artificial Sequence
  Synthetic construct
WVIHTLF

SEQ ID NO: 25549 - protein, 7 aa, Artificial Sequence
  Synthetic construct
WVIHTLY

SEQ ID NO: 25550 - protein, 7 aa, Artificial Sequence
  Synthetic construct
WVIHTAF

SEQ ID NO: 25551 - protein, 7 aa, Artificial Sequence
  Synthetic construct
WVIHTAY

SEQ ID NO: 25552 - protein, 7 aa, Artificial Sequence
  Synthetic construct
WVIHTQF

SEQ ID NO: 25553 - protein, 7 aa, Artificial Sequence
  Synthetic construct
WVIHTQY

SEQ ID NO: 25554 - protein, 7 aa, Artificial Sequence
  Synthetic construct
WVIHTDF

SEQ ID NO: 25555 - protein, 7 aa, Artificial Sequence
  Synthetic construct
WVIHTDY

SEQ ID NO: 25556 - protein, 7 aa, Artificial Sequence
  Synthetic construct
WVIHTVF

SEQ ID NO: 25557 - protein, 7 aa, Artificial Sequence
  Synthetic construct
WVIHTVY

SEQ ID NO: 25558 - protein, 7 aa, Artificial Sequence
  Synthetic construct
WVIHGFF

SEQ ID NO: 25559 - protein, 7 aa, Artificial Sequence
  Synthetic construct
WVIHGFY

SEQ ID NO: 25560 - protein, 7 aa, Artificial Sequence
  Synthetic construct
WVIHGRF

SEQ ID NO: 25561 - protein, 7 aa, Artificial Sequence
  Synthetic construct
WVIHGRY

SEQ ID NO: 25562 - protein, 7 aa, Artificial Sequence
  Synthetic construct
WVIHGCF

SEQ ID NO: 25563 - protein, 7 aa, Artificial Sequence
  Synthetic construct
WVIHGCY

SEQ ID NO: 25564 - protein, 7 aa, Artificial Sequence
  Synthetic construct
WVIHGLF

SEQ ID NO: 25565 - protein, 7 aa, Artificial Sequence
  Synthetic construct
WVIHGLY

SEQ ID NO: 25566 - protein, 7 aa, Artificial Sequence
  Synthetic construct
WVIHGAF

SEQ ID NO: 25567 - protein, 7 aa, Artificial Sequence
  Synthetic construct
WVIHGAY

SEQ ID NO: 25568 - protein, 7 aa, Artificial Sequence
  Synthetic construct
WVIHGQF

SEQ ID NO: 25569 - protein, 7 aa, Artificial Sequence
  Synthetic construct
WVIHGQY

SEQ ID NO: 25570 - protein, 7 aa, Artificial Sequence
  Synthetic construct
WVIHGDF

SEQ ID NO: 25571 - protein, 7 aa, Artificial Sequence
  Synthetic construct
WVIHGDY

SEQ ID NO: 25572 - protein, 7 aa, Artificial Sequence
  Synthetic construct
WVIHGVF

SEQ ID NO: 25573 - protein, 7 aa, Artificial Sequence
  Synthetic construct
WVIHGVY

SEQ ID NO: 25574 - protein, 7 aa, Artificial Sequence
  Synthetic construct
WVIHAFF

SEQ ID NO: 25575 - protein, 7 aa, Artificial Sequence
  Synthetic construct
WVIHAFY

SEQ ID NO: 25576 - protein, 7 aa, Artificial Sequence
  Synthetic construct
WVIHARF

SEQ ID NO: 25577 - protein, 7 aa, Artificial Sequence
  Synthetic construct
WVIHARY

SEQ ID NO: 25578 - protein, 7 aa, Artificial Sequence
  Synthetic construct
WVIHACF

SEQ ID NO: 25579 - protein, 7 aa, Artificial Sequence
  Synthetic construct
WVIHACY

SEQ ID NO: 25580 - protein, 7 aa, Artificial Sequence
  Synthetic construct
WVIHALF

SEQ ID NO: 25581 - protein, 7 aa, Artificial Sequence
  Synthetic construct
WVIHALY

SEQ ID NO: 25582 - protein, 7 aa, Artificial Sequence
  Synthetic construct
WVIHAAF

SEQ ID NO: 25583 - protein, 7 aa, Artificial Sequence
  Synthetic construct
WVIHAAY

SEQ ID NO: 25584 - protein, 7 aa, Artificial Sequence
  Synthetic construct
WVIHAQF

SEQ ID NO: 25585 - protein, 7 aa, Artificial Sequence
  Synthetic construct
WVIHAQY

SEQ ID NO: 25586 - protein, 7 aa, Artificial Sequence
  Synthetic construct
WVIHADF

SEQ ID NO: 25587 - protein, 7 aa, Artificial Sequence
  Synthetic construct
WVIHADY

SEQ ID NO: 25588 - protein, 7 aa, Artificial Sequence
  Synthetic construct
WVIHAVF

SEQ ID NO: 25589 - protein, 7 aa, Artificial Sequence
  Synthetic construct
WVIHAVY

SEQ ID NO: 25590 - protein, 7 aa, Artificial Sequence
  Synthetic construct
WVIHQFF

SEQ ID NO: 25591 - protein, 7 aa, Artificial Sequence
  Synthetic construct
WVIHQFY

SEQ ID NO: 25592 - protein, 7 aa, Artificial Sequence
  Synthetic construct
WVIHQRF

SEQ ID NO: 25593 - protein, 7 aa, Artificial Sequence
  Synthetic construct
WVIHQRY

SEQ ID NO: 25594 - protein, 7 aa, Artificial Sequence
  Synthetic construct
WVIHQCF

SEQ ID NO: 25595 - protein, 7 aa, Artificial Sequence
  Synthetic construct
WVIHQCY

SEQ ID NO: 25596 - protein, 7 aa, Artificial Sequence
  Synthetic construct
WVIHQLF

SEQ ID NO: 25597 - protein, 7 aa, Artificial Sequence
  Synthetic construct
WVIHQLY

SEQ ID NO: 25598 - protein, 7 aa, Artificial Sequence
  Synthetic construct
WVIHQAF

SEQ ID NO: 25599 - protein, 7 aa, Artificial Sequence
  Synthetic construct
WVIHQAY

SEQ ID NO: 25600 - protein, 7 aa, Artificial Sequence
  Synthetic construct
WVIHQQF

SEQ ID NO: 25601 - protein, 7 aa, Artificial Sequence
  Synthetic construct
WVIHQQY

SEQ ID NO: 25602 - protein, 7 aa, Artificial Sequence
  Synthetic construct
WVIHQDF

SEQ ID NO: 25603 - protein, 7 aa, Artificial Sequence
  Synthetic construct
WVIHQDY

SEQ ID NO: 25604 - protein, 7 aa, Artificial Sequence
  Synthetic construct
WVIHQVF

SEQ ID NO: 25605 - protein, 7 aa, Artificial Sequence
  Synthetic construct
WVIHQVY

SEQ ID NO: 25606 - protein, 7 aa, Artificial Sequence
  Synthetic construct
WVILIFF

SEQ ID NO: 25607 - protein, 7 aa, Artificial Sequence
  Synthetic construct
WVILIFY

SEQ ID NO: 25608 - protein, 7 aa, Artificial Sequence
  Synthetic construct
WVILIRF

SEQ ID NO: 25609 - protein, 7 aa, Artificial Sequence
  Synthetic construct
WVILIRY

SEQ ID NO: 25610 - protein, 7 aa, Artificial Sequence
  Synthetic construct
WVILICF

SEQ ID NO: 25611 - protein, 7 aa, Artificial Sequence
  Synthetic construct
WVILICY

SEQ ID NO: 25612 - protein, 7 aa, Artificial Sequence
  Synthetic construct
WVILILF

SEQ ID NO: 25613 - protein, 7 aa, Artificial Sequence
  Synthetic construct
WVILILY

SEQ ID NO: 25614 - protein, 7 aa, Artificial Sequence
  Synthetic construct
WVILIAF

SEQ ID NO: 25615 - protein, 7 aa, Artificial Sequence
  Synthetic construct
WVILIAY

SEQ ID NO: 25616 - protein, 7 aa, Artificial Sequence
  Synthetic construct
WVILIQF

SEQ ID NO: 25617 - protein, 7 aa, Artificial Sequence
  Synthetic construct
WVILIQY

SEQ ID NO: 25618 - protein, 7 aa, Artificial Sequence
  Synthetic construct
WVILIDF

SEQ ID NO: 25619 - protein, 7 aa, Artificial Sequence
  Synthetic construct
WVILIDY

SEQ ID NO: 25620 - protein, 7 aa, Artificial Sequence
  Synthetic construct
WVILIVF

SEQ ID NO: 25621 - protein, 7 aa, Artificial Sequence
  Synthetic construct
WVILIVY

SEQ ID NO: 25622 - protein, 7 aa, Artificial Sequence
  Synthetic construct
WVILDFF

SEQ ID NO: 25623 - protein, 7 aa, Artificial Sequence
  Synthetic construct
WVILDFY

SEQ ID NO: 25624 - protein, 7 aa, Artificial Sequence
  Synthetic construct
WVILDRF

SEQ ID NO: 25625 - protein, 7 aa, Artificial Sequence
  Synthetic construct
WVILDRY

SEQ ID NO: 25626 - protein, 7 aa, Artificial Sequence
  Synthetic construct
WVILDCF

SEQ ID NO: 25627 - protein, 7 aa, Artificial Sequence
  Synthetic construct
WVILDCY

SEQ ID NO: 25628 - protein, 7 aa, Artificial Sequence
  Synthetic construct
WVILDLF

SEQ ID NO: 25629 - protein, 7 aa, Artificial Sequence
  Synthetic construct
WVILDLY

SEQ ID NO: 25630 - protein, 7 aa, Artificial Sequence
  Synthetic construct
WVILDAF

SEQ ID NO: 25631 - protein, 7 aa, Artificial Sequence
  Synthetic construct
WVILDAY

SEQ ID NO: 25632 - protein, 7 aa, Artificial Sequence
  Synthetic construct
WVILDQF

SEQ ID NO: 25633 - protein, 7 aa, Artificial Sequence
  Synthetic construct
WVILDQY

SEQ ID NO: 25634 - protein, 7 aa, Artificial Sequence
  Synthetic construct
WVILDDF

SEQ ID NO: 25635 - protein, 7 aa, Artificial Sequence
  Synthetic construct
WVILDDY

SEQ ID NO: 25636 - protein, 7 aa, Artificial Sequence
  Synthetic construct
WVILDVF

SEQ ID NO: 25637 - protein, 7 aa, Artificial Sequence
  Synthetic construct
WVILDVY

SEQ ID NO: 25638 - protein, 7 aa, Artificial Sequence
  Synthetic construct
WVILYFF

SEQ ID NO: 25639 - protein, 7 aa, Artificial Sequence
  Synthetic construct
WVILYFY

SEQ ID NO: 25640 - protein, 7 aa, Artificial Sequence
  Synthetic construct
WVILYRF

SEQ ID NO: 25641 - protein, 7 aa, Artificial Sequence
  Synthetic construct
WVILYRY

SEQ ID NO: 25642 - protein, 7 aa, Artificial Sequence
  Synthetic construct
WVILYCF

SEQ ID NO: 25643 - protein, 7 aa, Artificial Sequence
  Synthetic construct
WVILYCY

SEQ ID NO: 25644 - protein, 7 aa, Artificial Sequence
  Synthetic construct
WVILYLF

SEQ ID NO: 25645 - protein, 7 aa, Artificial Sequence
  Synthetic construct
WVILYLY

SEQ ID NO: 25646 - protein, 7 aa, Artificial Sequence
  Synthetic construct
WVILYAF

SEQ ID NO: 25647 - protein, 7 aa, Artificial Sequence
  Synthetic construct
WVILYAY

SEQ ID NO: 25648 - protein, 7 aa, Artificial Sequence
  Synthetic construct
WVILYQF

SEQ ID NO: 25649 - protein, 7 aa, Artificial Sequence
  Synthetic construct
WVILYQY

SEQ ID NO: 25650 - protein, 7 aa, Artificial Sequence
  Synthetic construct
WVILYDF

SEQ ID NO: 25651 - protein, 7 aa, Artificial Sequence
  Synthetic construct
WVILYDY

SEQ ID NO: 25652 - protein, 7 aa, Artificial Sequence
  Synthetic construct
WVILYVF

SEQ ID NO: 25653 - protein, 7 aa, Artificial Sequence
  Synthetic construct
WVILYVY

SEQ ID NO: 25654 - protein, 7 aa, Artificial Sequence
  Synthetic construct
WVILFFF

SEQ ID NO: 25655 - protein, 7 aa, Artificial Sequence
  Synthetic construct
WVILFFY

SEQ ID NO: 25656 - protein, 7 aa, Artificial Sequence
  Synthetic construct
WVILFRF

SEQ ID NO: 25657 - protein, 7 aa, Artificial Sequence
  Synthetic construct
WVILFRY

SEQ ID NO: 25658 - protein, 7 aa, Artificial Sequence
  Synthetic construct
WVILFCF

SEQ ID NO: 25659 - protein, 7 aa, Artificial Sequence
  Synthetic construct
WVILFCY

SEQ ID NO: 25660 - protein, 7 aa, Artificial Sequence
  Synthetic construct
WVILFLF

SEQ ID NO: 25661 - protein, 7 aa, Artificial Sequence
  Synthetic construct
WVILFLY

SEQ ID NO: 25662 - protein, 7 aa, Artificial Sequence
  Synthetic construct
WVILFAF

SEQ ID NO: 25663 - protein, 7 aa, Artificial Sequence
  Synthetic construct
WVILFAY

SEQ ID NO: 25664 - protein, 7 aa, Artificial Sequence
  Synthetic construct
WVILFQF

SEQ ID NO: 25665 - protein, 7 aa, Artificial Sequence
  Synthetic construct
WVILFQY

SEQ ID NO: 25666 - protein, 7 aa, Artificial Sequence
  Synthetic construct
WVILFDF

SEQ ID NO: 25667 - protein, 7 aa, Artificial Sequence
  Synthetic construct
WVILFDY

SEQ ID NO: 25668 - protein, 7 aa, Artificial Sequence
  Synthetic construct
WVILFVF

SEQ ID NO: 25669 - protein, 7 aa, Artificial Sequence
  Synthetic construct
WVILFVY

SEQ ID NO: 25670 - protein, 7 aa, Artificial Sequence
  Synthetic construct
WVILVFF

SEQ ID NO: 25671 - protein, 7 aa, Artificial Sequence
  Synthetic construct
WVILVFY

SEQ ID NO: 25672 - protein, 7 aa, Artificial Sequence
  Synthetic construct
WVILVRF

SEQ ID NO: 25673 - protein, 7 aa, Artificial Sequence
  Synthetic construct
WVILVRY

SEQ ID NO: 25674 - protein, 7 aa, Artificial Sequence
  Synthetic construct
WVILVCF

SEQ ID NO: 25675 - protein, 7 aa, Artificial Sequence
  Synthetic construct
WVILVCY

SEQ ID NO: 25676 - protein, 7 aa, Artificial Sequence
  Synthetic construct
WVILVLF

SEQ ID NO: 25677 - protein, 7 aa, Artificial Sequence
  Synthetic construct
WVILVLY

SEQ ID NO: 25678 - protein, 7 aa, Artificial Sequence
  Synthetic construct
WVILVAF

SEQ ID NO: 25679 - protein, 7 aa, Artificial Sequence
  Synthetic construct
WVILVAY

SEQ ID NO: 25680 - protein, 7 aa, Artificial Sequence
  Synthetic construct
WVILVQF

SEQ ID NO: 25681 - protein, 7 aa, Artificial Sequence
  Synthetic construct
WVILVQY

SEQ ID NO: 25682 - protein, 7 aa, Artificial Sequence
  Synthetic construct
WVILVDF

SEQ ID NO: 25683 - protein, 7 aa, Artificial Sequence
  Synthetic construct
WVILVDY

SEQ ID NO: 25684 - protein, 7 aa, Artificial Sequence
  Synthetic construct
WVILVVF

SEQ ID NO: 25685 - protein, 7 aa, Artificial Sequence
  Synthetic construct
WVILVVY

SEQ ID NO: 25686 - protein, 7 aa, Artificial Sequence
  Synthetic construct
WVILTFF

SEQ ID NO: 25687 - protein, 7 aa, Artificial Sequence
  Synthetic construct
WVILTFY

SEQ ID NO: 25688 - protein, 7 aa, Artificial Sequence
  Synthetic construct
WVILTRF

SEQ ID NO: 25689 - protein, 7 aa, Artificial Sequence
  Synthetic construct
WVILTRY

SEQ ID NO: 25690 - protein, 7 aa, Artificial Sequence
  Synthetic construct
WVILTCF

SEQ ID NO: 25691 - protein, 7 aa, Artificial Sequence
  Synthetic construct
WVILTCY

SEQ ID NO: 25692 - protein, 7 aa, Artificial Sequence
  Synthetic construct
WVILTLF

SEQ ID NO: 25693 - protein, 7 aa, Artificial Sequence
  Synthetic construct
WVILTLY

SEQ ID NO: 25694 - protein, 7 aa, Artificial Sequence
  Synthetic construct
WVILTAF

SEQ ID NO: 25695 - protein, 7 aa, Artificial Sequence
  Synthetic construct
WVILTAY

SEQ ID NO: 25696 - protein, 7 aa, Artificial Sequence
  Synthetic construct
WVILTQF

SEQ ID NO: 25697 - protein, 7 aa, Artificial Sequence
  Synthetic construct
WVILTQY

SEQ ID NO: 25698 - protein, 7 aa, Artificial Sequence
  Synthetic construct
WVILTDF

SEQ ID NO: 25699 - protein, 7 aa, Artificial Sequence
  Synthetic construct
WVILTDY

SEQ ID NO: 25700 - protein, 7 aa, Artificial Sequence
  Synthetic construct
WVILTVF

SEQ ID NO: 25701 - protein, 7 aa, Artificial Sequence
  Synthetic construct
WVILTVY

SEQ ID NO: 25702 - protein, 7 aa, Artificial Sequence
  Synthetic construct
WVILGFF

SEQ ID NO: 25703 - protein, 7 aa, Artificial Sequence
  Synthetic construct
WVILGFY

SEQ ID NO: 25704 - protein, 7 aa, Artificial Sequence
  Synthetic construct
WVILGRF

SEQ ID NO: 25705 - protein, 7 aa, Artificial Sequence
  Synthetic construct
WVILGRY

SEQ ID NO: 25706 - protein, 7 aa, Artificial Sequence
  Synthetic construct
WVILGCF

SEQ ID NO: 25707 - protein, 7 aa, Artificial Sequence
  Synthetic construct
WVILGCY

SEQ ID NO: 25708 - protein, 7 aa, Artificial Sequence
  Synthetic construct
WVILGLF

SEQ ID NO: 25709 - protein, 7 aa, Artificial Sequence
  Synthetic construct
WVILGLY

SEQ ID NO: 25710 - protein, 7 aa, Artificial Sequence
  Synthetic construct
WVILGAF

SEQ ID NO: 25711 - protein, 7 aa, Artificial Sequence
  Synthetic construct
WVILGAY

SEQ ID NO: 25712 - protein, 7 aa, Artificial Sequence
  Synthetic construct
WVILGQF

SEQ ID NO: 25713 - protein, 7 aa, Artificial Sequence
  Synthetic construct
WVILGQY

SEQ ID NO: 25714 - protein, 7 aa, Artificial Sequence
  Synthetic construct
WVILGDF

SEQ ID NO: 25715 - protein, 7 aa, Artificial Sequence
  Synthetic construct
WVILGDY

SEQ ID NO: 25716 - protein, 7 aa, Artificial Sequence
  Synthetic construct
WVILGVF

SEQ ID NO: 25717 - protein, 7 aa, Artificial Sequence
  Synthetic construct
WVILGVY

SEQ ID NO: 25718 - protein, 7 aa, Artificial Sequence
  Synthetic construct
WVILAFF

SEQ ID NO: 25719 - protein, 7 aa, Artificial Sequence
  Synthetic construct
WVILAFY

SEQ ID NO: 25720 - protein, 7 aa, Artificial Sequence
  Synthetic construct
WVILARF

SEQ ID NO: 25721 - protein, 7 aa, Artificial Sequence
  Synthetic construct
WVILARY

SEQ ID NO: 25722 - protein, 7 aa, Artificial Sequence
  Synthetic construct
WVILACF

SEQ ID NO: 25723 - protein, 7 aa, Artificial Sequence
  Synthetic construct
WVILACY

SEQ ID NO: 25724 - protein, 7 aa, Artificial Sequence
  Synthetic construct
WVILALF

SEQ ID NO: 25725 - protein, 7 aa, Artificial Sequence
  Synthetic construct
WVILALY

SEQ ID NO: 25726 - protein, 7 aa, Artificial Sequence
  Synthetic construct
WVILAAF

SEQ ID NO: 25727 - protein, 7 aa, Artificial Sequence
  Synthetic construct
WVILAAY

SEQ ID NO: 25728 - protein, 7 aa, Artificial Sequence
  Synthetic construct
WVILAQF

SEQ ID NO: 25729 - protein, 7 aa, Artificial Sequence
  Synthetic construct
WVILAQY

SEQ ID NO: 25730 - protein, 7 aa, Artificial Sequence
  Synthetic construct
WVILADF

SEQ ID NO: 25731 - protein, 7 aa, Artificial Sequence
  Synthetic construct
WVILADY

SEQ ID NO: 25732 - protein, 7 aa, Artificial Sequence
  Synthetic construct
WVILAVF

SEQ ID NO: 25733 - protein, 7 aa, Artificial Sequence
  Synthetic construct
WVILAVY

SEQ ID NO: 25734 - protein, 7 aa, Artificial Sequence
  Synthetic construct
WVILQFF

SEQ ID NO: 25735 - protein, 7 aa, Artificial Sequence
  Synthetic construct
WVILQFY

SEQ ID NO: 25736 - protein, 7 aa, Artificial Sequence
  Synthetic construct
WVILQRF

SEQ ID NO: 25737 - protein, 7 aa, Artificial Sequence
  Synthetic construct
WVILQRY

SEQ ID NO: 25738 - protein, 7 aa, Artificial Sequence
  Synthetic construct
WVILQCF

SEQ ID NO: 25739 - protein, 7 aa, Artificial Sequence
  Synthetic construct
WVILQCY

SEQ ID NO: 25740 - protein, 7 aa, Artificial Sequence
  Synthetic construct
WVILQLF

SEQ ID NO: 25741 - protein, 7 aa, Artificial Sequence
  Synthetic construct
WVILQLY

SEQ ID NO: 25742 - protein, 7 aa, Artificial Sequence
  Synthetic construct
WVILQAF

SEQ ID NO: 25743 - protein, 7 aa, Artificial Sequence
  Synthetic construct
WVILQAY

SEQ ID NO: 25744 - protein, 7 aa, Artificial Sequence
  Synthetic construct
WVILQQF

SEQ ID NO: 25745 - protein, 7 aa, Artificial Sequence
  Synthetic construct
WVILQQY

SEQ ID NO: 25746 - protein, 7 aa, Artificial Sequence
  Synthetic construct
WVILQDF

SEQ ID NO: 25747 - protein, 7 aa, Artificial Sequence
  Synthetic construct
WVILQDY

SEQ ID NO: 25748 - protein, 7 aa, Artificial Sequence
  Synthetic construct
WVILQVF

SEQ ID NO: 25749 - protein, 7 aa, Artificial Sequence
  Synthetic construct
WVILQVY

SEQ ID NO: 25750 - protein, 7 aa, Artificial Sequence
  Synthetic construct
WVIFIFF

SEQ ID NO: 25751 - protein, 7 aa, Artificial Sequence
  Synthetic construct
WVIFIFY

SEQ ID NO: 25752 - protein, 7 aa, Artificial Sequence
  Synthetic construct
WVIFIRF

SEQ ID NO: 25753 - protein, 7 aa, Artificial Sequence
  Synthetic construct
WVIFIRY

SEQ ID NO: 25754 - protein, 7 aa, Artificial Sequence
  Synthetic construct
WVIFICF

SEQ ID NO: 25755 - protein, 7 aa, Artificial Sequence
  Synthetic construct
WVIFICY

SEQ ID NO: 25756 - protein, 7 aa, Artificial Sequence
  Synthetic construct
WVIFILF

SEQ ID NO: 25757 - protein, 7 aa, Artificial Sequence
  Synthetic construct
WVIFILY

SEQ ID NO: 25758 - protein, 7 aa, Artificial Sequence
  Synthetic construct
WVIFIAF

SEQ ID NO: 25759 - protein, 7 aa, Artificial Sequence
  Synthetic construct
WVIFIAY

SEQ ID NO: 25760 - protein, 7 aa, Artificial Sequence
  Synthetic construct
WVIFIQF

SEQ ID NO: 25761 - protein, 7 aa, Artificial Sequence
  Synthetic construct
WVIFIQY

SEQ ID NO: 25762 - protein, 7 aa, Artificial Sequence
  Synthetic construct
WVIFIDF

SEQ ID NO: 25763 - protein, 7 aa, Artificial Sequence
  Synthetic construct
WVIFIDY

SEQ ID NO: 25764 - protein, 7 aa, Artificial Sequence
  Synthetic construct
WVIFIVF

SEQ ID NO: 25765 - protein, 7 aa, Artificial Sequence
  Synthetic construct
WVIFIVY

SEQ ID NO: 25766 - protein, 7 aa, Artificial Sequence
  Synthetic construct
WVIFDFF

SEQ ID NO: 25767 - protein, 7 aa, Artificial Sequence
  Synthetic construct
WVIFDFY

SEQ ID NO: 25768 - protein, 7 aa, Artificial Sequence
  Synthetic construct
WVIFDRF

SEQ ID NO: 25769 - protein, 7 aa, Artificial Sequence
  Synthetic construct
WVIFDRY

SEQ ID NO: 25770 - protein, 7 aa, Artificial Sequence
  Synthetic construct
WVIFDCF

SEQ ID NO: 25771 - protein, 7 aa, Artificial Sequence
  Synthetic construct
WVIFDCY

SEQ ID NO: 25772 - protein, 7 aa, Artificial Sequence
  Synthetic construct
WVIFDLF

SEQ ID NO: 25773 - protein, 7 aa, Artificial Sequence
  Synthetic construct
WVIFDLY

SEQ ID NO: 25774 - protein, 7 aa, Artificial Sequence
  Synthetic construct
WVIFDAF

SEQ ID NO: 25775 - protein, 7 aa, Artificial Sequence
  Synthetic construct
WVIFDAY

SEQ ID NO: 25776 - protein, 7 aa, Artificial Sequence
  Synthetic construct
WVIFDQF

SEQ ID NO: 25777 - protein, 7 aa, Artificial Sequence
  Synthetic construct
WVIFDQY

SEQ ID NO: 25778 - protein, 7 aa, Artificial Sequence
  Synthetic construct
WVIFDDF

SEQ ID NO: 25779 - protein, 7 aa, Artificial Sequence
  Synthetic construct
WVIFDDY

SEQ ID NO: 25780 - protein, 7 aa, Artificial Sequence
  Synthetic construct
WVIFDVF

SEQ ID NO: 25781 - protein, 7 aa, Artificial Sequence
  Synthetic construct
WVIFDVY

SEQ ID NO: 25782 - protein, 7 aa, Artificial Sequence
  Synthetic construct
WVIFYFF

SEQ ID NO: 25783 - protein, 7 aa, Artificial Sequence
  Synthetic construct
WVIFYFY

SEQ ID NO: 25784 - protein, 7 aa, Artificial Sequence
  Synthetic construct
WVIFYRF

SEQ ID NO: 25785 - protein, 7 aa, Artificial Sequence
  Synthetic construct
WVIFYRY

SEQ ID NO: 25786 - protein, 7 aa, Artificial Sequence
  Synthetic construct
WVIFYCF

SEQ ID NO: 25787 - protein, 7 aa, Artificial Sequence
  Synthetic construct
WVIFYCY

SEQ ID NO: 25788 - protein, 7 aa, Artificial Sequence
  Synthetic construct
WVIFYLF

SEQ ID NO: 25789 - protein, 7 aa, Artificial Sequence
  Synthetic construct
WVIFYLY

SEQ ID NO: 25790 - protein, 7 aa, Artificial Sequence
  Synthetic construct
WVIFYAF

SEQ ID NO: 25791 - protein, 7 aa, Artificial Sequence
  Synthetic construct
WVIFYAY

SEQ ID NO: 25792 - protein, 7 aa, Artificial Sequence
  Synthetic construct
WVIFYQF

SEQ ID NO: 25793 - protein, 7 aa, Artificial Sequence
  Synthetic construct
WVIFYQY

SEQ ID NO: 25794 - protein, 7 aa, Artificial Sequence
  Synthetic construct
WVIFYDF

SEQ ID NO: 25795 - protein, 7 aa, Artificial Sequence
  Synthetic construct
WVIFYDY

SEQ ID NO: 25796 - protein, 7 aa, Artificial Sequence
  Synthetic construct
WVIFYVF

SEQ ID NO: 25797 - protein, 7 aa, Artificial Sequence
  Synthetic construct
WVIFYVY

SEQ ID NO: 25798 - protein, 7 aa, Artificial Sequence
  Synthetic construct
WVIFFFF

SEQ ID NO: 25799 - protein, 7 aa, Artificial Sequence
  Synthetic construct
WVIFFFY

SEQ ID NO: 25800 - protein, 7 aa, Artificial Sequence
  Synthetic construct
WVIFFRF

SEQ ID NO: 25801 - protein, 7 aa, Artificial Sequence
  Synthetic construct
WVIFFRY

SEQ ID NO: 25802 - protein, 7 aa, Artificial Sequence
  Synthetic construct
WVIFFCF

SEQ ID NO: 25803 - protein, 7 aa, Artificial Sequence
  Synthetic construct
WVIFFCY

SEQ ID NO: 25804 - protein, 7 aa, Artificial Sequence
  Synthetic construct
WVIFFLF

SEQ ID NO: 25805 - protein, 7 aa, Artificial Sequence
  Synthetic construct
WVIFFLY

SEQ ID NO: 25806 - protein, 7 aa, Artificial Sequence
  Synthetic construct
WVIFFAF

SEQ ID NO: 25807 - protein, 7 aa, Artificial Sequence
  Synthetic construct
WVIFFAY

SEQ ID NO: 25808 - protein, 7 aa, Artificial Sequence
  Synthetic construct
WVIFFQF

SEQ ID NO: 25809 - protein, 7 aa, Artificial Sequence
  Synthetic construct
WVIFFQY

SEQ ID NO: 25810 - protein, 7 aa, Artificial Sequence
  Synthetic construct
WVIFFDF

SEQ ID NO: 25811 - protein, 7 aa, Artificial Sequence
  Synthetic construct
WVIFFDY

SEQ ID NO: 25812 - protein, 7 aa, Artificial Sequence
  Synthetic construct
WVIFFVF

SEQ ID NO: 25813 - protein, 7 aa, Artificial Sequence
  Synthetic construct
WVIFFVY

SEQ ID NO: 25814 - protein, 7 aa, Artificial Sequence
  Synthetic construct
WVIFVFF

SEQ ID NO: 25815 - protein, 7 aa, Artificial Sequence
  Synthetic construct
WVIFVFY

SEQ ID NO: 25816 - protein, 7 aa, Artificial Sequence
  Synthetic construct
WVIFVRF

SEQ ID NO: 25817 - protein, 7 aa, Artificial Sequence
  Synthetic construct
WVIFVRY

SEQ ID NO: 25818 - protein, 7 aa, Artificial Sequence
  Synthetic construct
WVIFVCF

SEQ ID NO: 25819 - protein, 7 aa, Artificial Sequence
  Synthetic construct
WVIFVCY

SEQ ID NO: 25820 - protein, 7 aa, Artificial Sequence
  Synthetic construct
WVIFVLF

SEQ ID NO: 25821 - protein, 7 aa, Artificial Sequence
  Synthetic construct
WVIFVLY

SEQ ID NO: 25822 - protein, 7 aa, Artificial Sequence
  Synthetic construct
WVIFVAF

SEQ ID NO: 25823 - protein, 7 aa, Artificial Sequence
  Synthetic construct
WVIFVAY

SEQ ID NO: 25824 - protein, 7 aa, Artificial Sequence
  Synthetic construct
WVIFVQF

SEQ ID NO: 25825 - protein, 7 aa, Artificial Sequence
  Synthetic construct
WVIFVQY

SEQ ID NO: 25826 - protein, 7 aa, Artificial Sequence
  Synthetic construct
WVIFVDF

SEQ ID NO: 25827 - protein, 7 aa, Artificial Sequence
  Synthetic construct
WVIFVDY

SEQ ID NO: 25828 - protein, 7 aa, Artificial Sequence
  Synthetic construct
WVIFVVF

SEQ ID NO: 25829 - protein, 7 aa, Artificial Sequence
  Synthetic construct
WVIFVVY

SEQ ID NO: 25830 - protein, 7 aa, Artificial Sequence
  Synthetic construct
WVIFTFF

SEQ ID NO: 25831 - protein, 7 aa, Artificial Sequence
  Synthetic construct
WVIFTFY

SEQ ID NO: 25832 - protein, 7 aa, Artificial Sequence
  Synthetic construct
WVIFTRF

SEQ ID NO: 25833 - protein, 7 aa, Artificial Sequence
  Synthetic construct
WVIFTRY

SEQ ID NO: 25834 - protein, 7 aa, Artificial Sequence
  Synthetic construct
WVIFTCF

SEQ ID NO: 25835 - protein, 7 aa, Artificial Sequence
  Synthetic construct
WVIFTCY

SEQ ID NO: 25836 - protein, 7 aa, Artificial Sequence
  Synthetic construct
WVIFTLF

SEQ ID NO: 25837 - protein, 7 aa, Artificial Sequence
  Synthetic construct
WVIFTLY

SEQ ID NO: 25838 - protein, 7 aa, Artificial Sequence
  Synthetic construct
WVIFTAF

SEQ ID NO: 25839 - protein, 7 aa, Artificial Sequence
  Synthetic construct
WVIFTAY

SEQ ID NO: 25840 - protein, 7 aa, Artificial Sequence
  Synthetic construct
WVIFTQF

SEQ ID NO: 25841 - protein, 7 aa, Artificial Sequence
  Synthetic construct
WVIFTQY

SEQ ID NO: 25842 - protein, 7 aa, Artificial Sequence
  Synthetic construct
WVIFTDF

SEQ ID NO: 25843 - protein, 7 aa, Artificial Sequence
  Synthetic construct
WVIFTDY

SEQ ID NO: 25844 - protein, 7 aa, Artificial Sequence
  Synthetic construct
WVIFTVF

SEQ ID NO: 25845 - protein, 7 aa, Artificial Sequence
  Synthetic construct
WVIFTVY

SEQ ID NO: 25846 - protein, 7 aa, Artificial Sequence
  Synthetic construct
WVIFGFF

SEQ ID NO: 25847 - protein, 7 aa, Artificial Sequence
  Synthetic construct
WVIFGFY

SEQ ID NO: 25848 - protein, 7 aa, Artificial Sequence
  Synthetic construct
WVIFGRF

SEQ ID NO: 25849 - protein, 7 aa, Artificial Sequence
  Synthetic construct
WVIFGRY

SEQ ID NO: 25850 - protein, 7 aa, Artificial Sequence
  Synthetic construct
WVIFGCF

SEQ ID NO: 25851 - protein, 7 aa, Artificial Sequence
  Synthetic construct
WVIFGCY

SEQ ID NO: 25852 - protein, 7 aa, Artificial Sequence
  Synthetic construct
WVIFGLF

SEQ ID NO: 25853 - protein, 7 aa, Artificial Sequence
  Synthetic construct
WVIFGLY

SEQ ID NO: 25854 - protein, 7 aa, Artificial Sequence
  Synthetic construct
WVIFGAF

SEQ ID NO: 25855 - protein, 7 aa, Artificial Sequence
  Synthetic construct
WVIFGAY

SEQ ID NO: 25856 - protein, 7 aa, Artificial Sequence
  Synthetic construct
WVIFGQF

SEQ ID NO: 25857 - protein, 7 aa, Artificial Sequence
  Synthetic construct
WVIFGQY

SEQ ID NO: 25858 - protein, 7 aa, Artificial Sequence
  Synthetic construct
WVIFGDF

SEQ ID NO: 25859 - protein, 7 aa, Artificial Sequence
  Synthetic construct
WVIFGDY

SEQ ID NO: 25860 - protein, 7 aa, Artificial Sequence
  Synthetic construct
WVIFGVF

SEQ ID NO: 25861 - protein, 7 aa, Artificial Sequence
  Synthetic construct
WVIFGVY

SEQ ID NO: 25862 - protein, 7 aa, Artificial Sequence
  Synthetic construct
WVIFAFF

SEQ ID NO: 25863 - protein, 7 aa, Artificial Sequence
  Synthetic construct
WVIFAFY

SEQ ID NO: 25864 - protein, 7 aa, Artificial Sequence
  Synthetic construct
WVIFARF

SEQ ID NO: 25865 - protein, 7 aa, Artificial Sequence
  Synthetic construct
WVIFARY

SEQ ID NO: 25866 - protein, 7 aa, Artificial Sequence
  Synthetic construct
WVIFACF

SEQ ID NO: 25867 - protein, 7 aa, Artificial Sequence
  Synthetic construct
WVIFACY

SEQ ID NO: 25868 - protein, 7 aa, Artificial Sequence
  Synthetic construct
WVIFALF

SEQ ID NO: 25869 - protein, 7 aa, Artificial Sequence
  Synthetic construct
WVIFALY

SEQ ID NO: 25870 - protein, 7 aa, Artificial Sequence
  Synthetic construct
WVIFAAF

SEQ ID NO: 25871 - protein, 7 aa, Artificial Sequence
  Synthetic construct
WVIFAAY

SEQ ID NO: 25872 - protein, 7 aa, Artificial Sequence
  Synthetic construct
WVIFAQF

SEQ ID NO: 25873 - protein, 7 aa, Artificial Sequence
  Synthetic construct
WVIFAQY

SEQ ID NO: 25874 - protein, 7 aa, Artificial Sequence
  Synthetic construct
WVIFADF

SEQ ID NO: 25875 - protein, 7 aa, Artificial Sequence
  Synthetic construct
WVIFADY

SEQ ID NO: 25876 - protein, 7 aa, Artificial Sequence
  Synthetic construct
WVIFAVF

SEQ ID NO: 25877 - protein, 7 aa, Artificial Sequence
  Synthetic construct
WVIFAVY

SEQ ID NO: 25878 - protein, 7 aa, Artificial Sequence
  Synthetic construct
WVIFQFF

SEQ ID NO: 25879 - protein, 7 aa, Artificial Sequence
  Synthetic construct
WVIFQFY

SEQ ID NO: 25880 - protein, 7 aa, Artificial Sequence
  Synthetic construct
WVIFQRF

SEQ ID NO: 25881 - protein, 7 aa, Artificial Sequence
  Synthetic construct
WVIFQRY

SEQ ID NO: 25882 - protein, 7 aa, Artificial Sequence
  Synthetic construct
WVIFQCF

SEQ ID NO: 25883 - protein, 7 aa, Artificial Sequence
  Synthetic construct
WVIFQCY

SEQ ID NO: 25884 - protein, 7 aa, Artificial Sequence
  Synthetic construct
WVIFQLF

SEQ ID NO: 25885 - protein, 7 aa, Artificial Sequence
  Synthetic construct
WVIFQLY

SEQ ID NO: 25886 - protein, 7 aa, Artificial Sequence
  Synthetic construct
WVIFQAF

SEQ ID NO: 25887 - protein, 7 aa, Artificial Sequence
  Synthetic construct
WVIFQAY

SEQ ID NO: 25888 - protein, 7 aa, Artificial Sequence
  Synthetic construct
WVIFQQF

SEQ ID NO: 25889 - protein, 7 aa, Artificial Sequence
  Synthetic construct
WVIFQQY

SEQ ID NO: 25890 - protein, 7 aa, Artificial Sequence
  Synthetic construct
WVIFQDF

SEQ ID NO: 25891 - protein, 7 aa, Artificial Sequence
  Synthetic construct
WVIFQDY

SEQ ID NO: 25892 - protein, 7 aa, Artificial Sequence
  Synthetic construct
WVIFQVF

SEQ ID NO: 25893 - protein, 7 aa, Artificial Sequence
  Synthetic construct
WVIFQVY

SEQ ID NO: 25894 - protein, 7 aa, Artificial Sequence
  Synthetic construct
WVGYIFF

SEQ ID NO: 25895 - protein, 7 aa, Artificial Sequence
  Synthetic construct
WVGYIFY

SEQ ID NO: 25896 - protein, 7 aa, Artificial Sequence
  Synthetic construct
WVGYIRF

SEQ ID NO: 25897 - protein, 7 aa, Artificial Sequence
  Synthetic construct
WVGYIRY

SEQ ID NO: 25898 - protein, 7 aa, Artificial Sequence
  Synthetic construct
WVGYICF

SEQ ID NO: 25899 - protein, 7 aa, Artificial Sequence
  Synthetic construct
WVGYICY

SEQ ID NO: 25900 - protein, 7 aa, Artificial Sequence
  Synthetic construct
WVGYILF

SEQ ID NO: 25901 - protein, 7 aa, Artificial Sequence
  Synthetic construct
WVGYILY

SEQ ID NO: 25902 - protein, 7 aa, Artificial Sequence
  Synthetic construct
WVGYIAF

SEQ ID NO: 25903 - protein, 7 aa, Artificial Sequence
  Synthetic construct
WVGYIAY

SEQ ID NO: 25904 - protein, 7 aa, Artificial Sequence
  Synthetic construct
WVGYIQF

SEQ ID NO: 25905 - protein, 7 aa, Artificial Sequence
  Synthetic construct
WVGYIQY

SEQ ID NO: 25906 - protein, 7 aa, Artificial Sequence
  Synthetic construct
WVGYIDF

SEQ ID NO: 25907 - protein, 7 aa, Artificial Sequence
  Synthetic construct
WVGYIDY

SEQ ID NO: 25908 - protein, 7 aa, Artificial Sequence
  Synthetic construct
WVGYIVF

SEQ ID NO: 25909 - protein, 7 aa, Artificial Sequence
  Synthetic construct
WVGYIVY

SEQ ID NO: 25910 - protein, 7 aa, Artificial Sequence
  Synthetic construct
WVGYDFF

SEQ ID NO: 25911 - protein, 7 aa, Artificial Sequence
  Synthetic construct
WVGYDFY

SEQ ID NO: 25912 - protein, 7 aa, Artificial Sequence
  Synthetic construct
WVGYDRF

SEQ ID NO: 25913 - protein, 7 aa, Artificial Sequence
  Synthetic construct
WVGYDRY

SEQ ID NO: 25914 - protein, 7 aa, Artificial Sequence
  Synthetic construct
WVGYDCF

SEQ ID NO: 25915 - protein, 7 aa, Artificial Sequence
  Synthetic construct
WVGYDCY

SEQ ID NO: 25916 - protein, 7 aa, Artificial Sequence
  Synthetic construct
WVGYDLF

SEQ ID NO: 25917 - protein, 7 aa, Artificial Sequence
  Synthetic construct
WVGYDLY

SEQ ID NO: 25918 - protein, 7 aa, Artificial Sequence
  Synthetic construct
WVGYDAF

SEQ ID NO: 25919 - protein, 7 aa, Artificial Sequence
  Synthetic construct
WVGYDAY

SEQ ID NO: 25920 - protein, 7 aa, Artificial Sequence
  Synthetic construct
WVGYDQF

SEQ ID NO: 25921 - protein, 7 aa, Artificial Sequence
  Synthetic construct
WVGYDQY

SEQ ID NO: 25922 - protein, 7 aa, Artificial Sequence
  Synthetic construct
WVGYDDF

SEQ ID NO: 25923 - protein, 7 aa, Artificial Sequence
  Synthetic construct
WVGYDDY

SEQ ID NO: 25924 - protein, 7 aa, Artificial Sequence
  Synthetic construct
WVGYDVF

SEQ ID NO: 25925 - protein, 7 aa, Artificial Sequence
  Synthetic construct
WVGYDVY

SEQ ID NO: 25926 - protein, 7 aa, Artificial Sequence
  Synthetic construct
WVGYYFF

SEQ ID NO: 25927 - protein, 7 aa, Artificial Sequence
  Synthetic construct
WVGYYFY

SEQ ID NO: 25928 - protein, 7 aa, Artificial Sequence
  Synthetic construct
WVGYYRF

SEQ ID NO: 25929 - protein, 7 aa, Artificial Sequence
  Synthetic construct
WVGYYRY

SEQ ID NO: 25930 - protein, 7 aa, Artificial Sequence
  Synthetic construct
WVGYYCF

SEQ ID NO: 25931 - protein, 7 aa, Artificial Sequence
  Synthetic construct
WVGYYCY

SEQ ID NO: 25932 - protein, 7 aa, Artificial Sequence
  Synthetic construct
WVGYYLF

SEQ ID NO: 25933 - protein, 7 aa, Artificial Sequence
  Synthetic construct
WVGYYLY

SEQ ID NO: 25934 - protein, 7 aa, Artificial Sequence
  Synthetic construct
WVGYYAF

SEQ ID NO: 25935 - protein, 7 aa, Artificial Sequence
  Synthetic construct
WVGYYAY

SEQ ID NO: 25936 - protein, 7 aa, Artificial Sequence
  Synthetic construct
WVGYYQF

SEQ ID NO: 25937 - protein, 7 aa, Artificial Sequence
  Synthetic construct
WVGYYQY

SEQ ID NO: 25938 - protein, 7 aa, Artificial Sequence
  Synthetic construct
WVGYYDF

SEQ ID NO: 25939 - protein, 7 aa, Artificial Sequence
  Synthetic construct
WVGYYDY

SEQ ID NO: 25940 - protein, 7 aa, Artificial Sequence
  Synthetic construct
WVGYYVF

SEQ ID NO: 25941 - protein, 7 aa, Artificial Sequence
  Synthetic construct
WVGYYVY

SEQ ID NO: 25942 - protein, 7 aa, Artificial Sequence
  Synthetic construct
WVGYFFF

SEQ ID NO: 25943 - protein, 7 aa, Artificial Sequence
  Synthetic construct
WVGYFFY

SEQ ID NO: 25944 - protein, 7 aa, Artificial Sequence
  Synthetic construct
WVGYFRF

SEQ ID NO: 25945 - protein, 7 aa, Artificial Sequence
  Synthetic construct
WVGYFRY

SEQ ID NO: 25946 - protein, 7 aa, Artificial Sequence
  Synthetic construct
WVGYFCF

SEQ ID NO: 25947 - protein, 7 aa, Artificial Sequence
  Synthetic construct
WVGYFCY

SEQ ID NO: 25948 - protein, 7 aa, Artificial Sequence
  Synthetic construct
WVGYFLF

SEQ ID NO: 25949 - protein, 7 aa, Artificial Sequence
  Synthetic construct
WVGYFLY

SEQ ID NO: 25950 - protein, 7 aa, Artificial Sequence
  Synthetic construct
WVGYFAF

SEQ ID NO: 25951 - protein, 7 aa, Artificial Sequence
  Synthetic construct
WVGYFAY

SEQ ID NO: 25952 - protein, 7 aa, Artificial Sequence
  Synthetic construct
WVGYFQF

SEQ ID NO: 25953 - protein, 7 aa, Artificial Sequence
  Synthetic construct
WVGYFQY

SEQ ID NO: 25954 - protein, 7 aa, Artificial Sequence
  Synthetic construct
WVGYFDF

SEQ ID NO: 25955 - protein, 7 aa, Artificial Sequence
  Synthetic construct
WVGYFDY

SEQ ID NO: 25956 - protein, 7 aa, Artificial Sequence
  Synthetic construct
WVGYFVF

SEQ ID NO: 25957 - protein, 7 aa, Artificial Sequence
  Synthetic construct
WVGYFVY

SEQ ID NO: 25958 - protein, 7 aa, Artificial Sequence
  Synthetic construct
WVGYVFF

SEQ ID NO: 25959 - protein, 7 aa, Artificial Sequence
  Synthetic construct
WVGYVFY

SEQ ID NO: 25960 - protein, 7 aa, Artificial Sequence
  Synthetic construct
WVGYVRF

SEQ ID NO: 25961 - protein, 7 aa, Artificial Sequence
  Synthetic construct
WVGYVRY

SEQ ID NO: 25962 - protein, 7 aa, Artificial Sequence
  Synthetic construct
WVGYVCF

SEQ ID NO: 25963 - protein, 7 aa, Artificial Sequence
  Synthetic construct
WVGYVCY

SEQ ID NO: 25964 - protein, 7 aa, Artificial Sequence
  Synthetic construct
WVGYVLF

SEQ ID NO: 25965 - protein, 7 aa, Artificial Sequence
  Synthetic construct
WVGYVLY

SEQ ID NO: 25966 - protein, 7 aa, Artificial Sequence
  Synthetic construct
WVGYVAF

SEQ ID NO: 25967 - protein, 7 aa, Artificial Sequence
  Synthetic construct
WVGYVAY

SEQ ID NO: 25968 - protein, 7 aa, Artificial Sequence
  Synthetic construct
WVGYVQF

SEQ ID NO: 25969 - protein, 7 aa, Artificial Sequence
  Synthetic construct
WVGYVQY

SEQ ID NO: 25970 - protein, 7 aa, Artificial Sequence
  Synthetic construct
WVGYVDF

SEQ ID NO: 25971 - protein, 7 aa, Artificial Sequence
  Synthetic construct
WVGYVDY

SEQ ID NO: 25972 - protein, 7 aa, Artificial Sequence
  Synthetic construct
WVGYVVF

SEQ ID NO: 25973 - protein, 7 aa, Artificial Sequence
  Synthetic construct
WVGYVVY

SEQ ID NO: 25974 - protein, 7 aa, Artificial Sequence
  Synthetic construct
WVGYTFF

SEQ ID NO: 25975 - protein, 7 aa, Artificial Sequence
  Synthetic construct
WVGYTFY

SEQ ID NO: 25976 - protein, 7 aa, Artificial Sequence
  Synthetic construct
WVGYTRF

SEQ ID NO: 25977 - protein, 7 aa, Artificial Sequence
  Synthetic construct
WVGYTRY

SEQ ID NO: 25978 - protein, 7 aa, Artificial Sequence
  Synthetic construct
WVGYTCF

SEQ ID NO: 25979 - protein, 7 aa, Artificial Sequence
  Synthetic construct
WVGYTCY

SEQ ID NO: 25980 - protein, 7 aa, Artificial Sequence
  Synthetic construct
WVGYTLF

SEQ ID NO: 25981 - protein, 7 aa, Artificial Sequence
  Synthetic construct
WVGYTLY

SEQ ID NO: 25982 - protein, 7 aa, Artificial Sequence
  Synthetic construct
WVGYTAF

SEQ ID NO: 25983 - protein, 7 aa, Artificial Sequence
  Synthetic construct
WVGYTAY

SEQ ID NO: 25984 - protein, 7 aa, Artificial Sequence
  Synthetic construct
WVGYTQF

SEQ ID NO: 25985 - protein, 7 aa, Artificial Sequence
  Synthetic construct
WVGYTQY

SEQ ID NO: 25986 - protein, 7 aa, Artificial Sequence
  Synthetic construct
WVGYTDF

SEQ ID NO: 25987 - protein, 7 aa, Artificial Sequence
  Synthetic construct
WVGYTDY

SEQ ID NO: 25988 - protein, 7 aa, Artificial Sequence
  Synthetic construct
WVGYTVF

SEQ ID NO: 25989 - protein, 7 aa, Artificial Sequence
  Synthetic construct
WVGYTVY

SEQ ID NO: 25990 - protein, 7 aa, Artificial Sequence
  Synthetic construct
WVGYGFF

SEQ ID NO: 25991 - protein, 7 aa, Artificial Sequence
  Synthetic construct
WVGYGFY

SEQ ID NO: 25992 - protein, 7 aa, Artificial Sequence
  Synthetic construct
WVGYGRF

SEQ ID NO: 25993 - protein, 7 aa, Artificial Sequence
  Synthetic construct
WVGYGRY

SEQ ID NO: 25994 - protein, 7 aa, Artificial Sequence
  Synthetic construct
WVGYGCF

SEQ ID NO: 25995 - protein, 7 aa, Artificial Sequence
  Synthetic construct
WVGYGCY

SEQ ID NO: 25996 - protein, 7 aa, Artificial Sequence
  Synthetic construct
WVGYGLF

SEQ ID NO: 25997 - protein, 7 aa, Artificial Sequence
  Synthetic construct
WVGYGLY

SEQ ID NO: 25998 - protein, 7 aa, Artificial Sequence
  Synthetic construct
WVGYGAF

SEQ ID NO: 25999 - protein, 7 aa, Artificial Sequence
  Synthetic construct
WVGYGAY

SEQ ID NO: 26000 - protein, 7 aa, Artificial Sequence
  Synthetic construct
WVGYGQF

SEQ ID NO: 26001 - protein, 7 aa, Artificial Sequence
  Synthetic construct
WVGYGQY

SEQ ID NO: 26002 - protein, 7 aa, Artificial Sequence
  Synthetic construct
WVGYGDF

SEQ ID NO: 26003 - protein, 7 aa, Artificial Sequence
  Synthetic construct
WVGYGDY

SEQ ID NO: 26004 - protein, 7 aa, Artificial Sequence
  Synthetic construct
WVGYGVF

SEQ ID NO: 26005 - protein, 7 aa, Artificial Sequence
  Synthetic construct
WVGYGVY

SEQ ID NO: 26006 - protein, 7 aa, Artificial Sequence
  Synthetic construct
WVGYAFF

SEQ ID NO: 26007 - protein, 7 aa, Artificial Sequence
  Synthetic construct
WVGYAFY

SEQ ID NO: 26008 - protein, 7 aa, Artificial Sequence
  Synthetic construct
WVGYARF

SEQ ID NO: 26009 - protein, 7 aa, Artificial Sequence
  Synthetic construct
WVGYARY

SEQ ID NO: 26010 - protein, 7 aa, Artificial Sequence
  Synthetic construct
WVGYACF

SEQ ID NO: 26011 - protein, 7 aa, Artificial Sequence
  Synthetic construct
WVGYACY

SEQ ID NO: 26012 - protein, 7 aa, Artificial Sequence
  Synthetic construct
WVGYALF

SEQ ID NO: 26013 - protein, 7 aa, Artificial Sequence
  Synthetic construct
WVGYALY

SEQ ID NO: 26014 - protein, 7 aa, Artificial Sequence
  Synthetic construct
WVGYAAF

SEQ ID NO: 26015 - protein, 7 aa, Artificial Sequence
  Synthetic construct
WVGYAAY

SEQ ID NO: 26016 - protein, 7 aa, Artificial Sequence
  Synthetic construct
WVGYAQF

SEQ ID NO: 26017 - protein, 7 aa, Artificial Sequence
  Synthetic construct
WVGYAQY

SEQ ID NO: 26018 - protein, 7 aa, Artificial Sequence
  Synthetic construct
WVGYADF

SEQ ID NO: 26019 - protein, 7 aa, Artificial Sequence
  Synthetic construct
WVGYADY

SEQ ID NO: 26020 - protein, 7 aa, Artificial Sequence
  Synthetic construct
WVGYAVF

SEQ ID NO: 26021 - protein, 7 aa, Artificial Sequence
  Synthetic construct
WVGYAVY

SEQ ID NO: 26022 - protein, 7 aa, Artificial Sequence
  Synthetic construct
WVGYQFF

SEQ ID NO: 26023 - protein, 7 aa, Artificial Sequence
  Synthetic construct
WVGYQFY

SEQ ID NO: 26024 - protein, 7 aa, Artificial Sequence
  Synthetic construct
WVGYQRF

SEQ ID NO: 26025 - protein, 7 aa, Artificial Sequence
  Synthetic construct
WVGYQRY

SEQ ID NO: 26026 - protein, 7 aa, Artificial Sequence
  Synthetic construct
WVGYQCF

SEQ ID NO: 26027 - protein, 7 aa, Artificial Sequence
  Synthetic construct
WVGYQCY

SEQ ID NO: 26028 - protein, 7 aa, Artificial Sequence
  Synthetic construct
WVGYQLF

SEQ ID NO: 26029 - protein, 7 aa, Artificial Sequence
  Synthetic construct
WVGYQLY

SEQ ID NO: 26030 - protein, 7 aa, Artificial Sequence
  Synthetic construct
WVGYQAF

SEQ ID NO: 26031 - protein, 7 aa, Artificial Sequence
  Synthetic construct
WVGYQAY

SEQ ID NO: 26032 - protein, 7 aa, Artificial Sequence
  Synthetic construct
WVGYQQF

SEQ ID NO: 26033 - protein, 7 aa, Artificial Sequence
  Synthetic construct
WVGYQQY

SEQ ID NO: 26034 - protein, 7 aa, Artificial Sequence
  Synthetic construct
WVGYQDF

SEQ ID NO: 26035 - protein, 7 aa, Artificial Sequence
  Synthetic construct
WVGYQDY

SEQ ID NO: 26036 - protein, 7 aa, Artificial Sequence
  Synthetic construct
WVGYQVF

SEQ ID NO: 26037 - protein, 7 aa, Artificial Sequence
  Synthetic construct
WVGYQVY

SEQ ID NO: 26038 - protein, 7 aa, Artificial Sequence
  Synthetic construct
WVGPIFF

SEQ ID NO: 26039 - protein, 7 aa, Artificial Sequence
  Synthetic construct
WVGPIFY

SEQ ID NO: 26040 - protein, 7 aa, Artificial Sequence
  Synthetic construct
WVGPIRF

SEQ ID NO: 26041 - protein, 7 aa, Artificial Sequence
  Synthetic construct
WVGPIRY

SEQ ID NO: 26042 - protein, 7 aa, Artificial Sequence
  Synthetic construct
WVGPICF

SEQ ID NO: 26043 - protein, 7 aa, Artificial Sequence
  Synthetic construct
WVGPICY

SEQ ID NO: 26044 - protein, 7 aa, Artificial Sequence
  Synthetic construct
WVGPILF

SEQ ID NO: 26045 - protein, 7 aa, Artificial Sequence
  Synthetic construct
WVGPILY

SEQ ID NO: 26046 - protein, 7 aa, Artificial Sequence
  Synthetic construct
WVGPIAF

SEQ ID NO: 26047 - protein, 7 aa, Artificial Sequence
  Synthetic construct
WVGPIAY

SEQ ID NO: 26048 - protein, 7 aa, Artificial Sequence
  Synthetic construct
WVGPIQF

SEQ ID NO: 26049 - protein, 7 aa, Artificial Sequence
  Synthetic construct
WVGPIQY

SEQ ID NO: 26050 - protein, 7 aa, Artificial Sequence
  Synthetic construct
WVGPIDF

SEQ ID NO: 26051 - protein, 7 aa, Artificial Sequence
  Synthetic construct
WVGPIDY

SEQ ID NO: 26052 - protein, 7 aa, Artificial Sequence
  Synthetic construct
WVGPIVF

SEQ ID NO: 26053 - protein, 7 aa, Artificial Sequence
  Synthetic construct
WVGPIVY

SEQ ID NO: 26054 - protein, 7 aa, Artificial Sequence
  Synthetic construct
WVGPDFF

SEQ ID NO: 26055 - protein, 7 aa, Artificial Sequence
  Synthetic construct
WVGPDFY

SEQ ID NO: 26056 - protein, 7 aa, Artificial Sequence
  Synthetic construct
WVGPDRF

SEQ ID NO: 26057 - protein, 7 aa, Artificial Sequence
  Synthetic construct
WVGPDRY

SEQ ID NO: 26058 - protein, 7 aa, Artificial Sequence
  Synthetic construct
WVGPDCF

SEQ ID NO: 26059 - protein, 7 aa, Artificial Sequence
  Synthetic construct
WVGPDCY

SEQ ID NO: 26060 - protein, 7 aa, Artificial Sequence
  Synthetic construct
WVGPDLF

SEQ ID NO: 26061 - protein, 7 aa, Artificial Sequence
  Synthetic construct
WVGPDLY

SEQ ID NO: 26062 - protein, 7 aa, Artificial Sequence
  Synthetic construct
WVGPDAF

SEQ ID NO: 26063 - protein, 7 aa, Artificial Sequence
  Synthetic construct
WVGPDAY

SEQ ID NO: 26064 - protein, 7 aa, Artificial Sequence
  Synthetic construct
WVGPDQF

SEQ ID NO: 26065 - protein, 7 aa, Artificial Sequence
  Synthetic construct
WVGPDQY

SEQ ID NO: 26066 - protein, 7 aa, Artificial Sequence
  Synthetic construct
WVGPDDF

SEQ ID NO: 26067 - protein, 7 aa, Artificial Sequence
  Synthetic construct
WVGPDDY

SEQ ID NO: 26068 - protein, 7 aa, Artificial Sequence
  Synthetic construct
WVGPDVF

SEQ ID NO: 26069 - protein, 7 aa, Artificial Sequence
  Synthetic construct
WVGPDVY

SEQ ID NO: 26070 - protein, 7 aa, Artificial Sequence
  Synthetic construct
WVGPYFF

SEQ ID NO: 26071 - protein, 7 aa, Artificial Sequence
  Synthetic construct
WVGPYFY

SEQ ID NO: 26072 - protein, 7 aa, Artificial Sequence
  Synthetic construct
WVGPYRF

SEQ ID NO: 26073 - protein, 7 aa, Artificial Sequence
  Synthetic construct
WVGPYRY

SEQ ID NO: 26074 - protein, 7 aa, Artificial Sequence
  Synthetic construct
WVGPYCF

SEQ ID NO: 26075 - protein, 7 aa, Artificial Sequence
  Synthetic construct
WVGPYCY

SEQ ID NO: 26076 - protein, 7 aa, Artificial Sequence
  Synthetic construct
WVGPYLF

SEQ ID NO: 26077 - protein, 7 aa, Artificial Sequence
  Synthetic construct
WVGPYLY

SEQ ID NO: 26078 - protein, 7 aa, Artificial Sequence
  Synthetic construct
WVGPYAF

SEQ ID NO: 26079 - protein, 7 aa, Artificial Sequence
  Synthetic construct
WVGPYAY

SEQ ID NO: 26080 - protein, 7 aa, Artificial Sequence
  Synthetic construct
WVGPYQF

SEQ ID NO: 26081 - protein, 7 aa, Artificial Sequence
  Synthetic construct
WVGPYQY

SEQ ID NO: 26082 - protein, 7 aa, Artificial Sequence
  Synthetic construct
WVGPYDF

SEQ ID NO: 26083 - protein, 7 aa, Artificial Sequence
  Synthetic construct
WVGPYDY

SEQ ID NO: 26084 - protein, 7 aa, Artificial Sequence
  Synthetic construct
WVGPYVF

SEQ ID NO: 26085 - protein, 7 aa, Artificial Sequence
  Synthetic construct
WVGPYVY

SEQ ID NO: 26086 - protein, 7 aa, Artificial Sequence
  Synthetic construct
WVGPFFF

SEQ ID NO: 26087 - protein, 7 aa, Artificial Sequence
  Synthetic construct
WVGPFFY

SEQ ID NO: 26088 - protein, 7 aa, Artificial Sequence
  Synthetic construct
WVGPFRF

SEQ ID NO: 26089 - protein, 7 aa, Artificial Sequence
  Synthetic construct
WVGPFRY

SEQ ID NO: 26090 - protein, 7 aa, Artificial Sequence
  Synthetic construct
WVGPFCF

SEQ ID NO: 26091 - protein, 7 aa, Artificial Sequence
  Synthetic construct
WVGPFCY

SEQ ID NO: 26092 - protein, 7 aa, Artificial Sequence
  Synthetic construct
WVGPFLF

SEQ ID NO: 26093 - protein, 7 aa, Artificial Sequence
  Synthetic construct
WVGPFLY

SEQ ID NO: 26094 - protein, 7 aa, Artificial Sequence
  Synthetic construct
WVGPFAF

SEQ ID NO: 26095 - protein, 7 aa, Artificial Sequence
  Synthetic construct
WVGPFAY

SEQ ID NO: 26096 - protein, 7 aa, Artificial Sequence
  Synthetic construct
WVGPFQF

SEQ ID NO: 26097 - protein, 7 aa, Artificial Sequence
  Synthetic construct
WVGPFQY

SEQ ID NO: 26098 - protein, 7 aa, Artificial Sequence
  Synthetic construct
WVGPFDF

SEQ ID NO: 26099 - protein, 7 aa, Artificial Sequence
  Synthetic construct
WVGPFDY

SEQ ID NO: 26100 - protein, 7 aa, Artificial Sequence
  Synthetic construct
WVGPFVF

SEQ ID NO: 26101 - protein, 7 aa, Artificial Sequence
  Synthetic construct
WVGPFVY

SEQ ID NO: 26102 - protein, 7 aa, Artificial Sequence
  Synthetic construct
WVGPVFF

SEQ ID NO: 26103 - protein, 7 aa, Artificial Sequence
  Synthetic construct
WVGPVFY

SEQ ID NO: 26104 - protein, 7 aa, Artificial Sequence
  Synthetic construct
WVGPVRF

SEQ ID NO: 26105 - protein, 7 aa, Artificial Sequence
  Synthetic construct
WVGPVRY

SEQ ID NO: 26106 - protein, 7 aa, Artificial Sequence
  Synthetic construct
WVGPVCF

SEQ ID NO: 26107 - protein, 7 aa, Artificial Sequence
  Synthetic construct
WVGPVCY

SEQ ID NO: 26108 - protein, 7 aa, Artificial Sequence
  Synthetic construct
WVGPVLF

SEQ ID NO: 26109 - protein, 7 aa, Artificial Sequence
  Synthetic construct
WVGPVLY

SEQ ID NO: 26110 - protein, 7 aa, Artificial Sequence
  Synthetic construct
WVGPVAF

SEQ ID NO: 26111 - protein, 7 aa, Artificial Sequence
  Synthetic construct
WVGPVAY

SEQ ID NO: 26112 - protein, 7 aa, Artificial Sequence
  Synthetic construct
WVGPVQF

SEQ ID NO: 26113 - protein, 7 aa, Artificial Sequence
  Synthetic construct
WVGPVQY

SEQ ID NO: 26114 - protein, 7 aa, Artificial Sequence
  Synthetic construct
WVGPVDF

SEQ ID NO: 26115 - protein, 7 aa, Artificial Sequence
  Synthetic construct
WVGPVDY

SEQ ID NO: 26116 - protein, 7 aa, Artificial Sequence
  Synthetic construct
WVGPVVF

SEQ ID NO: 26117 - protein, 7 aa, Artificial Sequence
  Synthetic construct
WVGPVVY

SEQ ID NO: 26118 - protein, 7 aa, Artificial Sequence
  Synthetic construct
WVGPTFF

SEQ ID NO: 26119 - protein, 7 aa, Artificial Sequence
  Synthetic construct
WVGPTFY

SEQ ID NO: 26120 - protein, 7 aa, Artificial Sequence
  Synthetic construct
WVGPTRF

SEQ ID NO: 26121 - protein, 7 aa, Artificial Sequence
  Synthetic construct
WVGPTRY

SEQ ID NO: 26122 - protein, 7 aa, Artificial Sequence
  Synthetic construct
WVGPTCF

SEQ ID NO: 26123 - protein, 7 aa, Artificial Sequence
  Synthetic construct
WVGPTCY

SEQ ID NO: 26124 - protein, 7 aa, Artificial Sequence
  Synthetic construct
WVGPTLF

SEQ ID NO: 26125 - protein, 7 aa, Artificial Sequence
  Synthetic construct
WVGPTLY

SEQ ID NO: 26126 - protein, 7 aa, Artificial Sequence
  Synthetic construct
WVGPTAF

SEQ ID NO: 26127 - protein, 7 aa, Artificial Sequence
  Synthetic construct
WVGPTAY

SEQ ID NO: 26128 - protein, 7 aa, Artificial Sequence
  Synthetic construct
WVGPTQF

SEQ ID NO: 26129 - protein, 7 aa, Artificial Sequence
  Synthetic construct
WVGPTQY

SEQ ID NO: 26130 - protein, 7 aa, Artificial Sequence
  Synthetic construct
WVGPTDF

SEQ ID NO: 26131 - protein, 7 aa, Artificial Sequence
  Synthetic construct
WVGPTDY

SEQ ID NO: 26132 - protein, 7 aa, Artificial Sequence
  Synthetic construct
WVGPTVF

SEQ ID NO: 26133 - protein, 7 aa, Artificial Sequence
  Synthetic construct
WVGPTVY

SEQ ID NO: 26134 - protein, 7 aa, Artificial Sequence
  Synthetic construct
WVGPGFF

SEQ ID NO: 26135 - protein, 7 aa, Artificial Sequence
  Synthetic construct
WVGPGFY

SEQ ID NO: 26136 - protein, 7 aa, Artificial Sequence
  Synthetic construct
WVGPGRF

SEQ ID NO: 26137 - protein, 7 aa, Artificial Sequence
  Synthetic construct
WVGPGRY

SEQ ID NO: 26138 - protein, 7 aa, Artificial Sequence
  Synthetic construct
WVGPGCF

SEQ ID NO: 26139 - protein, 7 aa, Artificial Sequence
  Synthetic construct
WVGPGCY

SEQ ID NO: 26140 - protein, 7 aa, Artificial Sequence
  Synthetic construct
WVGPGLF

SEQ ID NO: 26141 - protein, 7 aa, Artificial Sequence
  Synthetic construct
WVGPGLY

SEQ ID NO: 26142 - protein, 7 aa, Artificial Sequence
  Synthetic construct
WVGPGAF

SEQ ID NO: 26143 - protein, 7 aa, Artificial Sequence
  Synthetic construct
WVGPGAY

SEQ ID NO: 26144 - protein, 7 aa, Artificial Sequence
  Synthetic construct
WVGPGQF

SEQ ID NO: 26145 - protein, 7 aa, Artificial Sequence
  Synthetic construct
WVGPGQY

SEQ ID NO: 26146 - protein, 7 aa, Artificial Sequence
  Synthetic construct
WVGPGDF

SEQ ID NO: 26147 - protein, 7 aa, Artificial Sequence
  Synthetic construct
WVGPGDY

SEQ ID NO: 26148 - protein, 7 aa, Artificial Sequence
  Synthetic construct
WVGPGVF

SEQ ID NO: 26149 - protein, 7 aa, Artificial Sequence
  Synthetic construct
WVGPGVY

SEQ ID NO: 26150 - protein, 7 aa, Artificial Sequence
  Synthetic construct
WVGPAFF

SEQ ID NO: 26151 - protein, 7 aa, Artificial Sequence
  Synthetic construct
WVGPAFY

SEQ ID NO: 26152 - protein, 7 aa, Artificial Sequence
  Synthetic construct
WVGPARF

SEQ ID NO: 26153 - protein, 7 aa, Artificial Sequence
  Synthetic construct
WVGPARY

SEQ ID NO: 26154 - protein, 7 aa, Artificial Sequence
  Synthetic construct
WVGPACF

SEQ ID NO: 26155 - protein, 7 aa, Artificial Sequence
  Synthetic construct
WVGPACY

SEQ ID NO: 26156 - protein, 7 aa, Artificial Sequence
  Synthetic construct
WVGPALF

SEQ ID NO: 26157 - protein, 7 aa, Artificial Sequence
  Synthetic construct
WVGPALY

SEQ ID NO: 26158 - protein, 7 aa, Artificial Sequence
  Synthetic construct
WVGPAAF

SEQ ID NO: 26159 - protein, 7 aa, Artificial Sequence
  Synthetic construct
WVGPAAY

SEQ ID NO: 26160 - protein, 7 aa, Artificial Sequence
  Synthetic construct
WVGPAQF

SEQ ID NO: 26161 - protein, 7 aa, Artificial Sequence
  Synthetic construct
WVGPAQY

SEQ ID NO: 26162 - protein, 7 aa, Artificial Sequence
  Synthetic construct
WVGPADF

SEQ ID NO: 26163 - protein, 7 aa, Artificial Sequence
  Synthetic construct
WVGPADY

SEQ ID NO: 26164 - protein, 7 aa, Artificial Sequence
  Synthetic construct
WVGPAVF

SEQ ID NO: 26165 - protein, 7 aa, Artificial Sequence
  Synthetic construct
WVGPAVY

SEQ ID NO: 26166 - protein, 7 aa, Artificial Sequence
  Synthetic construct
WVGPQFF

SEQ ID NO: 26167 - protein, 7 aa, Artificial Sequence
  Synthetic construct
WVGPQFY

SEQ ID NO: 26168 - protein, 7 aa, Artificial Sequence
  Synthetic construct
WVGPQRF

SEQ ID NO: 26169 - protein, 7 aa, Artificial Sequence
  Synthetic construct
WVGPQRY

SEQ ID NO: 26170 - protein, 7 aa, Artificial Sequence
  Synthetic construct
WVGPQCF

SEQ ID NO: 26171 - protein, 7 aa, Artificial Sequence
  Synthetic construct
WVGPQCY

SEQ ID NO: 26172 - protein, 7 aa, Artificial Sequence
  Synthetic construct
WVGPQLF

SEQ ID NO: 26173 - protein, 7 aa, Artificial Sequence
  Synthetic construct
WVGPQLY

SEQ ID NO: 26174 - protein, 7 aa, Artificial Sequence
  Synthetic construct
WVGPQAF

SEQ ID NO: 26175 - protein, 7 aa, Artificial Sequence
  Synthetic construct
WVGPQAY

SEQ ID NO: 26176 - protein, 7 aa, Artificial Sequence
  Synthetic construct
WVGPQQF

SEQ ID NO: 26177 - protein, 7 aa, Artificial Sequence
  Synthetic construct
WVGPQQY

SEQ ID NO: 26178 - protein, 7 aa, Artificial Sequence
  Synthetic construct
WVGPQDF

SEQ ID NO: 26179 - protein, 7 aa, Artificial Sequence
  Synthetic construct
WVGPQDY

SEQ ID NO: 26180 - protein, 7 aa, Artificial Sequence
  Synthetic construct
WVGPQVF

SEQ ID NO: 26181 - protein, 7 aa, Artificial Sequence
  Synthetic construct
WVGPQVY

SEQ ID NO: 26182 - protein, 7 aa, Artificial Sequence
  Synthetic construct
WVGHIFF

SEQ ID NO: 26183 - protein, 7 aa, Artificial Sequence
  Synthetic construct
WVGHIFY

SEQ ID NO: 26184 - protein, 7 aa, Artificial Sequence
  Synthetic construct
WVGHIRF

SEQ ID NO: 26185 - protein, 7 aa, Artificial Sequence
  Synthetic construct
WVGHIRY

SEQ ID NO: 26186 - protein, 7 aa, Artificial Sequence
  Synthetic construct
WVGHICF

SEQ ID NO: 26187 - protein, 7 aa, Artificial Sequence
  Synthetic construct
WVGHICY

SEQ ID NO: 26188 - protein, 7 aa, Artificial Sequence
  Synthetic construct
WVGHILF

SEQ ID NO: 26189 - protein, 7 aa, Artificial Sequence
  Synthetic construct
WVGHILY

SEQ ID NO: 26190 - protein, 7 aa, Artificial Sequence
  Synthetic construct
WVGHIAF

SEQ ID NO: 26191 - protein, 7 aa, Artificial Sequence
  Synthetic construct
WVGHIAY

SEQ ID NO: 26192 - protein, 7 aa, Artificial Sequence
  Synthetic construct
WVGHIQF

SEQ ID NO: 26193 - protein, 7 aa, Artificial Sequence
  Synthetic construct
WVGHIQY

SEQ ID NO: 26194 - protein, 7 aa, Artificial Sequence
  Synthetic construct
WVGHIDF

SEQ ID NO: 26195 - protein, 7 aa, Artificial Sequence
  Synthetic construct
WVGHIDY

SEQ ID NO: 26196 - protein, 7 aa, Artificial Sequence
  Synthetic construct
WVGHIVF

SEQ ID NO: 26197 - protein, 7 aa, Artificial Sequence
  Synthetic construct
WVGHIVY

SEQ ID NO: 26198 - protein, 7 aa, Artificial Sequence
  Synthetic construct
WVGHDFF

SEQ ID NO: 26199 - protein, 7 aa, Artificial Sequence
  Synthetic construct
WVGHDFY

SEQ ID NO: 26200 - protein, 7 aa, Artificial Sequence
  Synthetic construct
WVGHDRF

SEQ ID NO: 26201 - protein, 7 aa, Artificial Sequence
  Synthetic construct
WVGHDRY

SEQ ID NO: 26202 - protein, 7 aa, Artificial Sequence
  Synthetic construct
WVGHDCF

SEQ ID NO: 26203 - protein, 7 aa, Artificial Sequence
  Synthetic construct
WVGHDCY

SEQ ID NO: 26204 - protein, 7 aa, Artificial Sequence
  Synthetic construct
WVGHDLF

SEQ ID NO: 26205 - protein, 7 aa, Artificial Sequence
  Synthetic construct
WVGHDLY

SEQ ID NO: 26206 - protein, 7 aa, Artificial Sequence
  Synthetic construct
WVGHDAF

SEQ ID NO: 26207 - protein, 7 aa, Artificial Sequence
  Synthetic construct
WVGHDAY

SEQ ID NO: 26208 - protein, 7 aa, Artificial Sequence
  Synthetic construct
WVGHDQF

SEQ ID NO: 26209 - protein, 7 aa, Artificial Sequence
  Synthetic construct
WVGHDQY

SEQ ID NO: 26210 - protein, 7 aa, Artificial Sequence
  Synthetic construct
WVGHDDF

SEQ ID NO: 26211 - protein, 7 aa, Artificial Sequence
  Synthetic construct
WVGHDDY

SEQ ID NO: 26212 - protein, 7 aa, Artificial Sequence
  Synthetic construct
WVGHDVF

SEQ ID NO: 26213 - protein, 7 aa, Artificial Sequence
  Synthetic construct
WVGHDVY

SEQ ID NO: 26214 - protein, 7 aa, Artificial Sequence
  Synthetic construct
WVGHYFF

SEQ ID NO: 26215 - protein, 7 aa, Artificial Sequence
  Synthetic construct
WVGHYFY

SEQ ID NO: 26216 - protein, 7 aa, Artificial Sequence
  Synthetic construct
WVGHYRF

SEQ ID NO: 26217 - protein, 7 aa, Artificial Sequence
  Synthetic construct
WVGHYRY

SEQ ID NO: 26218 - protein, 7 aa, Artificial Sequence
  Synthetic construct
WVGHYCF

SEQ ID NO: 26219 - protein, 7 aa, Artificial Sequence
  Synthetic construct
WVGHYCY

SEQ ID NO: 26220 - protein, 7 aa, Artificial Sequence
  Synthetic construct
WVGHYLF

SEQ ID NO: 26221 - protein, 7 aa, Artificial Sequence
  Synthetic construct
WVGHYLY

SEQ ID NO: 26222 - protein, 7 aa, Artificial Sequence
  Synthetic construct
WVGHYAF

SEQ ID NO: 26223 - protein, 7 aa, Artificial Sequence
  Synthetic construct
WVGHYAY

SEQ ID NO: 26224 - protein, 7 aa, Artificial Sequence
  Synthetic construct
WVGHYQF

SEQ ID NO: 26225 - protein, 7 aa, Artificial Sequence
  Synthetic construct
WVGHYQY

SEQ ID NO: 26226 - protein, 7 aa, Artificial Sequence
  Synthetic construct
WVGHYDF

SEQ ID NO: 26227 - protein, 7 aa, Artificial Sequence
  Synthetic construct
WVGHYDY

SEQ ID NO: 26228 - protein, 7 aa, Artificial Sequence
  Synthetic construct
WVGHYVF

SEQ ID NO: 26229 - protein, 7 aa, Artificial Sequence
  Synthetic construct
WVGHYVY

SEQ ID NO: 26230 - protein, 7 aa, Artificial Sequence
  Synthetic construct
WVGHFFF

SEQ ID NO: 26231 - protein, 7 aa, Artificial Sequence
  Synthetic construct
WVGHFFY

SEQ ID NO: 26232 - protein, 7 aa, Artificial Sequence
  Synthetic construct
WVGHFRF

SEQ ID NO: 26233 - protein, 7 aa, Artificial Sequence
  Synthetic construct
WVGHFRY

SEQ ID NO: 26234 - protein, 7 aa, Artificial Sequence
  Synthetic construct
WVGHFCF

SEQ ID NO: 26235 - protein, 7 aa, Artificial Sequence
  Synthetic construct
WVGHFCY

SEQ ID NO: 26236 - protein, 7 aa, Artificial Sequence
  Synthetic construct
WVGHFLF

SEQ ID NO: 26237 - protein, 7 aa, Artificial Sequence
  Synthetic construct
WVGHFLY

SEQ ID NO: 26238 - protein, 7 aa, Artificial Sequence
  Synthetic construct
WVGHFAF

SEQ ID NO: 26239 - protein, 7 aa, Artificial Sequence
  Synthetic construct
WVGHFAY

SEQ ID NO: 26240 - protein, 7 aa, Artificial Sequence
  Synthetic construct
WVGHFQF

SEQ ID NO: 26241 - protein, 7 aa, Artificial Sequence
  Synthetic construct
WVGHFQY

SEQ ID NO: 26242 - protein, 7 aa, Artificial Sequence
  Synthetic construct
WVGHFDF

SEQ ID NO: 26243 - protein, 7 aa, Artificial Sequence
  Synthetic construct
WVGHFDY

SEQ ID NO: 26244 - protein, 7 aa, Artificial Sequence
  Synthetic construct
WVGHFVF

SEQ ID NO: 26245 - protein, 7 aa, Artificial Sequence
  Synthetic construct
WVGHFVY

SEQ ID NO: 26246 - protein, 7 aa, Artificial Sequence
  Synthetic construct
WVGHVFF

SEQ ID NO: 26247 - protein, 7 aa, Artificial Sequence
  Synthetic construct
WVGHVFY

SEQ ID NO: 26248 - protein, 7 aa, Artificial Sequence
  Synthetic construct
WVGHVRF

SEQ ID NO: 26249 - protein, 7 aa, Artificial Sequence
  Synthetic construct
WVGHVRY

SEQ ID NO: 26250 - protein, 7 aa, Artificial Sequence
  Synthetic construct
WVGHVCF

SEQ ID NO: 26251 - protein, 7 aa, Artificial Sequence
  Synthetic construct
WVGHVCY

SEQ ID NO: 26252 - protein, 7 aa, Artificial Sequence
  Synthetic construct
WVGHVLF

SEQ ID NO: 26253 - protein, 7 aa, Artificial Sequence
  Synthetic construct
WVGHVLY

SEQ ID NO: 26254 - protein, 7 aa, Artificial Sequence
  Synthetic construct
WVGHVAF

SEQ ID NO: 26255 - protein, 7 aa, Artificial Sequence
  Synthetic construct
WVGHVAY

SEQ ID NO: 26256 - protein, 7 aa, Artificial Sequence
  Synthetic construct
WVGHVQF

SEQ ID NO: 26257 - protein, 7 aa, Artificial Sequence
  Synthetic construct
WVGHVQY

SEQ ID NO: 26258 - protein, 7 aa, Artificial Sequence
  Synthetic construct
WVGHVDF

SEQ ID NO: 26259 - protein, 7 aa, Artificial Sequence
  Synthetic construct
WVGHVDY

SEQ ID NO: 26260 - protein, 7 aa, Artificial Sequence
  Synthetic construct
WVGHVVF

SEQ ID NO: 26261 - protein, 7 aa, Artificial Sequence
  Synthetic construct
WVGHVVY

SEQ ID NO: 26262 - protein, 7 aa, Artificial Sequence
  Synthetic construct
WVGHTFF

SEQ ID NO: 26263 - protein, 7 aa, Artificial Sequence
  Synthetic construct
WVGHTFY

SEQ ID NO: 26264 - protein, 7 aa, Artificial Sequence
  Synthetic construct
WVGHTRF

SEQ ID NO: 26265 - protein, 7 aa, Artificial Sequence
  Synthetic construct
WVGHTRY

SEQ ID NO: 26266 - protein, 7 aa, Artificial Sequence
  Synthetic construct
WVGHTCF

SEQ ID NO: 26267 - protein, 7 aa, Artificial Sequence
  Synthetic construct
WVGHTCY

SEQ ID NO: 26268 - protein, 7 aa, Artificial Sequence
  Synthetic construct
WVGHTLF

SEQ ID NO: 26269 - protein, 7 aa, Artificial Sequence
  Synthetic construct
WVGHTLY

SEQ ID NO: 26270 - protein, 7 aa, Artificial Sequence
  Synthetic construct
WVGHTAF

SEQ ID NO: 26271 - protein, 7 aa, Artificial Sequence
  Synthetic construct
WVGHTAY

SEQ ID NO: 26272 - protein, 7 aa, Artificial Sequence
  Synthetic construct
WVGHTQF

SEQ ID NO: 26273 - protein, 7 aa, Artificial Sequence
  Synthetic construct
WVGHTQY

SEQ ID NO: 26274 - protein, 7 aa, Artificial Sequence
  Synthetic construct
WVGHTDF

SEQ ID NO: 26275 - protein, 7 aa, Artificial Sequence
  Synthetic construct
WVGHTDY

SEQ ID NO: 26276 - protein, 7 aa, Artificial Sequence
  Synthetic construct
WVGHTVF

SEQ ID NO: 26277 - protein, 7 aa, Artificial Sequence
  Synthetic construct
WVGHTVY

SEQ ID NO: 26278 - protein, 7 aa, Artificial Sequence
  Synthetic construct
WVGHGFF

SEQ ID NO: 26279 - protein, 7 aa, Artificial Sequence
  Synthetic construct
WVGHGFY

SEQ ID NO: 26280 - protein, 7 aa, Artificial Sequence
  Synthetic construct
WVGHGRF

SEQ ID NO: 26281 - protein, 7 aa, Artificial Sequence
  Synthetic construct
WVGHGRY

SEQ ID NO: 26282 - protein, 7 aa, Artificial Sequence
  Synthetic construct
WVGHGCF

SEQ ID NO: 26283 - protein, 7 aa, Artificial Sequence
  Synthetic construct
WVGHGCY

SEQ ID NO: 26284 - protein, 7 aa, Artificial Sequence
  Synthetic construct
WVGHGLF

SEQ ID NO: 26285 - protein, 7 aa, Artificial Sequence
  Synthetic construct
WVGHGLY

SEQ ID NO: 26286 - protein, 7 aa, Artificial Sequence
  Synthetic construct
WVGHGAF

SEQ ID NO: 26287 - protein, 7 aa, Artificial Sequence
  Synthetic construct
WVGHGAY

SEQ ID NO: 26288 - protein, 7 aa, Artificial Sequence
  Synthetic construct
WVGHGQF

SEQ ID NO: 26289 - protein, 7 aa, Artificial Sequence
  Synthetic construct
WVGHGQY

SEQ ID NO: 26290 - protein, 7 aa, Artificial Sequence
  Synthetic construct
WVGHGDF

SEQ ID NO: 26291 - protein, 7 aa, Artificial Sequence
  Synthetic construct
WVGHGDY

SEQ ID NO: 26292 - protein, 7 aa, Artificial Sequence
  Synthetic construct
WVGHGVF

SEQ ID NO: 26293 - protein, 7 aa, Artificial Sequence
  Synthetic construct
WVGHGVY

SEQ ID NO: 26294 - protein, 7 aa, Artificial Sequence
  Synthetic construct
WVGHAFF

SEQ ID NO: 26295 - protein, 7 aa, Artificial Sequence
  Synthetic construct
WVGHAFY

SEQ ID NO: 26296 - protein, 7 aa, Artificial Sequence
  Synthetic construct
WVGHARF

SEQ ID NO: 26297 - protein, 7 aa, Artificial Sequence
  Synthetic construct
WVGHARY

SEQ ID NO: 26298 - protein, 7 aa, Artificial Sequence
  Synthetic construct
WVGHACF

SEQ ID NO: 26299 - protein, 7 aa, Artificial Sequence
  Synthetic construct
WVGHACY

SEQ ID NO: 26300 - protein, 7 aa, Artificial Sequence
  Synthetic construct
WVGHALF

SEQ ID NO: 26301 - protein, 7 aa, Artificial Sequence
  Synthetic construct
WVGHALY

SEQ ID NO: 26302 - protein, 7 aa, Artificial Sequence
  Synthetic construct
WVGHAAF

SEQ ID NO: 26303 - protein, 7 aa, Artificial Sequence
  Synthetic construct
WVGHAAY

SEQ ID NO: 26304 - protein, 7 aa, Artificial Sequence
  Synthetic construct
WVGHAQF

SEQ ID NO: 26305 - protein, 7 aa, Artificial Sequence
  Synthetic construct
WVGHAQY

SEQ ID NO: 26306 - protein, 7 aa, Artificial Sequence
  Synthetic construct
WVGHADF

SEQ ID NO: 26307 - protein, 7 aa, Artificial Sequence
  Synthetic construct
WVGHADY

SEQ ID NO: 26308 - protein, 7 aa, Artificial Sequence
  Synthetic construct
WVGHAVF

SEQ ID NO: 26309 - protein, 7 aa, Artificial Sequence
  Synthetic construct
WVGHAVY

SEQ ID NO: 26310 - protein, 7 aa, Artificial Sequence
  Synthetic construct
WVGHQFF

SEQ ID NO: 26311 - protein, 7 aa, Artificial Sequence
  Synthetic construct
WVGHQFY

SEQ ID NO: 26312 - protein, 7 aa, Artificial Sequence
  Synthetic construct
WVGHQRF

SEQ ID NO: 26313 - protein, 7 aa, Artificial Sequence
  Synthetic construct
WVGHQRY

SEQ ID NO: 26314 - protein, 7 aa, Artificial Sequence
  Synthetic construct
WVGHQCF

SEQ ID NO: 26315 - protein, 7 aa, Artificial Sequence
  Synthetic construct
WVGHQCY

SEQ ID NO: 26316 - protein, 7 aa, Artificial Sequence
  Synthetic construct
WVGHQLF

SEQ ID NO: 26317 - protein, 7 aa, Artificial Sequence
  Synthetic construct
WVGHQLY

SEQ ID NO: 26318 - protein, 7 aa, Artificial Sequence
  Synthetic construct
WVGHQAF

SEQ ID NO: 26319 - protein, 7 aa, Artificial Sequence
  Synthetic construct
WVGHQAY

SEQ ID NO: 26320 - protein, 7 aa, Artificial Sequence
  Synthetic construct
WVGHQQF

SEQ ID NO: 26321 - protein, 7 aa, Artificial Sequence
  Synthetic construct
WVGHQQY

SEQ ID NO: 26322 - protein, 7 aa, Artificial Sequence
  Synthetic construct
WVGHQDF

SEQ ID NO: 26323 - protein, 7 aa, Artificial Sequence
  Synthetic construct
WVGHQDY

SEQ ID NO: 26324 - protein, 7 aa, Artificial Sequence
  Synthetic construct
WVGHQVF

SEQ ID NO: 26325 - protein, 7 aa, Artificial Sequence
  Synthetic construct
WVGHQVY

SEQ ID NO: 26326 - protein, 7 aa, Artificial Sequence
  Synthetic construct
WVGLIFF

SEQ ID NO: 26327 - protein, 7 aa, Artificial Sequence
  Synthetic construct
WVGLIFY

SEQ ID NO: 26328 - protein, 7 aa, Artificial Sequence
  Synthetic construct
WVGLIRF

SEQ ID NO: 26329 - protein, 7 aa, Artificial Sequence
  Synthetic construct
WVGLIRY

SEQ ID NO: 26330 - protein, 7 aa, Artificial Sequence
  Synthetic construct
WVGLICF

SEQ ID NO: 26331 - protein, 7 aa, Artificial Sequence
  Synthetic construct
WVGLICY

SEQ ID NO: 26332 - protein, 7 aa, Artificial Sequence
  Synthetic construct
WVGLILF

SEQ ID NO: 26333 - protein, 7 aa, Artificial Sequence
  Synthetic construct
WVGLILY

SEQ ID NO: 26334 - protein, 7 aa, Artificial Sequence
  Synthetic construct
WVGLIAF

SEQ ID NO: 26335 - protein, 7 aa, Artificial Sequence
  Synthetic construct
WVGLIAY

SEQ ID NO: 26336 - protein, 7 aa, Artificial Sequence
  Synthetic construct
WVGLIQF

SEQ ID NO: 26337 - protein, 7 aa, Artificial Sequence
  Synthetic construct
WVGLIQY

SEQ ID NO: 26338 - protein, 7 aa, Artificial Sequence
  Synthetic construct
WVGLIDF

SEQ ID NO: 26339 - protein, 7 aa, Artificial Sequence
  Synthetic construct
WVGLIDY

SEQ ID NO: 26340 - protein, 7 aa, Artificial Sequence
  Synthetic construct
WVGLIVF

SEQ ID NO: 26341 - protein, 7 aa, Artificial Sequence
  Synthetic construct
WVGLIVY

SEQ ID NO: 26342 - protein, 7 aa, Artificial Sequence
  Synthetic construct
WVGLDFF

SEQ ID NO: 26343 - protein, 7 aa, Artificial Sequence
  Synthetic construct
WVGLDFY

SEQ ID NO: 26344 - protein, 7 aa, Artificial Sequence
  Synthetic construct
WVGLDRF

SEQ ID NO: 26345 - protein, 7 aa, Artificial Sequence
  Synthetic construct
WVGLDRY

SEQ ID NO: 26346 - protein, 7 aa, Artificial Sequence
  Synthetic construct
WVGLDCF

SEQ ID NO: 26347 - protein, 7 aa, Artificial Sequence
  Synthetic construct
WVGLDCY

SEQ ID NO: 26348 - protein, 7 aa, Artificial Sequence
  Synthetic construct
WVGLDLF

SEQ ID NO: 26349 - protein, 7 aa, Artificial Sequence
  Synthetic construct
WVGLDLY

SEQ ID NO: 26350 - protein, 7 aa, Artificial Sequence
  Synthetic construct
WVGLDAF

SEQ ID NO: 26351 - protein, 7 aa, Artificial Sequence
  Synthetic construct
WVGLDAY

SEQ ID NO: 26352 - protein, 7 aa, Artificial Sequence
  Synthetic construct
WVGLDQF

SEQ ID NO: 26353 - protein, 7 aa, Artificial Sequence
  Synthetic construct
WVGLDQY

SEQ ID NO: 26354 - protein, 7 aa, Artificial Sequence
  Synthetic construct
WVGLDDF

SEQ ID NO: 26355 - protein, 7 aa, Artificial Sequence
  Synthetic construct
WVGLDDY

SEQ ID NO: 26356 - protein, 7 aa, Artificial Sequence
  Synthetic construct
WVGLDVF

SEQ ID NO: 26357 - protein, 7 aa, Artificial Sequence
  Synthetic construct
WVGLDVY

SEQ ID NO: 26358 - protein, 7 aa, Artificial Sequence
  Synthetic construct
WVGLYFF

SEQ ID NO: 26359 - protein, 7 aa, Artificial Sequence
  Synthetic construct
WVGLYFY

SEQ ID NO: 26360 - protein, 7 aa, Artificial Sequence
  Synthetic construct
WVGLYRF

SEQ ID NO: 26361 - protein, 7 aa, Artificial Sequence
  Synthetic construct
WVGLYRY

SEQ ID NO: 26362 - protein, 7 aa, Artificial Sequence
  Synthetic construct
WVGLYCF

SEQ ID NO: 26363 - protein, 7 aa, Artificial Sequence
  Synthetic construct
WVGLYCY

SEQ ID NO: 26364 - protein, 7 aa, Artificial Sequence
  Synthetic construct
WVGLYLF

SEQ ID NO: 26365 - protein, 7 aa, Artificial Sequence
  Synthetic construct
WVGLYLY

SEQ ID NO: 26366 - protein, 7 aa, Artificial Sequence
  Synthetic construct
WVGLYAF

SEQ ID NO: 26367 - protein, 7 aa, Artificial Sequence
  Synthetic construct
WVGLYAY

SEQ ID NO: 26368 - protein, 7 aa, Artificial Sequence
  Synthetic construct
WVGLYQF

SEQ ID NO: 26369 - protein, 7 aa, Artificial Sequence
  Synthetic construct
WVGLYQY

SEQ ID NO: 26370 - protein, 7 aa, Artificial Sequence
  Synthetic construct
WVGLYDF

SEQ ID NO: 26371 - protein, 7 aa, Artificial Sequence
  Synthetic construct
WVGLYDY

SEQ ID NO: 26372 - protein, 7 aa, Artificial Sequence
  Synthetic construct
WVGLYVF

SEQ ID NO: 26373 - protein, 7 aa, Artificial Sequence
  Synthetic construct
WVGLYVY

SEQ ID NO: 26374 - protein, 7 aa, Artificial Sequence
  Synthetic construct
WVGLFFF

SEQ ID NO: 26375 - protein, 7 aa, Artificial Sequence
  Synthetic construct
WVGLFFY

SEQ ID NO: 26376 - protein, 7 aa, Artificial Sequence
  Synthetic construct
WVGLFRF

SEQ ID NO: 26377 - protein, 7 aa, Artificial Sequence
  Synthetic construct
WVGLFRY

SEQ ID NO: 26378 - protein, 7 aa, Artificial Sequence
  Synthetic construct
WVGLFCF

SEQ ID NO: 26379 - protein, 7 aa, Artificial Sequence
  Synthetic construct
WVGLFCY

SEQ ID NO: 26380 - protein, 7 aa, Artificial Sequence
  Synthetic construct
WVGLFLF

SEQ ID NO: 26381 - protein, 7 aa, Artificial Sequence
  Synthetic construct
WVGLFLY

SEQ ID NO: 26382 - protein, 7 aa, Artificial Sequence
  Synthetic construct
WVGLFAF

SEQ ID NO: 26383 - protein, 7 aa, Artificial Sequence
  Synthetic construct
WVGLFAY

SEQ ID NO: 26384 - protein, 7 aa, Artificial Sequence
  Synthetic construct
WVGLFQF

SEQ ID NO: 26385 - protein, 7 aa, Artificial Sequence
  Synthetic construct
WVGLFQY

SEQ ID NO: 26386 - protein, 7 aa, Artificial Sequence
  Synthetic construct
WVGLFDF

SEQ ID NO: 26387 - protein, 7 aa, Artificial Sequence
  Synthetic construct
WVGLFDY

SEQ ID NO: 26388 - protein, 7 aa, Artificial Sequence
  Synthetic construct
WVGLFVF

SEQ ID NO: 26389 - protein, 7 aa, Artificial Sequence
  Synthetic construct
WVGLFVY

SEQ ID NO: 26390 - protein, 7 aa, Artificial Sequence
  Synthetic construct
WVGLVFF

SEQ ID NO: 26391 - protein, 7 aa, Artificial Sequence
  Synthetic construct
WVGLVFY

SEQ ID NO: 26392 - protein, 7 aa, Artificial Sequence
  Synthetic construct
WVGLVRF

SEQ ID NO: 26393 - protein, 7 aa, Artificial Sequence
  Synthetic construct
WVGLVRY

SEQ ID NO: 26394 - protein, 7 aa, Artificial Sequence
  Synthetic construct
WVGLVCF

SEQ ID NO: 26395 - protein, 7 aa, Artificial Sequence
  Synthetic construct
WVGLVCY

SEQ ID NO: 26396 - protein, 7 aa, Artificial Sequence
  Synthetic construct
WVGLVLF

SEQ ID NO: 26397 - protein, 7 aa, Artificial Sequence
  Synthetic construct
WVGLVLY

SEQ ID NO: 26398 - protein, 7 aa, Artificial Sequence
  Synthetic construct
WVGLVAF

SEQ ID NO: 26399 - protein, 7 aa, Artificial Sequence
  Synthetic construct
WVGLVAY

SEQ ID NO: 26400 - protein, 7 aa, Artificial Sequence
  Synthetic construct
WVGLVQF

SEQ ID NO: 26401 - protein, 7 aa, Artificial Sequence
  Synthetic construct
WVGLVQY

SEQ ID NO: 26402 - protein, 7 aa, Artificial Sequence
  Synthetic construct
WVGLVDF

SEQ ID NO: 26403 - protein, 7 aa, Artificial Sequence
  Synthetic construct
WVGLVDY

SEQ ID NO: 26404 - protein, 7 aa, Artificial Sequence
  Synthetic construct
WVGLVVF

SEQ ID NO: 26405 - protein, 7 aa, Artificial Sequence
  Synthetic construct
WVGLVVY

SEQ ID NO: 26406 - protein, 7 aa, Artificial Sequence
  Synthetic construct
WVGLTFF

SEQ ID NO: 26407 - protein, 7 aa, Artificial Sequence
  Synthetic construct
WVGLTFY

SEQ ID NO: 26408 - protein, 7 aa, Artificial Sequence
  Synthetic construct
WVGLTRF

SEQ ID NO: 26409 - protein, 7 aa, Artificial Sequence
  Synthetic construct
WVGLTRY

SEQ ID NO: 26410 - protein, 7 aa, Artificial Sequence
  Synthetic construct
WVGLTCF

SEQ ID NO: 26411 - protein, 7 aa, Artificial Sequence
  Synthetic construct
WVGLTCY

SEQ ID NO: 26412 - protein, 7 aa, Artificial Sequence
  Synthetic construct
WVGLTLF

SEQ ID NO: 26413 - protein, 7 aa, Artificial Sequence
  Synthetic construct
WVGLTLY

SEQ ID NO: 26414 - protein, 7 aa, Artificial Sequence
  Synthetic construct
WVGLTAF

SEQ ID NO: 26415 - protein, 7 aa, Artificial Sequence
  Synthetic construct
WVGLTAY

SEQ ID NO: 26416 - protein, 7 aa, Artificial Sequence
  Synthetic construct
WVGLTQF

SEQ ID NO: 26417 - protein, 7 aa, Artificial Sequence
  Synthetic construct
WVGLTQY

SEQ ID NO: 26418 - protein, 7 aa, Artificial Sequence
  Synthetic construct
WVGLTDF

SEQ ID NO: 26419 - protein, 7 aa, Artificial Sequence
  Synthetic construct
WVGLTDY

SEQ ID NO: 26420 - protein, 7 aa, Artificial Sequence
  Synthetic construct
WVGLTVF

SEQ ID NO: 26421 - protein, 7 aa, Artificial Sequence
  Synthetic construct
WVGLTVY

SEQ ID NO: 26422 - protein, 7 aa, Artificial Sequence
  Synthetic construct
WVGLGFF

SEQ ID NO: 26423 - protein, 7 aa, Artificial Sequence
  Synthetic construct
WVGLGFY

SEQ ID NO: 26424 - protein, 7 aa, Artificial Sequence
  Synthetic construct
WVGLGRF

SEQ ID NO: 26425 - protein, 7 aa, Artificial Sequence
  Synthetic construct
WVGLGRY

SEQ ID NO: 26426 - protein, 7 aa, Artificial Sequence
  Synthetic construct
WVGLGCF

SEQ ID NO: 26427 - protein, 7 aa, Artificial Sequence
  Synthetic construct
WVGLGCY

SEQ ID NO: 26428 - protein, 7 aa, Artificial Sequence
  Synthetic construct
WVGLGLF

SEQ ID NO: 26429 - protein, 7 aa, Artificial Sequence
  Synthetic construct
WVGLGLY

SEQ ID NO: 26430 - protein, 7 aa, Artificial Sequence
  Synthetic construct
WVGLGAF

SEQ ID NO: 26431 - protein, 7 aa, Artificial Sequence
  Synthetic construct
WVGLGAY

SEQ ID NO: 26432 - protein, 7 aa, Artificial Sequence
  Synthetic construct
WVGLGQF

SEQ ID NO: 26433 - protein, 7 aa, Artificial Sequence
  Synthetic construct
WVGLGQY

SEQ ID NO: 26434 - protein, 7 aa, Artificial Sequence
  Synthetic construct
WVGLGDF

SEQ ID NO: 26435 - protein, 7 aa, Artificial Sequence
  Synthetic construct
WVGLGDY

SEQ ID NO: 26436 - protein, 7 aa, Artificial Sequence
  Synthetic construct
WVGLGVF

SEQ ID NO: 26437 - protein, 7 aa, Artificial Sequence
  Synthetic construct
WVGLGVY

SEQ ID NO: 26438 - protein, 7 aa, Artificial Sequence
  Synthetic construct
WVGLAFF

SEQ ID NO: 26439 - protein, 7 aa, Artificial Sequence
  Synthetic construct
WVGLAFY

SEQ ID NO: 26440 - protein, 7 aa, Artificial Sequence
  Synthetic construct
WVGLARF

SEQ ID NO: 26441 - protein, 7 aa, Artificial Sequence
  Synthetic construct
WVGLARY

SEQ ID NO: 26442 - protein, 7 aa, Artificial Sequence
  Synthetic construct
WVGLACF

SEQ ID NO: 26443 - protein, 7 aa, Artificial Sequence
  Synthetic construct
WVGLACY

SEQ ID NO: 26444 - protein, 7 aa, Artificial Sequence
  Synthetic construct
WVGLALF

SEQ ID NO: 26445 - protein, 7 aa, Artificial Sequence
  Synthetic construct
WVGLALY

SEQ ID NO: 26446 - protein, 7 aa, Artificial Sequence
  Synthetic construct
WVGLAAF

SEQ ID NO: 26447 - protein, 7 aa, Artificial Sequence
  Synthetic construct
WVGLAAY

SEQ ID NO: 26448 - protein, 7 aa, Artificial Sequence
  Synthetic construct
WVGLAQF

SEQ ID NO: 26449 - protein, 7 aa, Artificial Sequence
  Synthetic construct
WVGLAQY

SEQ ID NO: 26450 - protein, 7 aa, Artificial Sequence
  Synthetic construct
WVGLADF

SEQ ID NO: 26451 - protein, 7 aa, Artificial Sequence
  Synthetic construct
WVGLADY

SEQ ID NO: 26452 - protein, 7 aa, Artificial Sequence
  Synthetic construct
WVGLAVF

SEQ ID NO: 26453 - protein, 7 aa, Artificial Sequence
  Synthetic construct
WVGLAVY

SEQ ID NO: 26454 - protein, 7 aa, Artificial Sequence
  Synthetic construct
WVGLQFF

SEQ ID NO: 26455 - protein, 7 aa, Artificial Sequence
  Synthetic construct
WVGLQFY

SEQ ID NO: 26456 - protein, 7 aa, Artificial Sequence
  Synthetic construct
WVGLQRF

SEQ ID NO: 26457 - protein, 7 aa, Artificial Sequence
  Synthetic construct
WVGLQRY

SEQ ID NO: 26458 - protein, 7 aa, Artificial Sequence
  Synthetic construct
WVGLQCF

SEQ ID NO: 26459 - protein, 7 aa, Artificial Sequence
  Synthetic construct
WVGLQCY

SEQ ID NO: 26460 - protein, 7 aa, Artificial Sequence
  Synthetic construct
WVGLQLF

SEQ ID NO: 26461 - protein, 7 aa, Artificial Sequence
  Synthetic construct
WVGLQLY

SEQ ID NO: 26462 - protein, 7 aa, Artificial Sequence
  Synthetic construct
WVGLQAF

SEQ ID NO: 26463 - protein, 7 aa, Artificial Sequence
  Synthetic construct
WVGLQAY

SEQ ID NO: 26464 - protein, 7 aa, Artificial Sequence
  Synthetic construct
WVGLQQF

SEQ ID NO: 26465 - protein, 7 aa, Artificial Sequence
  Synthetic construct
WVGLQQY

SEQ ID NO: 26466 - protein, 7 aa, Artificial Sequence
  Synthetic construct
WVGLQDF

SEQ ID NO: 26467 - protein, 7 aa, Artificial Sequence
  Synthetic construct
WVGLQDY

SEQ ID NO: 26468 - protein, 7 aa, Artificial Sequence
  Synthetic construct
WVGLQVF

SEQ ID NO: 26469 - protein, 7 aa, Artificial Sequence
  Synthetic construct
WVGLQVY

SEQ ID NO: 26470 - protein, 7 aa, Artificial Sequence
  Synthetic construct
WVGFIFF

SEQ ID NO: 26471 - protein, 7 aa, Artificial Sequence
  Synthetic construct
WVGFIFY

SEQ ID NO: 26472 - protein, 7 aa, Artificial Sequence
  Synthetic construct
WVGFIRF

SEQ ID NO: 26473 - protein, 7 aa, Artificial Sequence
  Synthetic construct
WVGFIRY

SEQ ID NO: 26474 - protein, 7 aa, Artificial Sequence
  Synthetic construct
WVGFICF

SEQ ID NO: 26475 - protein, 7 aa, Artificial Sequence
  Synthetic construct
WVGFICY

SEQ ID NO: 26476 - protein, 7 aa, Artificial Sequence
  Synthetic construct
WVGFILF

SEQ ID NO: 26477 - protein, 7 aa, Artificial Sequence
  Synthetic construct
WVGFILY

SEQ ID NO: 26478 - protein, 7 aa, Artificial Sequence
  Synthetic construct
WVGFIAF

SEQ ID NO: 26479 - protein, 7 aa, Artificial Sequence
  Synthetic construct
WVGFIAY

SEQ ID NO: 26480 - protein, 7 aa, Artificial Sequence
  Synthetic construct
WVGFIQF

SEQ ID NO: 26481 - protein, 7 aa, Artificial Sequence
  Synthetic construct
WVGFIQY

SEQ ID NO: 26482 - protein, 7 aa, Artificial Sequence
  Synthetic construct
WVGFIDF

SEQ ID NO: 26483 - protein, 7 aa, Artificial Sequence
  Synthetic construct
WVGFIDY

SEQ ID NO: 26484 - protein, 7 aa, Artificial Sequence
  Synthetic construct
WVGFIVF

SEQ ID NO: 26485 - protein, 7 aa, Artificial Sequence
  Synthetic construct
WVGFIVY

SEQ ID NO: 26486 - protein, 7 aa, Artificial Sequence
  Synthetic construct
WVGFDFF

SEQ ID NO: 26487 - protein, 7 aa, Artificial Sequence
  Synthetic construct
WVGFDFY

SEQ ID NO: 26488 - protein, 7 aa, Artificial Sequence
  Synthetic construct
WVGFDRF

SEQ ID NO: 26489 - protein, 7 aa, Artificial Sequence
  Synthetic construct
WVGFDRY

SEQ ID NO: 26490 - protein, 7 aa, Artificial Sequence
  Synthetic construct
WVGFDCF

SEQ ID NO: 26491 - protein, 7 aa, Artificial Sequence
  Synthetic construct
WVGFDCY

SEQ ID NO: 26492 - protein, 7 aa, Artificial Sequence
  Synthetic construct
WVGFDLF

SEQ ID NO: 26493 - protein, 7 aa, Artificial Sequence
  Synthetic construct
WVGFDLY

SEQ ID NO: 26494 - protein, 7 aa, Artificial Sequence
  Synthetic construct
WVGFDAF

SEQ ID NO: 26495 - protein, 7 aa, Artificial Sequence
  Synthetic construct
WVGFDAY

SEQ ID NO: 26496 - protein, 7 aa, Artificial Sequence
  Synthetic construct
WVGFDQF

SEQ ID NO: 26497 - protein, 7 aa, Artificial Sequence
  Synthetic construct
WVGFDQY

SEQ ID NO: 26498 - protein, 7 aa, Artificial Sequence
  Synthetic construct
WVGFDDF

SEQ ID NO: 26499 - protein, 7 aa, Artificial Sequence
  Synthetic construct
WVGFDDY

SEQ ID NO: 26500 - protein, 7 aa, Artificial Sequence
  Synthetic construct
WVGFDVF

SEQ ID NO: 26501 - protein, 7 aa, Artificial Sequence
  Synthetic construct
WVGFDVY

SEQ ID NO: 26502 - protein, 7 aa, Artificial Sequence
  Synthetic construct
WVGFYFF

SEQ ID NO: 26503 - protein, 7 aa, Artificial Sequence
  Synthetic construct
WVGFYFY

SEQ ID NO: 26504 - protein, 7 aa, Artificial Sequence
  Synthetic construct
WVGFYRF

SEQ ID NO: 26505 - protein, 7 aa, Artificial Sequence
  Synthetic construct
WVGFYRY

SEQ ID NO: 26506 - protein, 7 aa, Artificial Sequence
  Synthetic construct
WVGFYCF

SEQ ID NO: 26507 - protein, 7 aa, Artificial Sequence
  Synthetic construct
WVGFYCY

SEQ ID NO: 26508 - protein, 7 aa, Artificial Sequence
  Synthetic construct
WVGFYLF

SEQ ID NO: 26509 - protein, 7 aa, Artificial Sequence
  Synthetic construct
WVGFYLY

SEQ ID NO: 26510 - protein, 7 aa, Artificial Sequence
  Synthetic construct
WVGFYAF

SEQ ID NO: 26511 - protein, 7 aa, Artificial Sequence
  Synthetic construct
WVGFYAY

SEQ ID NO: 26512 - protein, 7 aa, Artificial Sequence
  Synthetic construct
WVGFYQF

SEQ ID NO: 26513 - protein, 7 aa, Artificial Sequence
  Synthetic construct
WVGFYQY

SEQ ID NO: 26514 - protein, 7 aa, Artificial Sequence
  Synthetic construct
WVGFYDF

SEQ ID NO: 26515 - protein, 7 aa, Artificial Sequence
  Synthetic construct
WVGFYDY

SEQ ID NO: 26516 - protein, 7 aa, Artificial Sequence
  Synthetic construct
WVGFYVF

SEQ ID NO: 26517 - protein, 7 aa, Artificial Sequence
  Synthetic construct
WVGFYVY

SEQ ID NO: 26518 - protein, 7 aa, Artificial Sequence
  Synthetic construct
WVGFFFF

SEQ ID NO: 26519 - protein, 7 aa, Artificial Sequence
  Synthetic construct
WVGFFFY

SEQ ID NO: 26520 - protein, 7 aa, Artificial Sequence
  Synthetic construct
WVGFFRF

SEQ ID NO: 26521 - protein, 7 aa, Artificial Sequence
  Synthetic construct
WVGFFRY

SEQ ID NO: 26522 - protein, 7 aa, Artificial Sequence
  Synthetic construct
WVGFFCF

SEQ ID NO: 26523 - protein, 7 aa, Artificial Sequence
  Synthetic construct
WVGFFCY

SEQ ID NO: 26524 - protein, 7 aa, Artificial Sequence
  Synthetic construct
WVGFFLF

SEQ ID NO: 26525 - protein, 7 aa, Artificial Sequence
  Synthetic construct
WVGFFLY

SEQ ID NO: 26526 - protein, 7 aa, Artificial Sequence
  Synthetic construct
WVGFFAF

SEQ ID NO: 26527 - protein, 7 aa, Artificial Sequence
  Synthetic construct
WVGFFAY

SEQ ID NO: 26528 - protein, 7 aa, Artificial Sequence
  Synthetic construct
WVGFFQF

SEQ ID NO: 26529 - protein, 7 aa, Artificial Sequence
  Synthetic construct
WVGFFQY

SEQ ID NO: 26530 - protein, 7 aa, Artificial Sequence
  Synthetic construct
WVGFFDF

SEQ ID NO: 26531 - protein, 7 aa, Artificial Sequence
  Synthetic construct
WVGFFDY

SEQ ID NO: 26532 - protein, 7 aa, Artificial Sequence
  Synthetic construct
WVGFFVF

SEQ ID NO: 26533 - protein, 7 aa, Artificial Sequence
  Synthetic construct
WVGFFVY

SEQ ID NO: 26534 - protein, 7 aa, Artificial Sequence
  Synthetic construct
WVGFVFF

SEQ ID NO: 26535 - protein, 7 aa, Artificial Sequence
  Synthetic construct
WVGFVFY

SEQ ID NO: 26536 - protein, 7 aa, Artificial Sequence
  Synthetic construct
WVGFVRF

SEQ ID NO: 26537 - protein, 7 aa, Artificial Sequence
  Synthetic construct
WVGFVRY

SEQ ID NO: 26538 - protein, 7 aa, Artificial Sequence
  Synthetic construct
WVGFVCF

SEQ ID NO: 26539 - protein, 7 aa, Artificial Sequence
  Synthetic construct
WVGFVCY

SEQ ID NO: 26540 - protein, 7 aa, Artificial Sequence
  Synthetic construct
WVGFVLF

SEQ ID NO: 26541 - protein, 7 aa, Artificial Sequence
  Synthetic construct
WVGFVLY

SEQ ID NO: 26542 - protein, 7 aa, Artificial Sequence
  Synthetic construct
WVGFVAF

SEQ ID NO: 26543 - protein, 7 aa, Artificial Sequence
  Synthetic construct
WVGFVAY

SEQ ID NO: 26544 - protein, 7 aa, Artificial Sequence
  Synthetic construct
WVGFVQF

SEQ ID NO: 26545 - protein, 7 aa, Artificial Sequence
  Synthetic construct
WVGFVQY

SEQ ID NO: 26546 - protein, 7 aa, Artificial Sequence
  Synthetic construct
WVGFVDF

SEQ ID NO: 26547 - protein, 7 aa, Artificial Sequence
  Synthetic construct
WVGFVDY

SEQ ID NO: 26548 - protein, 7 aa, Artificial Sequence
  Synthetic construct
WVGFVVF

SEQ ID NO: 26549 - protein, 7 aa, Artificial Sequence
  Synthetic construct
WVGFVVY

SEQ ID NO: 26550 - protein, 7 aa, Artificial Sequence
  Synthetic construct
WVGFTFF

SEQ ID NO: 26551 - protein, 7 aa, Artificial Sequence
  Synthetic construct
WVGFTFY

SEQ ID NO: 26552 - protein, 7 aa, Artificial Sequence
  Synthetic construct
WVGFTRF

SEQ ID NO: 26553 - protein, 7 aa, Artificial Sequence
  Synthetic construct
WVGFTRY

SEQ ID NO: 26554 - protein, 7 aa, Artificial Sequence
  Synthetic construct
WVGFTCF

SEQ ID NO: 26555 - protein, 7 aa, Artificial Sequence
  Synthetic construct
WVGFTCY

SEQ ID NO: 26556 - protein, 7 aa, Artificial Sequence
  Synthetic construct
WVGFTLF

SEQ ID NO: 26557 - protein, 7 aa, Artificial Sequence
  Synthetic construct
WVGFTLY

SEQ ID NO: 26558 - protein, 7 aa, Artificial Sequence
  Synthetic construct
WVGFTAF

SEQ ID NO: 26559 - protein, 7 aa, Artificial Sequence
  Synthetic construct
WVGFTAY

SEQ ID NO: 26560 - protein, 7 aa, Artificial Sequence
  Synthetic construct
WVGFTQF

SEQ ID NO: 26561 - protein, 7 aa, Artificial Sequence
  Synthetic construct
WVGFTQY

SEQ ID NO: 26562 - protein, 7 aa, Artificial Sequence
  Synthetic construct
WVGFTDF

SEQ ID NO: 26563 - protein, 7 aa, Artificial Sequence
  Synthetic construct
WVGFTDY

SEQ ID NO: 26564 - protein, 7 aa, Artificial Sequence
  Synthetic construct
WVGFTVF

SEQ ID NO: 26565 - protein, 7 aa, Artificial Sequence
  Synthetic construct
WVGFTVY

SEQ ID NO: 26566 - protein, 7 aa, Artificial Sequence
  Synthetic construct
WVGFGFF

SEQ ID NO: 26567 - protein, 7 aa, Artificial Sequence
  Synthetic construct
WVGFGFY

SEQ ID NO: 26568 - protein, 7 aa, Artificial Sequence
  Synthetic construct
WVGFGRF

SEQ ID NO: 26569 - protein, 7 aa, Artificial Sequence
  Synthetic construct
WVGFGRY

SEQ ID NO: 26570 - protein, 7 aa, Artificial Sequence
  Synthetic construct
WVGFGCF

SEQ ID NO: 26571 - protein, 7 aa, Artificial Sequence
  Synthetic construct
WVGFGCY

SEQ ID NO: 26572 - protein, 7 aa, Artificial Sequence
  Synthetic construct
WVGFGLF

SEQ ID NO: 26573 - protein, 7 aa, Artificial Sequence
  Synthetic construct
WVGFGLY

SEQ ID NO: 26574 - protein, 7 aa, Artificial Sequence
  Synthetic construct
WVGFGAF

SEQ ID NO: 26575 - protein, 7 aa, Artificial Sequence
  Synthetic construct
WVGFGAY

SEQ ID NO: 26576 - protein, 7 aa, Artificial Sequence
  Synthetic construct
WVGFGQF

SEQ ID NO: 26577 - protein, 7 aa, Artificial Sequence
  Synthetic construct
WVGFGQY

SEQ ID NO: 26578 - protein, 7 aa, Artificial Sequence
  Synthetic construct
WVGFGDF

SEQ ID NO: 26579 - protein, 7 aa, Artificial Sequence
  Synthetic construct
WVGFGDY

SEQ ID NO: 26580 - protein, 7 aa, Artificial Sequence
  Synthetic construct
WVGFGVF

SEQ ID NO: 26581 - protein, 7 aa, Artificial Sequence
  Synthetic construct
WVGFGVY

SEQ ID NO: 26582 - protein, 7 aa, Artificial Sequence
  Synthetic construct
WVGFAFF

SEQ ID NO: 26583 - protein, 7 aa, Artificial Sequence
  Synthetic construct
WVGFAFY

SEQ ID NO: 26584 - protein, 7 aa, Artificial Sequence
  Synthetic construct
WVGFARF

SEQ ID NO: 26585 - protein, 7 aa, Artificial Sequence
  Synthetic construct
WVGFARY

SEQ ID NO: 26586 - protein, 7 aa, Artificial Sequence
  Synthetic construct
WVGFACF

SEQ ID NO: 26587 - protein, 7 aa, Artificial Sequence
  Synthetic construct
WVGFACY

SEQ ID NO: 26588 - protein, 7 aa, Artificial Sequence
  Synthetic construct
WVGFALF

SEQ ID NO: 26589 - protein, 7 aa, Artificial Sequence
  Synthetic construct
WVGFALY

SEQ ID NO: 26590 - protein, 7 aa, Artificial Sequence
  Synthetic construct
WVGFAAF

SEQ ID NO: 26591 - protein, 7 aa, Artificial Sequence
  Synthetic construct
WVGFAAY

SEQ ID NO: 26592 - protein, 7 aa, Artificial Sequence
  Synthetic construct
WVGFAQF

SEQ ID NO: 26593 - protein, 7 aa, Artificial Sequence
  Synthetic construct
WVGFAQY

SEQ ID NO: 26594 - protein, 7 aa, Artificial Sequence
  Synthetic construct
WVGFADF

SEQ ID NO: 26595 - protein, 7 aa, Artificial Sequence
  Synthetic construct
WVGFADY

SEQ ID NO: 26596 - protein, 7 aa, Artificial Sequence
  Synthetic construct
WVGFAVF

SEQ ID NO: 26597 - protein, 7 aa, Artificial Sequence
  Synthetic construct
WVGFAVY

SEQ ID NO: 26598 - protein, 7 aa, Artificial Sequence
  Synthetic construct
WVGFQFF

SEQ ID NO: 26599 - protein, 7 aa, Artificial Sequence
  Synthetic construct
WVGFQFY

SEQ ID NO: 26600 - protein, 7 aa, Artificial Sequence
  Synthetic construct
WVGFQRF

SEQ ID NO: 26601 - protein, 7 aa, Artificial Sequence
  Synthetic construct
WVGFQRY

SEQ ID NO: 26602 - protein, 7 aa, Artificial Sequence
  Synthetic construct
WVGFQCF

SEQ ID NO: 26603 - protein, 7 aa, Artificial Sequence
  Synthetic construct
WVGFQCY

SEQ ID NO: 26604 - protein, 7 aa, Artificial Sequence
  Synthetic construct
WVGFQLF

SEQ ID NO: 26605 - protein, 7 aa, Artificial Sequence
  Synthetic construct
WVGFQLY

SEQ ID NO: 26606 - protein, 7 aa, Artificial Sequence
  Synthetic construct
WVGFQAF

SEQ ID NO: 26607 - protein, 7 aa, Artificial Sequence
  Synthetic construct
WVGFQAY

SEQ ID NO: 26608 - protein, 7 aa, Artificial Sequence
  Synthetic construct
WVGFQQF

SEQ ID NO: 26609 - protein, 7 aa, Artificial Sequence
  Synthetic construct
WVGFQQY

SEQ ID NO: 26610 - protein, 7 aa, Artificial Sequence
  Synthetic construct
WVGFQDF

SEQ ID NO: 26611 - protein, 7 aa, Artificial Sequence
  Synthetic construct
WVGFQDY

SEQ ID NO: 26612 - protein, 7 aa, Artificial Sequence
  Synthetic construct
WVGFQVF

SEQ ID NO: 26613 - protein, 7 aa, Artificial Sequence
  Synthetic construct
WVGFQVY

SEQ ID NO: 26614 - protein, 7 aa, Artificial Sequence
  Synthetic construct
WIIYIFF

SEQ ID NO: 26615 - protein, 7 aa, Artificial Sequence
  Synthetic construct
WIIYIFY

SEQ ID NO: 26616 - protein, 7 aa, Artificial Sequence
  Synthetic construct
WIIYIRF

SEQ ID NO: 26617 - protein, 7 aa, Artificial Sequence
  Synthetic construct
WIIYIRY

SEQ ID NO: 26618 - protein, 7 aa, Artificial Sequence
  Synthetic construct
WIIYICF

SEQ ID NO: 26619 - protein, 7 aa, Artificial Sequence
  Synthetic construct
WIIYICY

SEQ ID NO: 26620 - protein, 7 aa, Artificial Sequence
  Synthetic construct
WIIYILF

SEQ ID NO: 26621 - protein, 7 aa, Artificial Sequence
  Synthetic construct
WIIYILY

SEQ ID NO: 26622 - protein, 7 aa, Artificial Sequence
  Synthetic construct
WIIYIAF

SEQ ID NO: 26623 - protein, 7 aa, Artificial Sequence
  Synthetic construct
WIIYIAY

SEQ ID NO: 26624 - protein, 7 aa, Artificial Sequence
  Synthetic construct
WIIYIQF

SEQ ID NO: 26625 - protein, 7 aa, Artificial Sequence
  Synthetic construct
WIIYIQY

SEQ ID NO: 26626 - protein, 7 aa, Artificial Sequence
  Synthetic construct
WIIYIDF

SEQ ID NO: 26627 - protein, 7 aa, Artificial Sequence
  Synthetic construct
WIIYIDY

SEQ ID NO: 26628 - protein, 7 aa, Artificial Sequence
  Synthetic construct
WIIYIVF

SEQ ID NO: 26629 - protein, 7 aa, Artificial Sequence
  Synthetic construct
WIIYIVY

SEQ ID NO: 26630 - protein, 7 aa, Artificial Sequence
  Synthetic construct
WIIYDFF

SEQ ID NO: 26631 - protein, 7 aa, Artificial Sequence
  Synthetic construct
WIIYDFY

SEQ ID NO: 26632 - protein, 7 aa, Artificial Sequence
  Synthetic construct
WIIYDRF

SEQ ID NO: 26633 - protein, 7 aa, Artificial Sequence
  Synthetic construct
WIIYDRY

SEQ ID NO: 26634 - protein, 7 aa, Artificial Sequence
  Synthetic construct
WIIYDCF

SEQ ID NO: 26635 - protein, 7 aa, Artificial Sequence
  Synthetic construct
WIIYDCY

SEQ ID NO: 26636 - protein, 7 aa, Artificial Sequence
  Synthetic construct
WIIYDLF

SEQ ID NO: 26637 - protein, 7 aa, Artificial Sequence
  Synthetic construct
WIIYDLY

SEQ ID NO: 26638 - protein, 7 aa, Artificial Sequence
  Synthetic construct
WIIYDAF

SEQ ID NO: 26639 - protein, 7 aa, Artificial Sequence
  Synthetic construct
WIIYDAY

SEQ ID NO: 26640 - protein, 7 aa, Artificial Sequence
  Synthetic construct
WIIYDQF

SEQ ID NO: 26641 - protein, 7 aa, Artificial Sequence
  Synthetic construct
WIIYDQY

SEQ ID NO: 26642 - protein, 7 aa, Artificial Sequence
  Synthetic construct
WIIYDDF

SEQ ID NO: 26643 - protein, 7 aa, Artificial Sequence
  Synthetic construct
WIIYDDY

SEQ ID NO: 26644 - protein, 7 aa, Artificial Sequence
  Synthetic construct
WIIYDVF

SEQ ID NO: 26645 - protein, 7 aa, Artificial Sequence
  Synthetic construct
WIIYDVY

SEQ ID NO: 26646 - protein, 7 aa, Artificial Sequence
  Synthetic construct
WIIYYFF

SEQ ID NO: 26647 - protein, 7 aa, Artificial Sequence
  Synthetic construct
WIIYYFY

SEQ ID NO: 26648 - protein, 7 aa, Artificial Sequence
  Synthetic construct
WIIYYRF

SEQ ID NO: 26649 - protein, 7 aa, Artificial Sequence
  Synthetic construct
WIIYYRY

SEQ ID NO: 26650 - protein, 7 aa, Artificial Sequence
  Synthetic construct
WIIYYCF

SEQ ID NO: 26651 - protein, 7 aa, Artificial Sequence
  Synthetic construct
WIIYYCY

SEQ ID NO: 26652 - protein, 7 aa, Artificial Sequence
  Synthetic construct
WIIYYLF

SEQ ID NO: 26653 - protein, 7 aa, Artificial Sequence
  Synthetic construct
WIIYYLY

SEQ ID NO: 26654 - protein, 7 aa, Artificial Sequence
  Synthetic construct
WIIYYAF

SEQ ID NO: 26655 - protein, 7 aa, Artificial Sequence
  Synthetic construct
WIIYYAY

SEQ ID NO: 26656 - protein, 7 aa, Artificial Sequence
  Synthetic construct
WIIYYQF

SEQ ID NO: 26657 - protein, 7 aa, Artificial Sequence
  Synthetic construct
WIIYYQY

SEQ ID NO: 26658 - protein, 7 aa, Artificial Sequence
  Synthetic construct
WIIYYDF

SEQ ID NO: 26659 - protein, 7 aa, Artificial Sequence
  Synthetic construct
WIIYYDY

SEQ ID NO: 26660 - protein, 7 aa, Artificial Sequence
  Synthetic construct
WIIYYVF

SEQ ID NO: 26661 - protein, 7 aa, Artificial Sequence
  Synthetic construct
WIIYYVY

SEQ ID NO: 26662 - protein, 7 aa, Artificial Sequence
  Synthetic construct
WIIYFFF

SEQ ID NO: 26663 - protein, 7 aa, Artificial Sequence
  Synthetic construct
WIIYFFY

SEQ ID NO: 26664 - protein, 7 aa, Artificial Sequence
  Synthetic construct
WIIYFRF

SEQ ID NO: 26665 - protein, 7 aa, Artificial Sequence
  Synthetic construct
WIIYFRY

SEQ ID NO: 26666 - protein, 7 aa, Artificial Sequence
  Synthetic construct
WIIYFCF

SEQ ID NO: 26667 - protein, 7 aa, Artificial Sequence
  Synthetic construct
WIIYFCY

SEQ ID NO: 26668 - protein, 7 aa, Artificial Sequence
  Synthetic construct
WIIYFLF

SEQ ID NO: 26669 - protein, 7 aa, Artificial Sequence
  Synthetic construct
WIIYFLY

SEQ ID NO: 26670 - protein, 7 aa, Artificial Sequence
  Synthetic construct
WIIYFAF

SEQ ID NO: 26671 - protein, 7 aa, Artificial Sequence
  Synthetic construct
WIIYFAY

SEQ ID NO: 26672 - protein, 7 aa, Artificial Sequence
  Synthetic construct
WIIYFQF

SEQ ID NO: 26673 - protein, 7 aa, Artificial Sequence
  Synthetic construct
WIIYFQY

SEQ ID NO: 26674 - protein, 7 aa, Artificial Sequence
  Synthetic construct
WIIYFDF

SEQ ID NO: 26675 - protein, 7 aa, Artificial Sequence
  Synthetic construct
WIIYFDY

SEQ ID NO: 26676 - protein, 7 aa, Artificial Sequence
  Synthetic construct
WIIYFVF

SEQ ID NO: 26677 - protein, 7 aa, Artificial Sequence
  Synthetic construct
WIIYFVY

SEQ ID NO: 26678 - protein, 7 aa, Artificial Sequence
  Synthetic construct
WIIYVFF

SEQ ID NO: 26679 - protein, 7 aa, Artificial Sequence
  Synthetic construct
WIIYVFY

SEQ ID NO: 26680 - protein, 7 aa, Artificial Sequence
  Synthetic construct
WIIYVRF

SEQ ID NO: 26681 - protein, 7 aa, Artificial Sequence
  Synthetic construct
WIIYVRY

SEQ ID NO: 26682 - protein, 7 aa, Artificial Sequence
  Synthetic construct
WIIYVCF

SEQ ID NO: 26683 - protein, 7 aa, Artificial Sequence
  Synthetic construct
WIIYVCY

SEQ ID NO: 26684 - protein, 7 aa, Artificial Sequence
  Synthetic construct
WIIYVLF

SEQ ID NO: 26685 - protein, 7 aa, Artificial Sequence
  Synthetic construct
WIIYVLY

SEQ ID NO: 26686 - protein, 7 aa, Artificial Sequence
  Synthetic construct
WIIYVAF

SEQ ID NO: 26687 - protein, 7 aa, Artificial Sequence
  Synthetic construct
WIIYVAY

SEQ ID NO: 26688 - protein, 7 aa, Artificial Sequence
  Synthetic construct
WIIYVQF

SEQ ID NO: 26689 - protein, 7 aa, Artificial Sequence
  Synthetic construct
WIIYVQY

SEQ ID NO: 26690 - protein, 7 aa, Artificial Sequence
  Synthetic construct
WIIYVDF

SEQ ID NO: 26691 - protein, 7 aa, Artificial Sequence
  Synthetic construct
WIIYVDY

SEQ ID NO: 26692 - protein, 7 aa, Artificial Sequence
  Synthetic construct
WIIYVVF

SEQ ID NO: 26693 - protein, 7 aa, Artificial Sequence
  Synthetic construct
WIIYVVY

SEQ ID NO: 26694 - protein, 7 aa, Artificial Sequence
  Synthetic construct
WIIYTFF

SEQ ID NO: 26695 - protein, 7 aa, Artificial Sequence
  Synthetic construct
WIIYTFY

SEQ ID NO: 26696 - protein, 7 aa, Artificial Sequence
  Synthetic construct
WIIYTRF

SEQ ID NO: 26697 - protein, 7 aa, Artificial Sequence
  Synthetic construct
WIIYTRY

SEQ ID NO: 26698 - protein, 7 aa, Artificial Sequence
  Synthetic construct
WIIYTCF

SEQ ID NO: 26699 - protein, 7 aa, Artificial Sequence
  Synthetic construct
WIIYTCY

SEQ ID NO: 26700 - protein, 7 aa, Artificial Sequence
  Synthetic construct
WIIYTLF

SEQ ID NO: 26701 - protein, 7 aa, Artificial Sequence
  Synthetic construct
WIIYTLY

SEQ ID NO: 26702 - protein, 7 aa, Artificial Sequence
  Synthetic construct
WIIYTAF

SEQ ID NO: 26703 - protein, 7 aa, Artificial Sequence
  Synthetic construct
WIIYTAY

SEQ ID NO: 26704 - protein, 7 aa, Artificial Sequence
  Synthetic construct
WIIYTQF

SEQ ID NO: 26705 - protein, 7 aa, Artificial Sequence
  Synthetic construct
WIIYTQY

SEQ ID NO: 26706 - protein, 7 aa, Artificial Sequence
  Synthetic construct
WIIYTDF

SEQ ID NO: 26707 - protein, 7 aa, Artificial Sequence
  Synthetic construct
WIIYTDY

SEQ ID NO: 26708 - protein, 7 aa, Artificial Sequence
  Synthetic construct
WIIYTVF

SEQ ID NO: 26709 - protein, 7 aa, Artificial Sequence
  Synthetic construct
WIIYTVY

SEQ ID NO: 26710 - protein, 7 aa, Artificial Sequence
  Synthetic construct
WIIYGFF

SEQ ID NO: 26711 - protein, 7 aa, Artificial Sequence
  Synthetic construct
WIIYGFY

SEQ ID NO: 26712 - protein, 7 aa, Artificial Sequence
  Synthetic construct
WIIYGRF

SEQ ID NO: 26713 - protein, 7 aa, Artificial Sequence
  Synthetic construct
WIIYGRY

SEQ ID NO: 26714 - protein, 7 aa, Artificial Sequence
  Synthetic construct
WIIYGCF

SEQ ID NO: 26715 - protein, 7 aa, Artificial Sequence
  Synthetic construct
WIIYGCY

SEQ ID NO: 26716 - protein, 7 aa, Artificial Sequence
  Synthetic construct
WIIYGLF

SEQ ID NO: 26717 - protein, 7 aa, Artificial Sequence
  Synthetic construct
WIIYGLY

SEQ ID NO: 26718 - protein, 7 aa, Artificial Sequence
  Synthetic construct
WIIYGAF

SEQ ID NO: 26719 - protein, 7 aa, Artificial Sequence
  Synthetic construct
WIIYGAY

SEQ ID NO: 26720 - protein, 7 aa, Artificial Sequence
  Synthetic construct
WIIYGQF

SEQ ID NO: 26721 - protein, 7 aa, Artificial Sequence
  Synthetic construct
WIIYGQY

SEQ ID NO: 26722 - protein, 7 aa, Artificial Sequence
  Synthetic construct
WIIYGDF

SEQ ID NO: 26723 - protein, 7 aa, Artificial Sequence
  Synthetic construct
WIIYGDY

SEQ ID NO: 26724 - protein, 7 aa, Artificial Sequence
  Synthetic construct
WIIYGVF

SEQ ID NO: 26725 - protein, 7 aa, Artificial Sequence
  Synthetic construct
WIIYGVY

SEQ ID NO: 26726 - protein, 7 aa, Artificial Sequence
  Synthetic construct
WIIYAFF

SEQ ID NO: 26727 - protein, 7 aa, Artificial Sequence
  Synthetic construct
WIIYAFY

SEQ ID NO: 26728 - protein, 7 aa, Artificial Sequence
  Synthetic construct
WIIYARF

SEQ ID NO: 26729 - protein, 7 aa, Artificial Sequence
  Synthetic construct
WIIYARY

SEQ ID NO: 26730 - protein, 7 aa, Artificial Sequence
  Synthetic construct
WIIYACF

SEQ ID NO: 26731 - protein, 7 aa, Artificial Sequence
  Synthetic construct
WIIYACY

SEQ ID NO: 26732 - protein, 7 aa, Artificial Sequence
  Synthetic construct
WIIYALF

SEQ ID NO: 26733 - protein, 7 aa, Artificial Sequence
  Synthetic construct
WIIYALY

SEQ ID NO: 26734 - protein, 7 aa, Artificial Sequence
  Synthetic construct
WIIYAAF

SEQ ID NO: 26735 - protein, 7 aa, Artificial Sequence
  Synthetic construct
WIIYAAY

SEQ ID NO: 26736 - protein, 7 aa, Artificial Sequence
  Synthetic construct
WIIYAQF

SEQ ID NO: 26737 - protein, 7 aa, Artificial Sequence
  Synthetic construct
WIIYAQY

SEQ ID NO: 26738 - protein, 7 aa, Artificial Sequence
  Synthetic construct
WIIYADF

SEQ ID NO: 26739 - protein, 7 aa, Artificial Sequence
  Synthetic construct
WIIYADY

SEQ ID NO: 26740 - protein, 7 aa, Artificial Sequence
  Synthetic construct
WIIYAVF

SEQ ID NO: 26741 - protein, 7 aa, Artificial Sequence
  Synthetic construct
WIIYAVY

SEQ ID NO: 26742 - protein, 7 aa, Artificial Sequence
  Synthetic construct
WIIYQFF

SEQ ID NO: 26743 - protein, 7 aa, Artificial Sequence
  Synthetic construct
WIIYQFY

SEQ ID NO: 26744 - protein, 7 aa, Artificial Sequence
  Synthetic construct
WIIYQRF

SEQ ID NO: 26745 - protein, 7 aa, Artificial Sequence
  Synthetic construct
WIIYQRY

SEQ ID NO: 26746 - protein, 7 aa, Artificial Sequence
  Synthetic construct
WIIYQCF

SEQ ID NO: 26747 - protein, 7 aa, Artificial Sequence
  Synthetic construct
WIIYQCY

SEQ ID NO: 26748 - protein, 7 aa, Artificial Sequence
  Synthetic construct
WIIYQLF

SEQ ID NO: 26749 - protein, 7 aa, Artificial Sequence
  Synthetic construct
WIIYQLY

SEQ ID NO: 26750 - protein, 7 aa, Artificial Sequence
  Synthetic construct
WIIYQAF

SEQ ID NO: 26751 - protein, 7 aa, Artificial Sequence
  Synthetic construct
WIIYQAY

SEQ ID NO: 26752 - protein, 7 aa, Artificial Sequence
  Synthetic construct
WIIYQQF

SEQ ID NO: 26753 - protein, 7 aa, Artificial Sequence
  Synthetic construct
WIIYQQY

SEQ ID NO: 26754 - protein, 7 aa, Artificial Sequence
  Synthetic construct
WIIYQDF

SEQ ID NO: 26755 - protein, 7 aa, Artificial Sequence
  Synthetic construct
WIIYQDY

SEQ ID NO: 26756 - protein, 7 aa, Artificial Sequence
  Synthetic construct
WIIYQVF

SEQ ID NO: 26757 - protein, 7 aa, Artificial Sequence
  Synthetic construct
WIIYQVY

SEQ ID NO: 26758 - protein, 7 aa, Artificial Sequence
  Synthetic construct
WIIPIFF

SEQ ID NO: 26759 - protein, 7 aa, Artificial Sequence
  Synthetic construct
WIIPIFY

SEQ ID NO: 26760 - protein, 7 aa, Artificial Sequence
  Synthetic construct
WIIPIRF

SEQ ID NO: 26761 - protein, 7 aa, Artificial Sequence
  Synthetic construct
WIIPIRY

SEQ ID NO: 26762 - protein, 7 aa, Artificial Sequence
  Synthetic construct
WIIPICF

SEQ ID NO: 26763 - protein, 7 aa, Artificial Sequence
  Synthetic construct
WIIPICY

SEQ ID NO: 26764 - protein, 7 aa, Artificial Sequence
  Synthetic construct
WIIPILF

SEQ ID NO: 26765 - protein, 7 aa, Artificial Sequence
  Synthetic construct
WIIPILY

SEQ ID NO: 26766 - protein, 7 aa, Artificial Sequence
  Synthetic construct
WIIPIAF

SEQ ID NO: 26767 - protein, 7 aa, Artificial Sequence
  Synthetic construct
WIIPIAY

SEQ ID NO: 26768 - protein, 7 aa, Artificial Sequence
  Synthetic construct
WIIPIQF

SEQ ID NO: 26769 - protein, 7 aa, Artificial Sequence
  Synthetic construct
WIIPIQY

SEQ ID NO: 26770 - protein, 7 aa, Artificial Sequence
  Synthetic construct
WIIPIDF

SEQ ID NO: 26771 - protein, 7 aa, Artificial Sequence
  Synthetic construct
WIIPIDY

SEQ ID NO: 26772 - protein, 7 aa, Artificial Sequence
  Synthetic construct
WIIPIVF

SEQ ID NO: 26773 - protein, 7 aa, Artificial Sequence
  Synthetic construct
WIIPIVY

SEQ ID NO: 26774 - protein, 7 aa, Artificial Sequence
  Synthetic construct
WIIPDFF

SEQ ID NO: 26775 - protein, 7 aa, Artificial Sequence
  Synthetic construct
WIIPDFY

SEQ ID NO: 26776 - protein, 7 aa, Artificial Sequence
  Synthetic construct
WIIPDRF

SEQ ID NO: 26777 - protein, 7 aa, Artificial Sequence
  Synthetic construct
WIIPDRY

SEQ ID NO: 26778 - protein, 7 aa, Artificial Sequence
  Synthetic construct
WIIPDCF

SEQ ID NO: 26779 - protein, 7 aa, Artificial Sequence
  Synthetic construct
WIIPDCY

SEQ ID NO: 26780 - protein, 7 aa, Artificial Sequence
  Synthetic construct
WIIPDLF

SEQ ID NO: 26781 - protein, 7 aa, Artificial Sequence
  Synthetic construct
WIIPDLY

SEQ ID NO: 26782 - protein, 7 aa, Artificial Sequence
  Synthetic construct
WIIPDAF

SEQ ID NO: 26783 - protein, 7 aa, Artificial Sequence
  Synthetic construct
WIIPDAY

SEQ ID NO: 26784 - protein, 7 aa, Artificial Sequence
  Synthetic construct
WIIPDQF

SEQ ID NO: 26785 - protein, 7 aa, Artificial Sequence
  Synthetic construct
WIIPDQY

SEQ ID NO: 26786 - protein, 7 aa, Artificial Sequence
  Synthetic construct
WIIPDDF

SEQ ID NO: 26787 - protein, 7 aa, Artificial Sequence
  Synthetic construct
WIIPDDY

SEQ ID NO: 26788 - protein, 7 aa, Artificial Sequence
  Synthetic construct
WIIPDVF

SEQ ID NO: 26789 - protein, 7 aa, Artificial Sequence
  Synthetic construct
WIIPDVY

SEQ ID NO: 26790 - protein, 7 aa, Artificial Sequence
  Synthetic construct
WIIPYFF

SEQ ID NO: 26791 - protein, 7 aa, Artificial Sequence
  Synthetic construct
WIIPYFY

SEQ ID NO: 26792 - protein, 7 aa, Artificial Sequence
  Synthetic construct
WIIPYRF

SEQ ID NO: 26793 - protein, 7 aa, Artificial Sequence
  Synthetic construct
WIIPYRY

SEQ ID NO: 26794 - protein, 7 aa, Artificial Sequence
  Synthetic construct
WIIPYCF

SEQ ID NO: 26795 - protein, 7 aa, Artificial Sequence
  Synthetic construct
WIIPYCY

SEQ ID NO: 26796 - protein, 7 aa, Artificial Sequence
  Synthetic construct
WIIPYLF

SEQ ID NO: 26797 - protein, 7 aa, Artificial Sequence
  Synthetic construct
WIIPYLY

SEQ ID NO: 26798 - protein, 7 aa, Artificial Sequence
  Synthetic construct
WIIPYAF

SEQ ID NO: 26799 - protein, 7 aa, Artificial Sequence
  Synthetic construct
WIIPYAY

SEQ ID NO: 26800 - protein, 7 aa, Artificial Sequence
  Synthetic construct
WIIPYQF

SEQ ID NO: 26801 - protein, 7 aa, Artificial Sequence
  Synthetic construct
WIIPYQY

SEQ ID NO: 26802 - protein, 7 aa, Artificial Sequence
  Synthetic construct
WIIPYDF

SEQ ID NO: 26803 - protein, 7 aa, Artificial Sequence
  Synthetic construct
WIIPYDY

SEQ ID NO: 26804 - protein, 7 aa, Artificial Sequence
  Synthetic construct
WIIPYVF

SEQ ID NO: 26805 - protein, 7 aa, Artificial Sequence
  Synthetic construct
WIIPYVY

SEQ ID NO: 26806 - protein, 7 aa, Artificial Sequence
  Synthetic construct
WIIPFFF

SEQ ID NO: 26807 - protein, 7 aa, Artificial Sequence
  Synthetic construct
WIIPFFY

SEQ ID NO: 26808 - protein, 7 aa, Artificial Sequence
  Synthetic construct
WIIPFRF

SEQ ID NO: 26809 - protein, 7 aa, Artificial Sequence
  Synthetic construct
WIIPFRY

SEQ ID NO: 26810 - protein, 7 aa, Artificial Sequence
  Synthetic construct
WIIPFCF

SEQ ID NO: 26811 - protein, 7 aa, Artificial Sequence
  Synthetic construct
WIIPFCY

SEQ ID NO: 26812 - protein, 7 aa, Artificial Sequence
  Synthetic construct
WIIPFLF

SEQ ID NO: 26813 - protein, 7 aa, Artificial Sequence
  Synthetic construct
WIIPFLY

SEQ ID NO: 26814 - protein, 7 aa, Artificial Sequence
  Synthetic construct
WIIPFAF

SEQ ID NO: 26815 - protein, 7 aa, Artificial Sequence
  Synthetic construct
WIIPFAY

SEQ ID NO: 26816 - protein, 7 aa, Artificial Sequence
  Synthetic construct
WIIPFQF

SEQ ID NO: 26817 - protein, 7 aa, Artificial Sequence
  Synthetic construct
WIIPFQY

SEQ ID NO: 26818 - protein, 7 aa, Artificial Sequence
  Synthetic construct
WIIPFDF

SEQ ID NO: 26819 - protein, 7 aa, Artificial Sequence
  Synthetic construct
WIIPFDY

SEQ ID NO: 26820 - protein, 7 aa, Artificial Sequence
  Synthetic construct
WIIPFVF

SEQ ID NO: 26821 - protein, 7 aa, Artificial Sequence
  Synthetic construct
WIIPFVY

SEQ ID NO: 26822 - protein, 7 aa, Artificial Sequence
  Synthetic construct
WIIPVFF

SEQ ID NO: 26823 - protein, 7 aa, Artificial Sequence
  Synthetic construct
WIIPVFY

SEQ ID NO: 26824 - protein, 7 aa, Artificial Sequence
  Synthetic construct
WIIPVRF

SEQ ID NO: 26825 - protein, 7 aa, Artificial Sequence
  Synthetic construct
WIIPVRY

SEQ ID NO: 26826 - protein, 7 aa, Artificial Sequence
  Synthetic construct
WIIPVCF

SEQ ID NO: 26827 - protein, 7 aa, Artificial Sequence
  Synthetic construct
WIIPVCY

SEQ ID NO: 26828 - protein, 7 aa, Artificial Sequence
  Synthetic construct
WIIPVLF

SEQ ID NO: 26829 - protein, 7 aa, Artificial Sequence
  Synthetic construct
WIIPVLY

SEQ ID NO: 26830 - protein, 7 aa, Artificial Sequence
  Synthetic construct
WIIPVAF

SEQ ID NO: 26831 - protein, 7 aa, Artificial Sequence
  Synthetic construct
WIIPVAY

SEQ ID NO: 26832 - protein, 7 aa, Artificial Sequence
  Synthetic construct
WIIPVQF

SEQ ID NO: 26833 - protein, 7 aa, Artificial Sequence
  Synthetic construct
WIIPVQY

SEQ ID NO: 26834 - protein, 7 aa, Artificial Sequence
  Synthetic construct
WIIPVDF

SEQ ID NO: 26835 - protein, 7 aa, Artificial Sequence
  Synthetic construct
WIIPVDY

SEQ ID NO: 26836 - protein, 7 aa, Artificial Sequence
  Synthetic construct
WIIPVVF

SEQ ID NO: 26837 - protein, 7 aa, Artificial Sequence
  Synthetic construct
WIIPVVY

SEQ ID NO: 26838 - protein, 7 aa, Artificial Sequence
  Synthetic construct
WIIPTFF

SEQ ID NO: 26839 - protein, 7 aa, Artificial Sequence
  Synthetic construct
WIIPTFY

SEQ ID NO: 26840 - protein, 7 aa, Artificial Sequence
  Synthetic construct
WIIPTRF

SEQ ID NO: 26841 - protein, 7 aa, Artificial Sequence
  Synthetic construct
WIIPTRY

SEQ ID NO: 26842 - protein, 7 aa, Artificial Sequence
  Synthetic construct
WIIPTCF

SEQ ID NO: 26843 - protein, 7 aa, Artificial Sequence
  Synthetic construct
WIIPTCY

SEQ ID NO: 26844 - protein, 7 aa, Artificial Sequence
  Synthetic construct
WIIPTLF

SEQ ID NO: 26845 - protein, 7 aa, Artificial Sequence
  Synthetic construct
WIIPTLY

SEQ ID NO: 26846 - protein, 7 aa, Artificial Sequence
  Synthetic construct
WIIPTAF

SEQ ID NO: 26847 - protein, 7 aa, Artificial Sequence
  Synthetic construct
WIIPTAY

SEQ ID NO: 26848 - protein, 7 aa, Artificial Sequence
  Synthetic construct
WIIPTQF

SEQ ID NO: 26849 - protein, 7 aa, Artificial Sequence
  Synthetic construct
WIIPTQY

SEQ ID NO: 26850 - protein, 7 aa, Artificial Sequence
  Synthetic construct
WIIPTDF

SEQ ID NO: 26851 - protein, 7 aa, Artificial Sequence
  Synthetic construct
WIIPTDY

SEQ ID NO: 26852 - protein, 7 aa, Artificial Sequence
  Synthetic construct
WIIPTVF

SEQ ID NO: 26853 - protein, 7 aa, Artificial Sequence
  Synthetic construct
WIIPTVY

SEQ ID NO: 26854 - protein, 7 aa, Artificial Sequence
  Synthetic construct
WIIPGFF

SEQ ID NO: 26855 - protein, 7 aa, Artificial Sequence
  Synthetic construct
WIIPGFY

SEQ ID NO: 26856 - protein, 7 aa, Artificial Sequence
  Synthetic construct
WIIPGRF

SEQ ID NO: 26857 - protein, 7 aa, Artificial Sequence
  Synthetic construct
WIIPGRY

SEQ ID NO: 26858 - protein, 7 aa, Artificial Sequence
  Synthetic construct
WIIPGCF

SEQ ID NO: 26859 - protein, 7 aa, Artificial Sequence
  Synthetic construct
WIIPGCY

SEQ ID NO: 26860 - protein, 7 aa, Artificial Sequence
  Synthetic construct
WIIPGLF

SEQ ID NO: 26861 - protein, 7 aa, Artificial Sequence
  Synthetic construct
WIIPGLY

SEQ ID NO: 26862 - protein, 7 aa, Artificial Sequence
  Synthetic construct
WIIPGAF

SEQ ID NO: 26863 - protein, 7 aa, Artificial Sequence
  Synthetic construct
WIIPGAY

SEQ ID NO: 26864 - protein, 7 aa, Artificial Sequence
  Synthetic construct
WIIPGQF

SEQ ID NO: 26865 - protein, 7 aa, Artificial Sequence
  Synthetic construct
WIIPGQY

SEQ ID NO: 26866 - protein, 7 aa, Artificial Sequence
  Synthetic construct
WIIPGDF

SEQ ID NO: 26867 - protein, 7 aa, Artificial Sequence
  Synthetic construct
WIIPGDY

SEQ ID NO: 26868 - protein, 7 aa, Artificial Sequence
  Synthetic construct
WIIPGVF

SEQ ID NO: 26869 - protein, 7 aa, Artificial Sequence
  Synthetic construct
WIIPGVY

SEQ ID NO: 26870 - protein, 7 aa, Artificial Sequence
  Synthetic construct
WIIPAFF

SEQ ID NO: 26871 - protein, 7 aa, Artificial Sequence
  Synthetic construct
WIIPAFY

SEQ ID NO: 26872 - protein, 7 aa, Artificial Sequence
  Synthetic construct
WIIPARF

SEQ ID NO: 26873 - protein, 7 aa, Artificial Sequence
  Synthetic construct
WIIPARY

SEQ ID NO: 26874 - protein, 7 aa, Artificial Sequence
  Synthetic construct
WIIPACF

SEQ ID NO: 26875 - protein, 7 aa, Artificial Sequence
  Synthetic construct
WIIPACY

SEQ ID NO: 26876 - protein, 7 aa, Artificial Sequence
  Synthetic construct
WIIPALF

SEQ ID NO: 26877 - protein, 7 aa, Artificial Sequence
  Synthetic construct
WIIPALY

SEQ ID NO: 26878 - protein, 7 aa, Artificial Sequence
  Synthetic construct
WIIPAAF

SEQ ID NO: 26879 - protein, 7 aa, Artificial Sequence
  Synthetic construct
WIIPAAY

SEQ ID NO: 26880 - protein, 7 aa, Artificial Sequence
  Synthetic construct
WIIPAQF

SEQ ID NO: 26881 - protein, 7 aa, Artificial Sequence
  Synthetic construct
WIIPAQY

SEQ ID NO: 26882 - protein, 7 aa, Artificial Sequence
  Synthetic construct
WIIPADF

SEQ ID NO: 26883 - protein, 7 aa, Artificial Sequence
  Synthetic construct
WIIPADY

SEQ ID NO: 26884 - protein, 7 aa, Artificial Sequence
  Synthetic construct
WIIPAVF

SEQ ID NO: 26885 - protein, 7 aa, Artificial Sequence
  Synthetic construct
WIIPAVY

SEQ ID NO: 26886 - protein, 7 aa, Artificial Sequence
  Synthetic construct
WIIPQFF

SEQ ID NO: 26887 - protein, 7 aa, Artificial Sequence
  Synthetic construct
WIIPQFY

SEQ ID NO: 26888 - protein, 7 aa, Artificial Sequence
  Synthetic construct
WIIPQRF

SEQ ID NO: 26889 - protein, 7 aa, Artificial Sequence
  Synthetic construct
WIIPQRY

SEQ ID NO: 26890 - protein, 7 aa, Artificial Sequence
  Synthetic construct
WIIPQCF

SEQ ID NO: 26891 - protein, 7 aa, Artificial Sequence
  Synthetic construct
WIIPQCY

SEQ ID NO: 26892 - protein, 7 aa, Artificial Sequence
  Synthetic construct
WIIPQLF

SEQ ID NO: 26893 - protein, 7 aa, Artificial Sequence
  Synthetic construct
WIIPQLY

SEQ ID NO: 26894 - protein, 7 aa, Artificial Sequence
  Synthetic construct
WIIPQAF

SEQ ID NO: 26895 - protein, 7 aa, Artificial Sequence
  Synthetic construct
WIIPQAY

SEQ ID NO: 26896 - protein, 7 aa, Artificial Sequence
  Synthetic construct
WIIPQQF

SEQ ID NO: 26897 - protein, 7 aa, Artificial Sequence
  Synthetic construct
WIIPQQY

SEQ ID NO: 26898 - protein, 7 aa, Artificial Sequence
  Synthetic construct
WIIPQDF

SEQ ID NO: 26899 - protein, 7 aa, Artificial Sequence
  Synthetic construct
WIIPQDY

SEQ ID NO: 26900 - protein, 7 aa, Artificial Sequence
  Synthetic construct
WIIPQVF

SEQ ID NO: 26901 - protein, 7 aa, Artificial Sequence
  Synthetic construct
WIIPQVY

SEQ ID NO: 26902 - protein, 7 aa, Artificial Sequence
  Synthetic construct
WIIHIFF

SEQ ID NO: 26903 - protein, 7 aa, Artificial Sequence
  Synthetic construct
WIIHIFY

SEQ ID NO: 26904 - protein, 7 aa, Artificial Sequence
  Synthetic construct
WIIHIRF

SEQ ID NO: 26905 - protein, 7 aa, Artificial Sequence
  Synthetic construct
WIIHIRY

SEQ ID NO: 26906 - protein, 7 aa, Artificial Sequence
  Synthetic construct
WIIHICF

SEQ ID NO: 26907 - protein, 7 aa, Artificial Sequence
  Synthetic construct
WIIHICY

SEQ ID NO: 26908 - protein, 7 aa, Artificial Sequence
  Synthetic construct
WIIHILF

SEQ ID NO: 26909 - protein, 7 aa, Artificial Sequence
  Synthetic construct
WIIHILY

SEQ ID NO: 26910 - protein, 7 aa, Artificial Sequence
  Synthetic construct
WIIHIAF

SEQ ID NO: 26911 - protein, 7 aa, Artificial Sequence
  Synthetic construct
WIIHIAY

SEQ ID NO: 26912 - protein, 7 aa, Artificial Sequence
  Synthetic construct
WIIHIQF

SEQ ID NO: 26913 - protein, 7 aa, Artificial Sequence
  Synthetic construct
WIIHIQY

SEQ ID NO: 26914 - protein, 7 aa, Artificial Sequence
  Synthetic construct
WIIHIDF

SEQ ID NO: 26915 - protein, 7 aa, Artificial Sequence
  Synthetic construct
WIIHIDY

SEQ ID NO: 26916 - protein, 7 aa, Artificial Sequence
  Synthetic construct
WIIHIVF

SEQ ID NO: 26917 - protein, 7 aa, Artificial Sequence
  Synthetic construct
WIIHIVY

SEQ ID NO: 26918 - protein, 7 aa, Artificial Sequence
  Synthetic construct
WIIHDFF

SEQ ID NO: 26919 - protein, 7 aa, Artificial Sequence
  Synthetic construct
WIIHDFY

SEQ ID NO: 26920 - protein, 7 aa, Artificial Sequence
  Synthetic construct
WIIHDRF

SEQ ID NO: 26921 - protein, 7 aa, Artificial Sequence
  Synthetic construct
WIIHDRY

SEQ ID NO: 26922 - protein, 7 aa, Artificial Sequence
  Synthetic construct
WIIHDCF

SEQ ID NO: 26923 - protein, 7 aa, Artificial Sequence
  Synthetic construct
WIIHDCY

SEQ ID NO: 26924 - protein, 7 aa, Artificial Sequence
  Synthetic construct
WIIHDLF

SEQ ID NO: 26925 - protein, 7 aa, Artificial Sequence
  Synthetic construct
WIIHDLY

SEQ ID NO: 26926 - protein, 7 aa, Artificial Sequence
  Synthetic construct
WIIHDAF

SEQ ID NO: 26927 - protein, 7 aa, Artificial Sequence
  Synthetic construct
WIIHDAY

SEQ ID NO: 26928 - protein, 7 aa, Artificial Sequence
  Synthetic construct
WIIHDQF

SEQ ID NO: 26929 - protein, 7 aa, Artificial Sequence
  Synthetic construct
WIIHDQY

SEQ ID NO: 26930 - protein, 7 aa, Artificial Sequence
  Synthetic construct
WIIHDDF

SEQ ID NO: 26931 - protein, 7 aa, Artificial Sequence
  Synthetic construct
WIIHDDY

SEQ ID NO: 26932 - protein, 7 aa, Artificial Sequence
  Synthetic construct
WIIHDVF

SEQ ID NO: 26933 - protein, 7 aa, Artificial Sequence
  Synthetic construct
WIIHDVY

SEQ ID NO: 26934 - protein, 7 aa, Artificial Sequence
  Synthetic construct
WIIHYFF

SEQ ID NO: 26935 - protein, 7 aa, Artificial Sequence
  Synthetic construct
WIIHYFY

SEQ ID NO: 26936 - protein, 7 aa, Artificial Sequence
  Synthetic construct
WIIHYRF

SEQ ID NO: 26937 - protein, 7 aa, Artificial Sequence
  Synthetic construct
WIIHYRY

SEQ ID NO: 26938 - protein, 7 aa, Artificial Sequence
  Synthetic construct
WIIHYCF

SEQ ID NO: 26939 - protein, 7 aa, Artificial Sequence
  Synthetic construct
WIIHYCY

SEQ ID NO: 26940 - protein, 7 aa, Artificial Sequence
  Synthetic construct
WIIHYLF

SEQ ID NO: 26941 - protein, 7 aa, Artificial Sequence
  Synthetic construct
WIIHYLY

SEQ ID NO: 26942 - protein, 7 aa, Artificial Sequence
  Synthetic construct
WIIHYAF

SEQ ID NO: 26943 - protein, 7 aa, Artificial Sequence
  Synthetic construct
WIIHYAY

SEQ ID NO: 26944 - protein, 7 aa, Artificial Sequence
  Synthetic construct
WIIHYQF

SEQ ID NO: 26945 - protein, 7 aa, Artificial Sequence
  Synthetic construct
WIIHYQY

SEQ ID NO: 26946 - protein, 7 aa, Artificial Sequence
  Synthetic construct
WIIHYDF

SEQ ID NO: 26947 - protein, 7 aa, Artificial Sequence
  Synthetic construct
WIIHYDY

SEQ ID NO: 26948 - protein, 7 aa, Artificial Sequence
  Synthetic construct
WIIHYVF

SEQ ID NO: 26949 - protein, 7 aa, Artificial Sequence
  Synthetic construct
WIIHYVY

SEQ ID NO: 26950 - protein, 7 aa, Artificial Sequence
  Synthetic construct
WIIHFFF

SEQ ID NO: 26951 - protein, 7 aa, Artificial Sequence
  Synthetic construct
WIIHFFY

SEQ ID NO: 26952 - protein, 7 aa, Artificial Sequence
  Synthetic construct
WIIHFRF

SEQ ID NO: 26953 - protein, 7 aa, Artificial Sequence
  Synthetic construct
WIIHFRY

SEQ ID NO: 26954 - protein, 7 aa, Artificial Sequence
  Synthetic construct
WIIHFCF

SEQ ID NO: 26955 - protein, 7 aa, Artificial Sequence
  Synthetic construct
WIIHFCY

SEQ ID NO: 26956 - protein, 7 aa, Artificial Sequence
  Synthetic construct
WIIHFLF

SEQ ID NO: 26957 - protein, 7 aa, Artificial Sequence
  Synthetic construct
WIIHFLY

SEQ ID NO: 26958 - protein, 7 aa, Artificial Sequence
  Synthetic construct
WIIHFAF

SEQ ID NO: 26959 - protein, 7 aa, Artificial Sequence
  Synthetic construct
WIIHFAY

SEQ ID NO: 26960 - protein, 7 aa, Artificial Sequence
  Synthetic construct
WIIHFQF

SEQ ID NO: 26961 - protein, 7 aa, Artificial Sequence
  Synthetic construct
WIIHFQY

SEQ ID NO: 26962 - protein, 7 aa, Artificial Sequence
  Synthetic construct
WIIHFDF

SEQ ID NO: 26963 - protein, 7 aa, Artificial Sequence
  Synthetic construct
WIIHFDY

SEQ ID NO: 26964 - protein, 7 aa, Artificial Sequence
  Synthetic construct
WIIHFVF

SEQ ID NO: 26965 - protein, 7 aa, Artificial Sequence
  Synthetic construct
WIIHFVY

SEQ ID NO: 26966 - protein, 7 aa, Artificial Sequence
  Synthetic construct
WIIHVFF

SEQ ID NO: 26967 - protein, 7 aa, Artificial Sequence
  Synthetic construct
WIIHVFY

SEQ ID NO: 26968 - protein, 7 aa, Artificial Sequence
  Synthetic construct
WIIHVRF

SEQ ID NO: 26969 - protein, 7 aa, Artificial Sequence
  Synthetic construct
WIIHVRY

SEQ ID NO: 26970 - protein, 7 aa, Artificial Sequence
  Synthetic construct
WIIHVCF

SEQ ID NO: 26971 - protein, 7 aa, Artificial Sequence
  Synthetic construct
WIIHVCY

SEQ ID NO: 26972 - protein, 7 aa, Artificial Sequence
  Synthetic construct
WIIHVLF

SEQ ID NO: 26973 - protein, 7 aa, Artificial Sequence
  Synthetic construct
WIIHVLY

SEQ ID NO: 26974 - protein, 7 aa, Artificial Sequence
  Synthetic construct
WIIHVAF

SEQ ID NO: 26975 - protein, 7 aa, Artificial Sequence
  Synthetic construct
WIIHVAY

SEQ ID NO: 26976 - protein, 7 aa, Artificial Sequence
  Synthetic construct
WIIHVQF

SEQ ID NO: 26977 - protein, 7 aa, Artificial Sequence
  Synthetic construct
WIIHVQY

SEQ ID NO: 26978 - protein, 7 aa, Artificial Sequence
  Synthetic construct
WIIHVDF

SEQ ID NO: 26979 - protein, 7 aa, Artificial Sequence
  Synthetic construct
WIIHVDY

SEQ ID NO: 26980 - protein, 7 aa, Artificial Sequence
  Synthetic construct
WIIHVVF

SEQ ID NO: 26981 - protein, 7 aa, Artificial Sequence
  Synthetic construct
WIIHVVY

SEQ ID NO: 26982 - protein, 7 aa, Artificial Sequence
  Synthetic construct
WIIHTFF

SEQ ID NO: 26983 - protein, 7 aa, Artificial Sequence
  Synthetic construct
WIIHTFY

SEQ ID NO: 26984 - protein, 7 aa, Artificial Sequence
  Synthetic construct
WIIHTRF

SEQ ID NO: 26985 - protein, 7 aa, Artificial Sequence
  Synthetic construct
WIIHTRY

SEQ ID NO: 26986 - protein, 7 aa, Artificial Sequence
  Synthetic construct
WIIHTCF

SEQ ID NO: 26987 - protein, 7 aa, Artificial Sequence
  Synthetic construct
WIIHTCY

SEQ ID NO: 26988 - protein, 7 aa, Artificial Sequence
  Synthetic construct
WIIHTLF

SEQ ID NO: 26989 - protein, 7 aa, Artificial Sequence
  Synthetic construct
WIIHTLY

SEQ ID NO: 26990 - protein, 7 aa, Artificial Sequence
  Synthetic construct
WIIHTAF

SEQ ID NO: 26991 - protein, 7 aa, Artificial Sequence
  Synthetic construct
WIIHTAY

SEQ ID NO: 26992 - protein, 7 aa, Artificial Sequence
  Synthetic construct
WIIHTQF

SEQ ID NO: 26993 - protein, 7 aa, Artificial Sequence
  Synthetic construct
WIIHTQY

SEQ ID NO: 26994 - protein, 7 aa, Artificial Sequence
  Synthetic construct
WIIHTDF

SEQ ID NO: 26995 - protein, 7 aa, Artificial Sequence
  Synthetic construct
WIIHTDY

SEQ ID NO: 26996 - protein, 7 aa, Artificial Sequence
  Synthetic construct
WIIHTVF

SEQ ID NO: 26997 - protein, 7 aa, Artificial Sequence
  Synthetic construct
WIIHTVY

SEQ ID NO: 26998 - protein, 7 aa, Artificial Sequence
  Synthetic construct
WIIHGFF

SEQ ID NO: 26999 - protein, 7 aa, Artificial Sequence
  Synthetic construct
WIIHGFY

SEQ ID NO: 27000 - protein, 7 aa, Artificial Sequence
  Synthetic construct
WIIHGRF

SEQ ID NO: 27001 - protein, 7 aa, Artificial Sequence
  Synthetic construct
WIIHGRY

SEQ ID NO: 27002 - protein, 7 aa, Artificial Sequence
  Synthetic construct
WIIHGCF

SEQ ID NO: 27003 - protein, 7 aa, Artificial Sequence
  Synthetic construct
WIIHGCY

SEQ ID NO: 27004 - protein, 7 aa, Artificial Sequence
  Synthetic construct
WIIHGLF

SEQ ID NO: 27005 - protein, 7 aa, Artificial Sequence
  Synthetic construct
WIIHGLY

SEQ ID NO: 27006 - protein, 7 aa, Artificial Sequence
  Synthetic construct
WIIHGAF

SEQ ID NO: 27007 - protein, 7 aa, Artificial Sequence
  Synthetic construct
WIIHGAY

SEQ ID NO: 27008 - protein, 7 aa, Artificial Sequence
  Synthetic construct
WIIHGQF

SEQ ID NO: 27009 - protein, 7 aa, Artificial Sequence
  Synthetic construct
WIIHGQY

SEQ ID NO: 27010 - protein, 7 aa, Artificial Sequence
  Synthetic construct
WIIHGDF

SEQ ID NO: 27011 - protein, 7 aa, Artificial Sequence
  Synthetic construct
WIIHGDY

SEQ ID NO: 27012 - protein, 7 aa, Artificial Sequence
  Synthetic construct
WIIHGVF

SEQ ID NO: 27013 - protein, 7 aa, Artificial Sequence
  Synthetic construct
WIIHGVY

SEQ ID NO: 27014 - protein, 7 aa, Artificial Sequence
  Synthetic construct
WIIHAFF

SEQ ID NO: 27015 - protein, 7 aa, Artificial Sequence
  Synthetic construct
WIIHAFY

SEQ ID NO: 27016 - protein, 7 aa, Artificial Sequence
  Synthetic construct
WIIHARF

SEQ ID NO: 27017 - protein, 7 aa, Artificial Sequence
  Synthetic construct
WIIHARY

SEQ ID NO: 27018 - protein, 7 aa, Artificial Sequence
  Synthetic construct
WIIHACF

SEQ ID NO: 27019 - protein, 7 aa, Artificial Sequence
  Synthetic construct
WIIHACY

SEQ ID NO: 27020 - protein, 7 aa, Artificial Sequence
  Synthetic construct
WIIHALF

SEQ ID NO: 27021 - protein, 7 aa, Artificial Sequence
  Synthetic construct
WIIHALY

SEQ ID NO: 27022 - protein, 7 aa, Artificial Sequence
  Synthetic construct
WIIHAAF

SEQ ID NO: 27023 - protein, 7 aa, Artificial Sequence
  Synthetic construct
WIIHAAY

SEQ ID NO: 27024 - protein, 7 aa, Artificial Sequence
  Synthetic construct
WIIHAQF

SEQ ID NO: 27025 - protein, 7 aa, Artificial Sequence
  Synthetic construct
WIIHAQY

SEQ ID NO: 27026 - protein, 7 aa, Artificial Sequence
  Synthetic construct
WIIHADF

SEQ ID NO: 27027 - protein, 7 aa, Artificial Sequence
  Synthetic construct
WIIHADY

SEQ ID NO: 27028 - protein, 7 aa, Artificial Sequence
  Synthetic construct
WIIHAVF

SEQ ID NO: 27029 - protein, 7 aa, Artificial Sequence
  Synthetic construct
WIIHAVY

SEQ ID NO: 27030 - protein, 7 aa, Artificial Sequence
  Synthetic construct
WIIHQFF

SEQ ID NO: 27031 - protein, 7 aa, Artificial Sequence
  Synthetic construct
WIIHQFY

SEQ ID NO: 27032 - protein, 7 aa, Artificial Sequence
  Synthetic construct
WIIHQRF

SEQ ID NO: 27033 - protein, 7 aa, Artificial Sequence
  Synthetic construct
WIIHQRY

SEQ ID NO: 27034 - protein, 7 aa, Artificial Sequence
  Synthetic construct
WIIHQCF

SEQ ID NO: 27035 - protein, 7 aa, Artificial Sequence
  Synthetic construct
WIIHQCY

SEQ ID NO: 27036 - protein, 7 aa, Artificial Sequence
  Synthetic construct
WIIHQLF

SEQ ID NO: 27037 - protein, 7 aa, Artificial Sequence
  Synthetic construct
WIIHQLY

SEQ ID NO: 27038 - protein, 7 aa, Artificial Sequence
  Synthetic construct
WIIHQAF

SEQ ID NO: 27039 - protein, 7 aa, Artificial Sequence
  Synthetic construct
WIIHQAY

SEQ ID NO: 27040 - protein, 7 aa, Artificial Sequence
  Synthetic construct
WIIHQQF

SEQ ID NO: 27041 - protein, 7 aa, Artificial Sequence
  Synthetic construct
WIIHQQY

SEQ ID NO: 27042 - protein, 7 aa, Artificial Sequence
  Synthetic construct
WIIHQDF

SEQ ID NO: 27043 - protein, 7 aa, Artificial Sequence
  Synthetic construct
WIIHQDY

SEQ ID NO: 27044 - protein, 7 aa, Artificial Sequence
  Synthetic construct
WIIHQVF

SEQ ID NO: 27045 - protein, 7 aa, Artificial Sequence
  Synthetic construct
WIIHQVY

SEQ ID NO: 27046 - protein, 7 aa, Artificial Sequence
  Synthetic construct
WIILIFF

SEQ ID NO: 27047 - protein, 7 aa, Artificial Sequence
  Synthetic construct
WIILIFY

SEQ ID NO: 27048 - protein, 7 aa, Artificial Sequence
  Synthetic construct
WIILIRF

SEQ ID NO: 27049 - protein, 7 aa, Artificial Sequence
  Synthetic construct
WIILIRY

SEQ ID NO: 27050 - protein, 7 aa, Artificial Sequence
  Synthetic construct
WIILICF

SEQ ID NO: 27051 - protein, 7 aa, Artificial Sequence
  Synthetic construct
WIILICY

SEQ ID NO: 27052 - protein, 7 aa, Artificial Sequence
  Synthetic construct
WIILILF

SEQ ID NO: 27053 - protein, 7 aa, Artificial Sequence
  Synthetic construct
WIILILY

SEQ ID NO: 27054 - protein, 7 aa, Artificial Sequence
  Synthetic construct
WIILIAF

SEQ ID NO: 27055 - protein, 7 aa, Artificial Sequence
  Synthetic construct
WIILIAY

SEQ ID NO: 27056 - protein, 7 aa, Artificial Sequence
  Synthetic construct
WIILIQF

SEQ ID NO: 27057 - protein, 7 aa, Artificial Sequence
  Synthetic construct
WIILIQY

SEQ ID NO: 27058 - protein, 7 aa, Artificial Sequence
  Synthetic construct
WIILIDF

SEQ ID NO: 27059 - protein, 7 aa, Artificial Sequence
  Synthetic construct
WIILIDY

SEQ ID NO: 27060 - protein, 7 aa, Artificial Sequence
  Synthetic construct
WIILIVF

SEQ ID NO: 27061 - protein, 7 aa, Artificial Sequence
  Synthetic construct
WIILIVY

SEQ ID NO: 27062 - protein, 7 aa, Artificial Sequence
  Synthetic construct
WIILDFF

SEQ ID NO: 27063 - protein, 7 aa, Artificial Sequence
  Synthetic construct
WIILDFY

SEQ ID NO: 27064 - protein, 7 aa, Artificial Sequence
  Synthetic construct
WIILDRF

SEQ ID NO: 27065 - protein, 7 aa, Artificial Sequence
  Synthetic construct
WIILDRY

SEQ ID NO: 27066 - protein, 7 aa, Artificial Sequence
  Synthetic construct
WIILDCF

SEQ ID NO: 27067 - protein, 7 aa, Artificial Sequence
  Synthetic construct
WIILDCY

SEQ ID NO: 27068 - protein, 7 aa, Artificial Sequence
  Synthetic construct
WIILDLF

SEQ ID NO: 27069 - protein, 7 aa, Artificial Sequence
  Synthetic construct
WIILDLY

SEQ ID NO: 27070 - protein, 7 aa, Artificial Sequence
  Synthetic construct
WIILDAF

SEQ ID NO: 27071 - protein, 7 aa, Artificial Sequence
  Synthetic construct
WIILDAY

SEQ ID NO: 27072 - protein, 7 aa, Artificial Sequence
  Synthetic construct
WIILDQF

SEQ ID NO: 27073 - protein, 7 aa, Artificial Sequence
  Synthetic construct
WIILDQY

SEQ ID NO: 27074 - protein, 7 aa, Artificial Sequence
  Synthetic construct
WIILDDF

SEQ ID NO: 27075 - protein, 7 aa, Artificial Sequence
  Synthetic construct
WIILDDY

SEQ ID NO: 27076 - protein, 7 aa, Artificial Sequence
  Synthetic construct
WIILDVF

SEQ ID NO: 27077 - protein, 7 aa, Artificial Sequence
  Synthetic construct
WIILDVY

SEQ ID NO: 27078 - protein, 7 aa, Artificial Sequence
  Synthetic construct
WIILYFF

SEQ ID NO: 27079 - protein, 7 aa, Artificial Sequence
  Synthetic construct
WIILYFY

SEQ ID NO: 27080 - protein, 7 aa, Artificial Sequence
  Synthetic construct
WIILYRF

SEQ ID NO: 27081 - protein, 7 aa, Artificial Sequence
  Synthetic construct
WIILYRY

SEQ ID NO: 27082 - protein, 7 aa, Artificial Sequence
  Synthetic construct
WIILYCF

SEQ ID NO: 27083 - protein, 7 aa, Artificial Sequence
  Synthetic construct
WIILYCY

SEQ ID NO: 27084 - protein, 7 aa, Artificial Sequence
  Synthetic construct
WIILYLF

SEQ ID NO: 27085 - protein, 7 aa, Artificial Sequence
  Synthetic construct
WIILYLY

SEQ ID NO: 27086 - protein, 7 aa, Artificial Sequence
  Synthetic construct
WIILYAF

SEQ ID NO: 27087 - protein, 7 aa, Artificial Sequence
  Synthetic construct
WIILYAY

SEQ ID NO: 27088 - protein, 7 aa, Artificial Sequence
  Synthetic construct
WIILYQF

SEQ ID NO: 27089 - protein, 7 aa, Artificial Sequence
  Synthetic construct
WIILYQY

SEQ ID NO: 27090 - protein, 7 aa, Artificial Sequence
  Synthetic construct
WIILYDF

SEQ ID NO: 27091 - protein, 7 aa, Artificial Sequence
  Synthetic construct
WIILYDY

SEQ ID NO: 27092 - protein, 7 aa, Artificial Sequence
  Synthetic construct
WIILYVF

SEQ ID NO: 27093 - protein, 7 aa, Artificial Sequence
  Synthetic construct
WIILYVY

SEQ ID NO: 27094 - protein, 7 aa, Artificial Sequence
  Synthetic construct
WIILFFF

SEQ ID NO: 27095 - protein, 7 aa, Artificial Sequence
  Synthetic construct
WIILFFY

SEQ ID NO: 27096 - protein, 7 aa, Artificial Sequence
  Synthetic construct
WIILFRF

SEQ ID NO: 27097 - protein, 7 aa, Artificial Sequence
  Synthetic construct
WIILFRY

SEQ ID NO: 27098 - protein, 7 aa, Artificial Sequence
  Synthetic construct
WIILFCF

SEQ ID NO: 27099 - protein, 7 aa, Artificial Sequence
  Synthetic construct
WIILFCY

SEQ ID NO: 27100 - protein, 7 aa, Artificial Sequence
  Synthetic construct
WIILFLF

SEQ ID NO: 27101 - protein, 7 aa, Artificial Sequence
  Synthetic construct
WIILFLY

SEQ ID NO: 27102 - protein, 7 aa, Artificial Sequence
  Synthetic construct
WIILFAF

SEQ ID NO: 27103 - protein, 7 aa, Artificial Sequence
  Synthetic construct
WIILFAY

SEQ ID NO: 27104 - protein, 7 aa, Artificial Sequence
  Synthetic construct
WIILFQF

SEQ ID NO: 27105 - protein, 7 aa, Artificial Sequence
  Synthetic construct
WIILFQY

SEQ ID NO: 27106 - protein, 7 aa, Artificial Sequence
  Synthetic construct
WIILFDF

SEQ ID NO: 27107 - protein, 7 aa, Artificial Sequence
  Synthetic construct
WIILFDY

SEQ ID NO: 27108 - protein, 7 aa, Artificial Sequence
  Synthetic construct
WIILFVF

SEQ ID NO: 27109 - protein, 7 aa, Artificial Sequence
  Synthetic construct
WIILFVY

SEQ ID NO: 27110 - protein, 7 aa, Artificial Sequence
  Synthetic construct
WIILVFF

SEQ ID NO: 27111 - protein, 7 aa, Artificial Sequence
  Synthetic construct
WIILVFY

SEQ ID NO: 27112 - protein, 7 aa, Artificial Sequence
  Synthetic construct
WIILVRF

SEQ ID NO: 27113 - protein, 7 aa, Artificial Sequence
  Synthetic construct
WIILVRY

SEQ ID NO: 27114 - protein, 7 aa, Artificial Sequence
  Synthetic construct
WIILVCF

SEQ ID NO: 27115 - protein, 7 aa, Artificial Sequence
  Synthetic construct
WIILVCY

SEQ ID NO: 27116 - protein, 7 aa, Artificial Sequence
  Synthetic construct
WIILVLF

SEQ ID NO: 27117 - protein, 7 aa, Artificial Sequence
  Synthetic construct
WIILVLY

SEQ ID NO: 27118 - protein, 7 aa, Artificial Sequence
  Synthetic construct
WIILVAF

SEQ ID NO: 27119 - protein, 7 aa, Artificial Sequence
  Synthetic construct
WIILVAY

SEQ ID NO: 27120 - protein, 7 aa, Artificial Sequence
  Synthetic construct
WIILVQF

SEQ ID NO: 27121 - protein, 7 aa, Artificial Sequence
  Synthetic construct
WIILVQY

SEQ ID NO: 27122 - protein, 7 aa, Artificial Sequence
  Synthetic construct
WIILVDF

SEQ ID NO: 27123 - protein, 7 aa, Artificial Sequence
  Synthetic construct
WIILVDY

SEQ ID NO: 27124 - protein, 7 aa, Artificial Sequence
  Synthetic construct
WIILVVF

SEQ ID NO: 27125 - protein, 7 aa, Artificial Sequence
  Synthetic construct
WIILVVY

SEQ ID NO: 27126 - protein, 7 aa, Artificial Sequence
  Synthetic construct
WIILTFF

SEQ ID NO: 27127 - protein, 7 aa, Artificial Sequence
  Synthetic construct
WIILTFY

SEQ ID NO: 27128 - protein, 7 aa, Artificial Sequence
  Synthetic construct
WIILTRF

SEQ ID NO: 27129 - protein, 7 aa, Artificial Sequence
  Synthetic construct
WIILTRY

SEQ ID NO: 27130 - protein, 7 aa, Artificial Sequence
  Synthetic construct
WIILTCF

SEQ ID NO: 27131 - protein, 7 aa, Artificial Sequence
  Synthetic construct
WIILTCY

SEQ ID NO: 27132 - protein, 7 aa, Artificial Sequence
  Synthetic construct
WIILTLF

SEQ ID NO: 27133 - protein, 7 aa, Artificial Sequence
  Synthetic construct
WIILTLY

SEQ ID NO: 27134 - protein, 7 aa, Artificial Sequence
  Synthetic construct
WIILTAF

SEQ ID NO: 27135 - protein, 7 aa, Artificial Sequence
  Synthetic construct
WIILTAY

SEQ ID NO: 27136 - protein, 7 aa, Artificial Sequence
  Synthetic construct
WIILTQF

SEQ ID NO: 27137 - protein, 7 aa, Artificial Sequence
  Synthetic construct
WIILTQY

SEQ ID NO: 27138 - protein, 7 aa, Artificial Sequence
  Synthetic construct
WIILTDF

SEQ ID NO: 27139 - protein, 7 aa, Artificial Sequence
  Synthetic construct
WIILTDY

SEQ ID NO: 27140 - protein, 7 aa, Artificial Sequence
  Synthetic construct
WIILTVF

SEQ ID NO: 27141 - protein, 7 aa, Artificial Sequence
  Synthetic construct
WIILTVY

SEQ ID NO: 27142 - protein, 7 aa, Artificial Sequence
  Synthetic construct
WIILGFF

SEQ ID NO: 27143 - protein, 7 aa, Artificial Sequence
  Synthetic construct
WIILGFY

SEQ ID NO: 27144 - protein, 7 aa, Artificial Sequence
  Synthetic construct
WIILGRF

SEQ ID NO: 27145 - protein, 7 aa, Artificial Sequence
  Synthetic construct
WIILGRY

SEQ ID NO: 27146 - protein, 7 aa, Artificial Sequence
  Synthetic construct
WIILGCF

SEQ ID NO: 27147 - protein, 7 aa, Artificial Sequence
  Synthetic construct
WIILGCY

SEQ ID NO: 27148 - protein, 7 aa, Artificial Sequence
  Synthetic construct
WIILGLF

SEQ ID NO: 27149 - protein, 7 aa, Artificial Sequence
  Synthetic construct
WIILGLY

SEQ ID NO: 27150 - protein, 7 aa, Artificial Sequence
  Synthetic construct
WIILGAF

SEQ ID NO: 27151 - protein, 7 aa, Artificial Sequence
  Synthetic construct
WIILGAY

SEQ ID NO: 27152 - protein, 7 aa, Artificial Sequence
  Synthetic construct
WIILGQF

SEQ ID NO: 27153 - protein, 7 aa, Artificial Sequence
  Synthetic construct
WIILGQY

SEQ ID NO: 27154 - protein, 7 aa, Artificial Sequence
  Synthetic construct
WIILGDF

SEQ ID NO: 27155 - protein, 7 aa, Artificial Sequence
  Synthetic construct
WIILGDY

SEQ ID NO: 27156 - protein, 7 aa, Artificial Sequence
  Synthetic construct
WIILGVF

SEQ ID NO: 27157 - protein, 7 aa, Artificial Sequence
  Synthetic construct
WIILGVY

SEQ ID NO: 27158 - protein, 7 aa, Artificial Sequence
  Synthetic construct
WIILAFF

SEQ ID NO: 27159 - protein, 7 aa, Artificial Sequence
  Synthetic construct
WIILAFY

SEQ ID NO: 27160 - protein, 7 aa, Artificial Sequence
  Synthetic construct
WIILARF

SEQ ID NO: 27161 - protein, 7 aa, Artificial Sequence
  Synthetic construct
WIILARY

SEQ ID NO: 27162 - protein, 7 aa, Artificial Sequence
  Synthetic construct
WIILACF

SEQ ID NO: 27163 - protein, 7 aa, Artificial Sequence
  Synthetic construct
WIILACY

SEQ ID NO: 27164 - protein, 7 aa, Artificial Sequence
  Synthetic construct
WIILALF

SEQ ID NO: 27165 - protein, 7 aa, Artificial Sequence
  Synthetic construct
WIILALY

SEQ ID NO: 27166 - protein, 7 aa, Artificial Sequence
  Synthetic construct
WIILAAF

SEQ ID NO: 27167 - protein, 7 aa, Artificial Sequence
  Synthetic construct
WIILAAY

SEQ ID NO: 27168 - protein, 7 aa, Artificial Sequence
  Synthetic construct
WIILAQF

SEQ ID NO: 27169 - protein, 7 aa, Artificial Sequence
  Synthetic construct
WIILAQY

SEQ ID NO: 27170 - protein, 7 aa, Artificial Sequence
  Synthetic construct
WIILADF

SEQ ID NO: 27171 - protein, 7 aa, Artificial Sequence
  Synthetic construct
WIILADY

SEQ ID NO: 27172 - protein, 7 aa, Artificial Sequence
  Synthetic construct
WIILAVF

SEQ ID NO: 27173 - protein, 7 aa, Artificial Sequence
  Synthetic construct
WIILAVY

SEQ ID NO: 27174 - protein, 7 aa, Artificial Sequence
  Synthetic construct
WIILQFF

SEQ ID NO: 27175 - protein, 7 aa, Artificial Sequence
  Synthetic construct
WIILQFY

SEQ ID NO: 27176 - protein, 7 aa, Artificial Sequence
  Synthetic construct
WIILQRF

SEQ ID NO: 27177 - protein, 7 aa, Artificial Sequence
  Synthetic construct
WIILQRY

SEQ ID NO: 27178 - protein, 7 aa, Artificial Sequence
  Synthetic construct
WIILQCF

SEQ ID NO: 27179 - protein, 7 aa, Artificial Sequence
  Synthetic construct
WIILQCY

SEQ ID NO: 27180 - protein, 7 aa, Artificial Sequence
  Synthetic construct
WIILQLF

SEQ ID NO: 27181 - protein, 7 aa, Artificial Sequence
  Synthetic construct
WIILQLY

SEQ ID NO: 27182 - protein, 7 aa, Artificial Sequence
  Synthetic construct
WIILQAF

SEQ ID NO: 27183 - protein, 7 aa, Artificial Sequence
  Synthetic construct
WIILQAY

SEQ ID NO: 27184 - protein, 7 aa, Artificial Sequence
  Synthetic construct
WIILQQF

SEQ ID NO: 27185 - protein, 7 aa, Artificial Sequence
  Synthetic construct
WIILQQY

SEQ ID NO: 27186 - protein, 7 aa, Artificial Sequence
  Synthetic construct
WIILQDF

SEQ ID NO: 27187 - protein, 7 aa, Artificial Sequence
  Synthetic construct
WIILQDY

SEQ ID NO: 27188 - protein, 7 aa, Artificial Sequence
  Synthetic construct
WIILQVF

SEQ ID NO: 27189 - protein, 7 aa, Artificial Sequence
  Synthetic construct
WIILQVY

SEQ ID NO: 27190 - protein, 7 aa, Artificial Sequence
  Synthetic construct
WIIFIFF

SEQ ID NO: 27191 - protein, 7 aa, Artificial Sequence
  Synthetic construct
WIIFIFY

SEQ ID NO: 27192 - protein, 7 aa, Artificial Sequence
  Synthetic construct
WIIFIRF

SEQ ID NO: 27193 - protein, 7 aa, Artificial Sequence
  Synthetic construct
WIIFIRY

SEQ ID NO: 27194 - protein, 7 aa, Artificial Sequence
  Synthetic construct
WIIFICF

SEQ ID NO: 27195 - protein, 7 aa, Artificial Sequence
  Synthetic construct
WIIFICY

SEQ ID NO: 27196 - protein, 7 aa, Artificial Sequence
  Synthetic construct
WIIFILF

SEQ ID NO: 27197 - protein, 7 aa, Artificial Sequence
  Synthetic construct
WIIFILY

SEQ ID NO: 27198 - protein, 7 aa, Artificial Sequence
  Synthetic construct
WIIFIAF

SEQ ID NO: 27199 - protein, 7 aa, Artificial Sequence
  Synthetic construct
WIIFIAY

SEQ ID NO: 27200 - protein, 7 aa, Artificial Sequence
  Synthetic construct
WIIFIQF

SEQ ID NO: 27201 - protein, 7 aa, Artificial Sequence
  Synthetic construct
WIIFIQY

SEQ ID NO: 27202 - protein, 7 aa, Artificial Sequence
  Synthetic construct
WIIFIDF

SEQ ID NO: 27203 - protein, 7 aa, Artificial Sequence
  Synthetic construct
WIIFIDY

SEQ ID NO: 27204 - protein, 7 aa, Artificial Sequence
  Synthetic construct
WIIFIVF

SEQ ID NO: 27205 - protein, 7 aa, Artificial Sequence
  Synthetic construct
WIIFIVY

SEQ ID NO: 27206 - protein, 7 aa, Artificial Sequence
  Synthetic construct
WIIFDFF

SEQ ID NO: 27207 - protein, 7 aa, Artificial Sequence
  Synthetic construct
WIIFDFY

SEQ ID NO: 27208 - protein, 7 aa, Artificial Sequence
  Synthetic construct
WIIFDRF

SEQ ID NO: 27209 - protein, 7 aa, Artificial Sequence
  Synthetic construct
WIIFDRY

SEQ ID NO: 27210 - protein, 7 aa, Artificial Sequence
  Synthetic construct
WIIFDCF

SEQ ID NO: 27211 - protein, 7 aa, Artificial Sequence
  Synthetic construct
WIIFDCY

SEQ ID NO: 27212 - protein, 7 aa, Artificial Sequence
  Synthetic construct
WIIFDLF

SEQ ID NO: 27213 - protein, 7 aa, Artificial Sequence
  Synthetic construct
WIIFDLY

SEQ ID NO: 27214 - protein, 7 aa, Artificial Sequence
  Synthetic construct
WIIFDAF

SEQ ID NO: 27215 - protein, 7 aa, Artificial Sequence
  Synthetic construct
WIIFDAY

SEQ ID NO: 27216 - protein, 7 aa, Artificial Sequence
  Synthetic construct
WIIFDQF

SEQ ID NO: 27217 - protein, 7 aa, Artificial Sequence
  Synthetic construct
WIIFDQY

SEQ ID NO: 27218 - protein, 7 aa, Artificial Sequence
  Synthetic construct
WIIFDDF

SEQ ID NO: 27219 - protein, 7 aa, Artificial Sequence
  Synthetic construct
WIIFDDY

SEQ ID NO: 27220 - protein, 7 aa, Artificial Sequence
  Synthetic construct
WIIFDVF

SEQ ID NO: 27221 - protein, 7 aa, Artificial Sequence
  Synthetic construct
WIIFDVY

SEQ ID NO: 27222 - protein, 7 aa, Artificial Sequence
  Synthetic construct
WIIFYFF

SEQ ID NO: 27223 - protein, 7 aa, Artificial Sequence
  Synthetic construct
WIIFYFY

SEQ ID NO: 27224 - protein, 7 aa, Artificial Sequence
  Synthetic construct
WIIFYRF

SEQ ID NO: 27225 - protein, 7 aa, Artificial Sequence
  Synthetic construct
WIIFYRY

SEQ ID NO: 27226 - protein, 7 aa, Artificial Sequence
  Synthetic construct
WIIFYCF

SEQ ID NO: 27227 - protein, 7 aa, Artificial Sequence
  Synthetic construct
WIIFYCY

SEQ ID NO: 27228 - protein, 7 aa, Artificial Sequence
  Synthetic construct
WIIFYLF

SEQ ID NO: 27229 - protein, 7 aa, Artificial Sequence
  Synthetic construct
WIIFYLY

SEQ ID NO: 27230 - protein, 7 aa, Artificial Sequence
  Synthetic construct
WIIFYAF

SEQ ID NO: 27231 - protein, 7 aa, Artificial Sequence
  Synthetic construct
WIIFYAY

SEQ ID NO: 27232 - protein, 7 aa, Artificial Sequence
  Synthetic construct
WIIFYQF

SEQ ID NO: 27233 - protein, 7 aa, Artificial Sequence
  Synthetic construct
WIIFYQY

SEQ ID NO: 27234 - protein, 7 aa, Artificial Sequence
  Synthetic construct
WIIFYDF

SEQ ID NO: 27235 - protein, 7 aa, Artificial Sequence
  Synthetic construct
WIIFYDY

SEQ ID NO: 27236 - protein, 7 aa, Artificial Sequence
  Synthetic construct
WIIFYVF

SEQ ID NO: 27237 - protein, 7 aa, Artificial Sequence
  Synthetic construct
WIIFYVY

SEQ ID NO: 27238 - protein, 7 aa, Artificial Sequence
  Synthetic construct
WIIFFFF

SEQ ID NO: 27239 - protein, 7 aa, Artificial Sequence
  Synthetic construct
WIIFFFY

SEQ ID NO: 27240 - protein, 7 aa, Artificial Sequence
  Synthetic construct
WIIFFRF

SEQ ID NO: 27241 - protein, 7 aa, Artificial Sequence
  Synthetic construct
WIIFFRY

SEQ ID NO: 27242 - protein, 7 aa, Artificial Sequence
  Synthetic construct
WIIFFCF

SEQ ID NO: 27243 - protein, 7 aa, Artificial Sequence
  Synthetic construct
WIIFFCY

SEQ ID NO: 27244 - protein, 7 aa, Artificial Sequence
  Synthetic construct
WIIFFLF

SEQ ID NO: 27245 - protein, 7 aa, Artificial Sequence
  Synthetic construct
WIIFFLY

SEQ ID NO: 27246 - protein, 7 aa, Artificial Sequence
  Synthetic construct
WIIFFAF

SEQ ID NO: 27247 - protein, 7 aa, Artificial Sequence
  Synthetic construct
WIIFFAY

SEQ ID NO: 27248 - protein, 7 aa, Artificial Sequence
  Synthetic construct
WIIFFQF

SEQ ID NO: 27249 - protein, 7 aa, Artificial Sequence
  Synthetic construct
WIIFFQY

SEQ ID NO: 27250 - protein, 7 aa, Artificial Sequence
  Synthetic construct
WIIFFDF

SEQ ID NO: 27251 - protein, 7 aa, Artificial Sequence
  Synthetic construct
WIIFFDY

SEQ ID NO: 27252 - protein, 7 aa, Artificial Sequence
  Synthetic construct
WIIFFVF

SEQ ID NO: 27253 - protein, 7 aa, Artificial Sequence
  Synthetic construct
WIIFFVY

SEQ ID NO: 27254 - protein, 7 aa, Artificial Sequence
  Synthetic construct
WIIFVFF

SEQ ID NO: 27255 - protein, 7 aa, Artificial Sequence
  Synthetic construct
WIIFVFY

SEQ ID NO: 27256 - protein, 7 aa, Artificial Sequence
  Synthetic construct
WIIFVRF

SEQ ID NO: 27257 - protein, 7 aa, Artificial Sequence
  Synthetic construct
WIIFVRY

SEQ ID NO: 27258 - protein, 7 aa, Artificial Sequence
  Synthetic construct
WIIFVCF

SEQ ID NO: 27259 - protein, 7 aa, Artificial Sequence
  Synthetic construct
WIIFVCY

SEQ ID NO: 27260 - protein, 7 aa, Artificial Sequence
  Synthetic construct
WIIFVLF

SEQ ID NO: 27261 - protein, 7 aa, Artificial Sequence
  Synthetic construct
WIIFVLY

SEQ ID NO: 27262 - protein, 7 aa, Artificial Sequence
  Synthetic construct
WIIFVAF

SEQ ID NO: 27263 - protein, 7 aa, Artificial Sequence
  Synthetic construct
WIIFVAY

SEQ ID NO: 27264 - protein, 7 aa, Artificial Sequence
  Synthetic construct
WIIFVQF

SEQ ID NO: 27265 - protein, 7 aa, Artificial Sequence
  Synthetic construct
WIIFVQY

SEQ ID NO: 27266 - protein, 7 aa, Artificial Sequence
  Synthetic construct
WIIFVDF

SEQ ID NO: 27267 - protein, 7 aa, Artificial Sequence
  Synthetic construct
WIIFVDY

SEQ ID NO: 27268 - protein, 7 aa, Artificial Sequence
  Synthetic construct
WIIFVVF

SEQ ID NO: 27269 - protein, 7 aa, Artificial Sequence
  Synthetic construct
WIIFVVY

SEQ ID NO: 27270 - protein, 7 aa, Artificial Sequence
  Synthetic construct
WIIFTFF

SEQ ID NO: 27271 - protein, 7 aa, Artificial Sequence
  Synthetic construct
WIIFTFY

SEQ ID NO: 27272 - protein, 7 aa, Artificial Sequence
  Synthetic construct
WIIFTRF

SEQ ID NO: 27273 - protein, 7 aa, Artificial Sequence
  Synthetic construct
WIIFTRY

SEQ ID NO: 27274 - protein, 7 aa, Artificial Sequence
  Synthetic construct
WIIFTCF

SEQ ID NO: 27275 - protein, 7 aa, Artificial Sequence
  Synthetic construct
WIIFTCY

SEQ ID NO: 27276 - protein, 7 aa, Artificial Sequence
  Synthetic construct
WIIFTLF

SEQ ID NO: 27277 - protein, 7 aa, Artificial Sequence
  Synthetic construct
WIIFTLY

SEQ ID NO: 27278 - protein, 7 aa, Artificial Sequence
  Synthetic construct
WIIFTAF

SEQ ID NO: 27279 - protein, 7 aa, Artificial Sequence
  Synthetic construct
WIIFTAY

SEQ ID NO: 27280 - protein, 7 aa, Artificial Sequence
  Synthetic construct
WIIFTQF

SEQ ID NO: 27281 - protein, 7 aa, Artificial Sequence
  Synthetic construct
WIIFTQY

SEQ ID NO: 27282 - protein, 7 aa, Artificial Sequence
  Synthetic construct
WIIFTDF

SEQ ID NO: 27283 - protein, 7 aa, Artificial Sequence
  Synthetic construct
WIIFTDY

SEQ ID NO: 27284 - protein, 7 aa, Artificial Sequence
  Synthetic construct
WIIFTVF

SEQ ID NO: 27285 - protein, 7 aa, Artificial Sequence
  Synthetic construct
WIIFTVY

SEQ ID NO: 27286 - protein, 7 aa, Artificial Sequence
  Synthetic construct
WIIFGFF

SEQ ID NO: 27287 - protein, 7 aa, Artificial Sequence
  Synthetic construct
WIIFGFY

SEQ ID NO: 27288 - protein, 7 aa, Artificial Sequence
  Synthetic construct
WIIFGRF

SEQ ID NO: 27289 - protein, 7 aa, Artificial Sequence
  Synthetic construct
WIIFGRY

SEQ ID NO: 27290 - protein, 7 aa, Artificial Sequence
  Synthetic construct
WIIFGCF

SEQ ID NO: 27291 - protein, 7 aa, Artificial Sequence
  Synthetic construct
WIIFGCY

SEQ ID NO: 27292 - protein, 7 aa, Artificial Sequence
  Synthetic construct
WIIFGLF

SEQ ID NO: 27293 - protein, 7 aa, Artificial Sequence
  Synthetic construct
WIIFGLY

SEQ ID NO: 27294 - protein, 7 aa, Artificial Sequence
  Synthetic construct
WIIFGAF

SEQ ID NO: 27295 - protein, 7 aa, Artificial Sequence
  Synthetic construct
WIIFGAY

SEQ ID NO: 27296 - protein, 7 aa, Artificial Sequence
  Synthetic construct
WIIFGQF

SEQ ID NO: 27297 - protein, 7 aa, Artificial Sequence
  Synthetic construct
WIIFGQY

SEQ ID NO: 27298 - protein, 7 aa, Artificial Sequence
  Synthetic construct
WIIFGDF

SEQ ID NO: 27299 - protein, 7 aa, Artificial Sequence
  Synthetic construct
WIIFGDY

SEQ ID NO: 27300 - protein, 7 aa, Artificial Sequence
  Synthetic construct
WIIFGVF

SEQ ID NO: 27301 - protein, 7 aa, Artificial Sequence
  Synthetic construct
WIIFGVY

SEQ ID NO: 27302 - protein, 7 aa, Artificial Sequence
  Synthetic construct
WIIFAFF

SEQ ID NO: 27303 - protein, 7 aa, Artificial Sequence
  Synthetic construct
WIIFAFY

SEQ ID NO: 27304 - protein, 7 aa, Artificial Sequence
  Synthetic construct
WIIFARF

SEQ ID NO: 27305 - protein, 7 aa, Artificial Sequence
  Synthetic construct
WIIFARY

SEQ ID NO: 27306 - protein, 7 aa, Artificial Sequence
  Synthetic construct
WIIFACF

SEQ ID NO: 27307 - protein, 7 aa, Artificial Sequence
  Synthetic construct
WIIFACY

SEQ ID NO: 27308 - protein, 7 aa, Artificial Sequence
  Synthetic construct
WIIFALF

SEQ ID NO: 27309 - protein, 7 aa, Artificial Sequence
  Synthetic construct
WIIFALY

SEQ ID NO: 27310 - protein, 7 aa, Artificial Sequence
  Synthetic construct
WIIFAAF

SEQ ID NO: 27311 - protein, 7 aa, Artificial Sequence
  Synthetic construct
WIIFAAY

SEQ ID NO: 27312 - protein, 7 aa, Artificial Sequence
  Synthetic construct
WIIFAQF

SEQ ID NO: 27313 - protein, 7 aa, Artificial Sequence
  Synthetic construct
WIIFAQY

SEQ ID NO: 27314 - protein, 7 aa, Artificial Sequence
  Synthetic construct
WIIFADF

SEQ ID NO: 27315 - protein, 7 aa, Artificial Sequence
  Synthetic construct
WIIFADY

SEQ ID NO: 27316 - protein, 7 aa, Artificial Sequence
  Synthetic construct
WIIFAVF

SEQ ID NO: 27317 - protein, 7 aa, Artificial Sequence
  Synthetic construct
WIIFAVY

SEQ ID NO: 27318 - protein, 7 aa, Artificial Sequence
  Synthetic construct
WIIFQFF

SEQ ID NO: 27319 - protein, 7 aa, Artificial Sequence
  Synthetic construct
WIIFQFY

SEQ ID NO: 27320 - protein, 7 aa, Artificial Sequence
  Synthetic construct
WIIFQRF

SEQ ID NO: 27321 - protein, 7 aa, Artificial Sequence
  Synthetic construct
WIIFQRY

SEQ ID NO: 27322 - protein, 7 aa, Artificial Sequence
  Synthetic construct
WIIFQCF

SEQ ID NO: 27323 - protein, 7 aa, Artificial Sequence
  Synthetic construct
WIIFQCY

SEQ ID NO: 27324 - protein, 7 aa, Artificial Sequence
  Synthetic construct
WIIFQLF

SEQ ID NO: 27325 - protein, 7 aa, Artificial Sequence
  Synthetic construct
WIIFQLY

SEQ ID NO: 27326 - protein, 7 aa, Artificial Sequence
  Synthetic construct
WIIFQAF

SEQ ID NO: 27327 - protein, 7 aa, Artificial Sequence
  Synthetic construct
WIIFQAY

SEQ ID NO: 27328 - protein, 7 aa, Artificial Sequence
  Synthetic construct
WIIFQQF

SEQ ID NO: 27329 - protein, 7 aa, Artificial Sequence
  Synthetic construct
WIIFQQY

SEQ ID NO: 27330 - protein, 7 aa, Artificial Sequence
  Synthetic construct
WIIFQDF

SEQ ID NO: 27331 - protein, 7 aa, Artificial Sequence
  Synthetic construct
WIIFQDY

SEQ ID NO: 27332 - protein, 7 aa, Artificial Sequence
  Synthetic construct
WIIFQVF

SEQ ID NO: 27333 - protein, 7 aa, Artificial Sequence
  Synthetic construct
WIIFQVY

SEQ ID NO: 27334 - protein, 7 aa, Artificial Sequence
  Synthetic construct
WIGYIFF

SEQ ID NO: 27335 - protein, 7 aa, Artificial Sequence
  Synthetic construct
WIGYIFY

SEQ ID NO: 27336 - protein, 7 aa, Artificial Sequence
  Synthetic construct
WIGYIRF

SEQ ID NO: 27337 - protein, 7 aa, Artificial Sequence
  Synthetic construct
WIGYIRY

SEQ ID NO: 27338 - protein, 7 aa, Artificial Sequence
  Synthetic construct
WIGYICF

SEQ ID NO: 27339 - protein, 7 aa, Artificial Sequence
  Synthetic construct
WIGYICY

SEQ ID NO: 27340 - protein, 7 aa, Artificial Sequence
  Synthetic construct
WIGYILF

SEQ ID NO: 27341 - protein, 7 aa, Artificial Sequence
  Synthetic construct
WIGYILY

SEQ ID NO: 27342 - protein, 7 aa, Artificial Sequence
  Synthetic construct
WIGYIAF

SEQ ID NO: 27343 - protein, 7 aa, Artificial Sequence
  Synthetic construct
WIGYIAY

SEQ ID NO: 27344 - protein, 7 aa, Artificial Sequence
  Synthetic construct
WIGYIQF

SEQ ID NO: 27345 - protein, 7 aa, Artificial Sequence
  Synthetic construct
WIGYIQY

SEQ ID NO: 27346 - protein, 7 aa, Artificial Sequence
  Synthetic construct
WIGYIDF

SEQ ID NO: 27347 - protein, 7 aa, Artificial Sequence
  Synthetic construct
WIGYIDY

SEQ ID NO: 27348 - protein, 7 aa, Artificial Sequence
  Synthetic construct
WIGYIVF

SEQ ID NO: 27349 - protein, 7 aa, Artificial Sequence
  Synthetic construct
WIGYIVY

SEQ ID NO: 27350 - protein, 7 aa, Artificial Sequence
  Synthetic construct
WIGYDFF

SEQ ID NO: 27351 - protein, 7 aa, Artificial Sequence
  Synthetic construct
WIGYDFY

SEQ ID NO: 27352 - protein, 7 aa, Artificial Sequence
  Synthetic construct
WIGYDRF

SEQ ID NO: 27353 - protein, 7 aa, Artificial Sequence
  Synthetic construct
WIGYDRY

SEQ ID NO: 27354 - protein, 7 aa, Artificial Sequence
  Synthetic construct
WIGYDCF

SEQ ID NO: 27355 - protein, 7 aa, Artificial Sequence
  Synthetic construct
WIGYDCY

SEQ ID NO: 27356 - protein, 7 aa, Artificial Sequence
  Synthetic construct
WIGYDLF

SEQ ID NO: 27357 - protein, 7 aa, Artificial Sequence
  Synthetic construct
WIGYDLY

SEQ ID NO: 27358 - protein, 7 aa, Artificial Sequence
  Synthetic construct
WIGYDAF

SEQ ID NO: 27359 - protein, 7 aa, Artificial Sequence
  Synthetic construct
WIGYDAY

SEQ ID NO: 27360 - protein, 7 aa, Artificial Sequence
  Synthetic construct
WIGYDQF

SEQ ID NO: 27361 - protein, 7 aa, Artificial Sequence
  Synthetic construct
WIGYDQY

SEQ ID NO: 27362 - protein, 7 aa, Artificial Sequence
  Synthetic construct
WIGYDDF

SEQ ID NO: 27363 - protein, 7 aa, Artificial Sequence
  Synthetic construct
WIGYDDY

SEQ ID NO: 27364 - protein, 7 aa, Artificial Sequence
  Synthetic construct
WIGYDVF

SEQ ID NO: 27365 - protein, 7 aa, Artificial Sequence
  Synthetic construct
WIGYDVY

SEQ ID NO: 27366 - protein, 7 aa, Artificial Sequence
  Synthetic construct
WIGYYFF

SEQ ID NO: 27367 - protein, 7 aa, Artificial Sequence
  Synthetic construct
WIGYYFY

SEQ ID NO: 27368 - protein, 7 aa, Artificial Sequence
  Synthetic construct
WIGYYRF

SEQ ID NO: 27369 - protein, 7 aa, Artificial Sequence
  Synthetic construct
WIGYYRY

SEQ ID NO: 27370 - protein, 7 aa, Artificial Sequence
  Synthetic construct
WIGYYCF

SEQ ID NO: 27371 - protein, 7 aa, Artificial Sequence
  Synthetic construct
WIGYYCY

SEQ ID NO: 27372 - protein, 7 aa, Artificial Sequence
  Synthetic construct
WIGYYLF

SEQ ID NO: 27373 - protein, 7 aa, Artificial Sequence
  Synthetic construct
WIGYYLY

SEQ ID NO: 27374 - protein, 7 aa, Artificial Sequence
  Synthetic construct
WIGYYAF

SEQ ID NO: 27375 - protein, 7 aa, Artificial Sequence
  Synthetic construct
WIGYYAY

SEQ ID NO: 27376 - protein, 7 aa, Artificial Sequence
  Synthetic construct
WIGYYQF

SEQ ID NO: 27377 - protein, 7 aa, Artificial Sequence
  Synthetic construct
WIGYYQY

SEQ ID NO: 27378 - protein, 7 aa, Artificial Sequence
  Synthetic construct
WIGYYDF

SEQ ID NO: 27379 - protein, 7 aa, Artificial Sequence
  Synthetic construct
WIGYYDY

SEQ ID NO: 27380 - protein, 7 aa, Artificial Sequence
  Synthetic construct
WIGYYVF

SEQ ID NO: 27381 - protein, 7 aa, Artificial Sequence
  Synthetic construct
WIGYYVY

SEQ ID NO: 27382 - protein, 7 aa, Artificial Sequence
  Synthetic construct
WIGYFFF

SEQ ID NO: 27383 - protein, 7 aa, Artificial Sequence
  Synthetic construct
WIGYFFY

SEQ ID NO: 27384 - protein, 7 aa, Artificial Sequence
  Synthetic construct
WIGYFRF

SEQ ID NO: 27385 - protein, 7 aa, Artificial Sequence
  Synthetic construct
WIGYFRY

SEQ ID NO: 27386 - protein, 7 aa, Artificial Sequence
  Synthetic construct
WIGYFCF

SEQ ID NO: 27387 - protein, 7 aa, Artificial Sequence
  Synthetic construct
WIGYFCY

SEQ ID NO: 27388 - protein, 7 aa, Artificial Sequence
  Synthetic construct
WIGYFLF

SEQ ID NO: 27389 - protein, 7 aa, Artificial Sequence
  Synthetic construct
WIGYFLY

SEQ ID NO: 27390 - protein, 7 aa, Artificial Sequence
  Synthetic construct
WIGYFAF

SEQ ID NO: 27391 - protein, 7 aa, Artificial Sequence
  Synthetic construct
WIGYFAY

SEQ ID NO: 27392 - protein, 7 aa, Artificial Sequence
  Synthetic construct
WIGYFQF

SEQ ID NO: 27393 - protein, 7 aa, Artificial Sequence
  Synthetic construct
WIGYFQY

SEQ ID NO: 27394 - protein, 7 aa, Artificial Sequence
  Synthetic construct
WIGYFDF

SEQ ID NO: 27395 - protein, 7 aa, Artificial Sequence
  Synthetic construct
WIGYFDY

SEQ ID NO: 27396 - protein, 7 aa, Artificial Sequence
  Synthetic construct
WIGYFVF

SEQ ID NO: 27397 - protein, 7 aa, Artificial Sequence
  Synthetic construct
WIGYFVY

SEQ ID NO: 27398 - protein, 7 aa, Artificial Sequence
  Synthetic construct
WIGYVFF

SEQ ID NO: 27399 - protein, 7 aa, Artificial Sequence
  Synthetic construct
WIGYVFY

SEQ ID NO: 27400 - protein, 7 aa, Artificial Sequence
  Synthetic construct
WIGYVRF

SEQ ID NO: 27401 - protein, 7 aa, Artificial Sequence
  Synthetic construct
WIGYVRY

SEQ ID NO: 27402 - protein, 7 aa, Artificial Sequence
  Synthetic construct
WIGYVCF

SEQ ID NO: 27403 - protein, 7 aa, Artificial Sequence
  Synthetic construct
WIGYVCY

SEQ ID NO: 27404 - protein, 7 aa, Artificial Sequence
  Synthetic construct
WIGYVLF

SEQ ID NO: 27405 - protein, 7 aa, Artificial Sequence
  Synthetic construct
WIGYVLY

SEQ ID NO: 27406 - protein, 7 aa, Artificial Sequence
  Synthetic construct
WIGYVAF

SEQ ID NO: 27407 - protein, 7 aa, Artificial Sequence
  Synthetic construct
WIGYVAY

SEQ ID NO: 27408 - protein, 7 aa, Artificial Sequence
  Synthetic construct
WIGYVQF

SEQ ID NO: 27409 - protein, 7 aa, Artificial Sequence
  Synthetic construct
WIGYVQY

SEQ ID NO: 27410 - protein, 7 aa, Artificial Sequence
  Synthetic construct
WIGYVDF

SEQ ID NO: 27411 - protein, 7 aa, Artificial Sequence
  Synthetic construct
WIGYVDY

SEQ ID NO: 27412 - protein, 7 aa, Artificial Sequence
  Synthetic construct
WIGYVVF

SEQ ID NO: 27413 - protein, 7 aa, Artificial Sequence
  Synthetic construct
WIGYVVY

SEQ ID NO: 27414 - protein, 7 aa, Artificial Sequence
  Synthetic construct
WIGYTFF

SEQ ID NO: 27415 - protein, 7 aa, Artificial Sequence
  Synthetic construct
WIGYTFY

SEQ ID NO: 27416 - protein, 7 aa, Artificial Sequence
  Synthetic construct
WIGYTRF

SEQ ID NO: 27417 - protein, 7 aa, Artificial Sequence
  Synthetic construct
WIGYTRY

SEQ ID NO: 27418 - protein, 7 aa, Artificial Sequence
  Synthetic construct
WIGYTCF

SEQ ID NO: 27419 - protein, 7 aa, Artificial Sequence
  Synthetic construct
WIGYTCY

SEQ ID NO: 27420 - protein, 7 aa, Artificial Sequence
  Synthetic construct
WIGYTLF

SEQ ID NO: 27421 - protein, 7 aa, Artificial Sequence
  Synthetic construct
WIGYTLY

SEQ ID NO: 27422 - protein, 7 aa, Artificial Sequence
  Synthetic construct
WIGYTAF

SEQ ID NO: 27423 - protein, 7 aa, Artificial Sequence
  Synthetic construct
WIGYTAY

SEQ ID NO: 27424 - protein, 7 aa, Artificial Sequence
  Synthetic construct
WIGYTQF

SEQ ID NO: 27425 - protein, 7 aa, Artificial Sequence
  Synthetic construct
WIGYTQY

SEQ ID NO: 27426 - protein, 7 aa, Artificial Sequence
  Synthetic construct
WIGYTDF

SEQ ID NO: 27427 - protein, 7 aa, Artificial Sequence
  Synthetic construct
WIGYTDY

SEQ ID NO: 27428 - protein, 7 aa, Artificial Sequence
  Synthetic construct
WIGYTVF

SEQ ID NO: 27429 - protein, 7 aa, Artificial Sequence
  Synthetic construct
WIGYTVY

SEQ ID NO: 27430 - protein, 7 aa, Artificial Sequence
  Synthetic construct
WIGYGFF

SEQ ID NO: 27431 - protein, 7 aa, Artificial Sequence
  Synthetic construct
WIGYGFY

SEQ ID NO: 27432 - protein, 7 aa, Artificial Sequence
  Synthetic construct
WIGYGRF

SEQ ID NO: 27433 - protein, 7 aa, Artificial Sequence
  Synthetic construct
WIGYGRY

SEQ ID NO: 27434 - protein, 7 aa, Artificial Sequence
  Synthetic construct
WIGYGCF

SEQ ID NO: 27435 - protein, 7 aa, Artificial Sequence
  Synthetic construct
WIGYGCY

SEQ ID NO: 27436 - protein, 7 aa, Artificial Sequence
  Synthetic construct
WIGYGLF

SEQ ID NO: 27437 - protein, 7 aa, Artificial Sequence
  Synthetic construct
WIGYGLY

SEQ ID NO: 27438 - protein, 7 aa, Artificial Sequence
  Synthetic construct
WIGYGAF

SEQ ID NO: 27439 - protein, 7 aa, Artificial Sequence
  Synthetic construct
WIGYGAY

SEQ ID NO: 27440 - protein, 7 aa, Artificial Sequence
  Synthetic construct
WIGYGQF

SEQ ID NO: 27441 - protein, 7 aa, Artificial Sequence
  Synthetic construct
WIGYGQY

SEQ ID NO: 27442 - protein, 7 aa, Artificial Sequence
  Synthetic construct
WIGYGDF

SEQ ID NO: 27443 - protein, 7 aa, Artificial Sequence
  Synthetic construct
WIGYGDY

SEQ ID NO: 27444 - protein, 7 aa, Artificial Sequence
  Synthetic construct
WIGYGVF

SEQ ID NO: 27445 - protein, 7 aa, Artificial Sequence
  Synthetic construct
WIGYGVY

SEQ ID NO: 27446 - protein, 7 aa, Artificial Sequence
  Synthetic construct
WIGYAFF

SEQ ID NO: 27447 - protein, 7 aa, Artificial Sequence
  Synthetic construct
WIGYAFY

SEQ ID NO: 27448 - protein, 7 aa, Artificial Sequence
  Synthetic construct
WIGYARF

SEQ ID NO: 27449 - protein, 7 aa, Artificial Sequence
  Synthetic construct
WIGYARY

SEQ ID NO: 27450 - protein, 7 aa, Artificial Sequence
  Synthetic construct
WIGYACF

SEQ ID NO: 27451 - protein, 7 aa, Artificial Sequence
  Synthetic construct
WIGYACY

SEQ ID NO: 27452 - protein, 7 aa, Artificial Sequence
  Synthetic construct
WIGYALF

SEQ ID NO: 27453 - protein, 7 aa, Artificial Sequence
  Synthetic construct
WIGYALY

SEQ ID NO: 27454 - protein, 7 aa, Artificial Sequence
  Synthetic construct
WIGYAAF

SEQ ID NO: 27455 - protein, 7 aa, Artificial Sequence
  Synthetic construct
WIGYAAY

SEQ ID NO: 27456 - protein, 7 aa, Artificial Sequence
  Synthetic construct
WIGYAQF

SEQ ID NO: 27457 - protein, 7 aa, Artificial Sequence
  Synthetic construct
WIGYAQY

SEQ ID NO: 27458 - protein, 7 aa, Artificial Sequence
  Synthetic construct
WIGYADF

SEQ ID NO: 27459 - protein, 7 aa, Artificial Sequence
  Synthetic construct
WIGYADY

SEQ ID NO: 27460 - protein, 7 aa, Artificial Sequence
  Synthetic construct
WIGYAVF

SEQ ID NO: 27461 - protein, 7 aa, Artificial Sequence
  Synthetic construct
WIGYAVY

SEQ ID NO: 27462 - protein, 7 aa, Artificial Sequence
  Synthetic construct
WIGYQFF

SEQ ID NO: 27463 - protein, 7 aa, Artificial Sequence
  Synthetic construct
WIGYQFY

SEQ ID NO: 27464 - protein, 7 aa, Artificial Sequence
  Synthetic construct
WIGYQRF

SEQ ID NO: 27465 - protein, 7 aa, Artificial Sequence
  Synthetic construct
WIGYQRY

SEQ ID NO: 27466 - protein, 7 aa, Artificial Sequence
  Synthetic construct
WIGYQCF

SEQ ID NO: 27467 - protein, 7 aa, Artificial Sequence
  Synthetic construct
WIGYQCY

SEQ ID NO: 27468 - protein, 7 aa, Artificial Sequence
  Synthetic construct
WIGYQLF

SEQ ID NO: 27469 - protein, 7 aa, Artificial Sequence
  Synthetic construct
WIGYQLY

SEQ ID NO: 27470 - protein, 7 aa, Artificial Sequence
  Synthetic construct
WIGYQAF

SEQ ID NO: 27471 - protein, 7 aa, Artificial Sequence
  Synthetic construct
WIGYQAY

SEQ ID NO: 27472 - protein, 7 aa, Artificial Sequence
  Synthetic construct
WIGYQQF

SEQ ID NO: 27473 - protein, 7 aa, Artificial Sequence
  Synthetic construct
WIGYQQY

SEQ ID NO: 27474 - protein, 7 aa, Artificial Sequence
  Synthetic construct
WIGYQDF

SEQ ID NO: 27475 - protein, 7 aa, Artificial Sequence
  Synthetic construct
WIGYQDY

SEQ ID NO: 27476 - protein, 7 aa, Artificial Sequence
  Synthetic construct
WIGYQVF

SEQ ID NO: 27477 - protein, 7 aa, Artificial Sequence
  Synthetic construct
WIGYQVY

SEQ ID NO: 27478 - protein, 7 aa, Artificial Sequence
  Synthetic construct
WIGPIFF

SEQ ID NO: 27479 - protein, 7 aa, Artificial Sequence
  Synthetic construct
WIGPIFY

SEQ ID NO: 27480 - protein, 7 aa, Artificial Sequence
  Synthetic construct
WIGPIRF

SEQ ID NO: 27481 - protein, 7 aa, Artificial Sequence
  Synthetic construct
WIGPIRY

SEQ ID NO: 27482 - protein, 7 aa, Artificial Sequence
  Synthetic construct
WIGPICF

SEQ ID NO: 27483 - protein, 7 aa, Artificial Sequence
  Synthetic construct
WIGPICY

SEQ ID NO: 27484 - protein, 7 aa, Artificial Sequence
  Synthetic construct
WIGPILF

SEQ ID NO: 27485 - protein, 7 aa, Artificial Sequence
  Synthetic construct
WIGPILY

SEQ ID NO: 27486 - protein, 7 aa, Artificial Sequence
  Synthetic construct
WIGPIAF

SEQ ID NO: 27487 - protein, 7 aa, Artificial Sequence
  Synthetic construct
WIGPIAY

SEQ ID NO: 27488 - protein, 7 aa, Artificial Sequence
  Synthetic construct
WIGPIQF

SEQ ID NO: 27489 - protein, 7 aa, Artificial Sequence
  Synthetic construct
WIGPIQY

SEQ ID NO: 27490 - protein, 7 aa, Artificial Sequence
  Synthetic construct
WIGPIDF

SEQ ID NO: 27491 - protein, 7 aa, Artificial Sequence
  Synthetic construct
WIGPIDY

SEQ ID NO: 27492 - protein, 7 aa, Artificial Sequence
  Synthetic construct
WIGPIVF

SEQ ID NO: 27493 - protein, 7 aa, Artificial Sequence
  Synthetic construct
WIGPIVY

SEQ ID NO: 27494 - protein, 7 aa, Artificial Sequence
  Synthetic construct
WIGPDFF

SEQ ID NO: 27495 - protein, 7 aa, Artificial Sequence
  Synthetic construct
WIGPDFY

SEQ ID NO: 27496 - protein, 7 aa, Artificial Sequence
  Synthetic construct
WIGPDRF

SEQ ID NO: 27497 - protein, 7 aa, Artificial Sequence
  Synthetic construct
WIGPDRY

SEQ ID NO: 27498 - protein, 7 aa, Artificial Sequence
  Synthetic construct
WIGPDCF

SEQ ID NO: 27499 - protein, 7 aa, Artificial Sequence
  Synthetic construct
WIGPDCY

SEQ ID NO: 27500 - protein, 7 aa, Artificial Sequence
  Synthetic construct
WIGPDLF

SEQ ID NO: 27501 - protein, 7 aa, Artificial Sequence
  Synthetic construct
WIGPDLY

SEQ ID NO: 27502 - protein, 7 aa, Artificial Sequence
  Synthetic construct
WIGPDAF

SEQ ID NO: 27503 - protein, 7 aa, Artificial Sequence
  Synthetic construct
WIGPDAY

SEQ ID NO: 27504 - protein, 7 aa, Artificial Sequence
  Synthetic construct
WIGPDQF

SEQ ID NO: 27505 - protein, 7 aa, Artificial Sequence
  Synthetic construct
WIGPDQY

SEQ ID NO: 27506 - protein, 7 aa, Artificial Sequence
  Synthetic construct
WIGPDDF

SEQ ID NO: 27507 - protein, 7 aa, Artificial Sequence
  Synthetic construct
WIGPDDY

SEQ ID NO: 27508 - protein, 7 aa, Artificial Sequence
  Synthetic construct
WIGPDVF

SEQ ID NO: 27509 - protein, 7 aa, Artificial Sequence
  Synthetic construct
WIGPDVY

SEQ ID NO: 27510 - protein, 7 aa, Artificial Sequence
  Synthetic construct
WIGPYFF

SEQ ID NO: 27511 - protein, 7 aa, Artificial Sequence
  Synthetic construct
WIGPYFY

SEQ ID NO: 27512 - protein, 7 aa, Artificial Sequence
  Synthetic construct
WIGPYRF

SEQ ID NO: 27513 - protein, 7 aa, Artificial Sequence
  Synthetic construct
WIGPYRY

SEQ ID NO: 27514 - protein, 7 aa, Artificial Sequence
  Synthetic construct
WIGPYCF

SEQ ID NO: 27515 - protein, 7 aa, Artificial Sequence
  Synthetic construct
WIGPYCY

SEQ ID NO: 27516 - protein, 7 aa, Artificial Sequence
  Synthetic construct
WIGPYLF

SEQ ID NO: 27517 - protein, 7 aa, Artificial Sequence
  Synthetic construct
WIGPYLY

SEQ ID NO: 27518 - protein, 7 aa, Artificial Sequence
  Synthetic construct
WIGPYAF

SEQ ID NO: 27519 - protein, 7 aa, Artificial Sequence
  Synthetic construct
WIGPYAY

SEQ ID NO: 27520 - protein, 7 aa, Artificial Sequence
  Synthetic construct
WIGPYQF

SEQ ID NO: 27521 - protein, 7 aa, Artificial Sequence
  Synthetic construct
WIGPYQY

SEQ ID NO: 27522 - protein, 7 aa, Artificial Sequence
  Synthetic construct
WIGPYDF

SEQ ID NO: 27523 - protein, 7 aa, Artificial Sequence
  Synthetic construct
WIGPYDY

SEQ ID NO: 27524 - protein, 7 aa, Artificial Sequence
  Synthetic construct
WIGPYVF

SEQ ID NO: 27525 - protein, 7 aa, Artificial Sequence
  Synthetic construct
WIGPYVY

SEQ ID NO: 27526 - protein, 7 aa, Artificial Sequence
  Synthetic construct
WIGPFFF

SEQ ID NO: 27527 - protein, 7 aa, Artificial Sequence
  Synthetic construct
WIGPFFY

SEQ ID NO: 27528 - protein, 7 aa, Artificial Sequence
  Synthetic construct
WIGPFRF

SEQ ID NO: 27529 - protein, 7 aa, Artificial Sequence
  Synthetic construct
WIGPFRY

SEQ ID NO: 27530 - protein, 7 aa, Artificial Sequence
  Synthetic construct
WIGPFCF

SEQ ID NO: 27531 - protein, 7 aa, Artificial Sequence
  Synthetic construct
WIGPFCY

SEQ ID NO: 27532 - protein, 7 aa, Artificial Sequence
  Synthetic construct
WIGPFLF

SEQ ID NO: 27533 - protein, 7 aa, Artificial Sequence
  Synthetic construct
WIGPFLY

SEQ ID NO: 27534 - protein, 7 aa, Artificial Sequence
  Synthetic construct
WIGPFAF

SEQ ID NO: 27535 - protein, 7 aa, Artificial Sequence
  Synthetic construct
WIGPFAY

SEQ ID NO: 27536 - protein, 7 aa, Artificial Sequence
  Synthetic construct
WIGPFQF

SEQ ID NO: 27537 - protein, 7 aa, Artificial Sequence
  Synthetic construct
WIGPFQY

SEQ ID NO: 27538 - protein, 7 aa, Artificial Sequence
  Synthetic construct
WIGPFDF

SEQ ID NO: 27539 - protein, 7 aa, Artificial Sequence
  Synthetic construct
WIGPFDY

SEQ ID NO: 27540 - protein, 7 aa, Artificial Sequence
  Synthetic construct
WIGPFVF

SEQ ID NO: 27541 - protein, 7 aa, Artificial Sequence
  Synthetic construct
WIGPFVY

SEQ ID NO: 27542 - protein, 7 aa, Artificial Sequence
  Synthetic construct
WIGPVFF

SEQ ID NO: 27543 - protein, 7 aa, Artificial Sequence
  Synthetic construct
WIGPVFY

SEQ ID NO: 27544 - protein, 7 aa, Artificial Sequence
  Synthetic construct
WIGPVRF

SEQ ID NO: 27545 - protein, 7 aa, Artificial Sequence
  Synthetic construct
WIGPVRY

SEQ ID NO: 27546 - protein, 7 aa, Artificial Sequence
  Synthetic construct
WIGPVCF

SEQ ID NO: 27547 - protein, 7 aa, Artificial Sequence
  Synthetic construct
WIGPVCY

SEQ ID NO: 27548 - protein, 7 aa, Artificial Sequence
  Synthetic construct
WIGPVLF

SEQ ID NO: 27549 - protein, 7 aa, Artificial Sequence
  Synthetic construct
WIGPVLY

SEQ ID NO: 27550 - protein, 7 aa, Artificial Sequence
  Synthetic construct
WIGPVAF

SEQ ID NO: 27551 - protein, 7 aa, Artificial Sequence
  Synthetic construct
WIGPVAY

SEQ ID NO: 27552 - protein, 7 aa, Artificial Sequence
  Synthetic construct
WIGPVQF

SEQ ID NO: 27553 - protein, 7 aa, Artificial Sequence
  Synthetic construct
WIGPVQY

SEQ ID NO: 27554 - protein, 7 aa, Artificial Sequence
  Synthetic construct
WIGPVDF

SEQ ID NO: 27555 - protein, 7 aa, Artificial Sequence
  Synthetic construct
WIGPVDY

SEQ ID NO: 27556 - protein, 7 aa, Artificial Sequence
  Synthetic construct
WIGPVVF

SEQ ID NO: 27557 - protein, 7 aa, Artificial Sequence
  Synthetic construct
WIGPVVY

SEQ ID NO: 27558 - protein, 7 aa, Artificial Sequence
  Synthetic construct
WIGPTFF

SEQ ID NO: 27559 - protein, 7 aa, Artificial Sequence
  Synthetic construct
WIGPTFY

SEQ ID NO: 27560 - protein, 7 aa, Artificial Sequence
  Synthetic construct
WIGPTRF

SEQ ID NO: 27561 - protein, 7 aa, Artificial Sequence
  Synthetic construct
WIGPTRY

SEQ ID NO: 27562 - protein, 7 aa, Artificial Sequence
  Synthetic construct
WIGPTCF

SEQ ID NO: 27563 - protein, 7 aa, Artificial Sequence
  Synthetic construct
WIGPTCY

SEQ ID NO: 27564 - protein, 7 aa, Artificial Sequence
  Synthetic construct
WIGPTLF

SEQ ID NO: 27565 - protein, 7 aa, Artificial Sequence
  Synthetic construct
WIGPTLY

SEQ ID NO: 27566 - protein, 7 aa, Artificial Sequence
  Synthetic construct
WIGPTAF

SEQ ID NO: 27567 - protein, 7 aa, Artificial Sequence
  Synthetic construct
WIGPTAY

SEQ ID NO: 27568 - protein, 7 aa, Artificial Sequence
  Synthetic construct
WIGPTQF

SEQ ID NO: 27569 - protein, 7 aa, Artificial Sequence
  Synthetic construct
WIGPTQY

SEQ ID NO: 27570 - protein, 7 aa, Artificial Sequence
  Synthetic construct
WIGPTDF

SEQ ID NO: 27571 - protein, 7 aa, Artificial Sequence
  Synthetic construct
WIGPTDY

SEQ ID NO: 27572 - protein, 7 aa, Artificial Sequence
  Synthetic construct
WIGPTVF

SEQ ID NO: 27573 - protein, 7 aa, Artificial Sequence
  Synthetic construct
WIGPTVY

SEQ ID NO: 27574 - protein, 7 aa, Artificial Sequence
  Synthetic construct
WIGPGFF

SEQ ID NO: 27575 - protein, 7 aa, Artificial Sequence
  Synthetic construct
WIGPGFY

SEQ ID NO: 27576 - protein, 7 aa, Artificial Sequence
  Synthetic construct
WIGPGRF

SEQ ID NO: 27577 - protein, 7 aa, Artificial Sequence
  Synthetic construct
WIGPGRY

SEQ ID NO: 27578 - protein, 7 aa, Artificial Sequence
  Synthetic construct
WIGPGCF

SEQ ID NO: 27579 - protein, 7 aa, Artificial Sequence
  Synthetic construct
WIGPGCY

SEQ ID NO: 27580 - protein, 7 aa, Artificial Sequence
  Synthetic construct
WIGPGLF

SEQ ID NO: 27581 - protein, 7 aa, Artificial Sequence
  Synthetic construct
WIGPGLY

SEQ ID NO: 27582 - protein, 7 aa, Artificial Sequence
  Synthetic construct
WIGPGAF

SEQ ID NO: 27583 - protein, 7 aa, Artificial Sequence
  Synthetic construct
WIGPGAY

SEQ ID NO: 27584 - protein, 7 aa, Artificial Sequence
  Synthetic construct
WIGPGQF

SEQ ID NO: 27585 - protein, 7 aa, Artificial Sequence
  Synthetic construct
WIGPGQY

SEQ ID NO: 27586 - protein, 7 aa, Artificial Sequence
  Synthetic construct
WIGPGDF

SEQ ID NO: 27587 - protein, 7 aa, Artificial Sequence
  Synthetic construct
WIGPGDY

SEQ ID NO: 27588 - protein, 7 aa, Artificial Sequence
  Synthetic construct
WIGPGVF

SEQ ID NO: 27589 - protein, 7 aa, Artificial Sequence
  Synthetic construct
WIGPGVY

SEQ ID NO: 27590 - protein, 7 aa, Artificial Sequence
  Synthetic construct
WIGPAFF

SEQ ID NO: 27591 - protein, 7 aa, Artificial Sequence
  Synthetic construct
WIGPAFY

SEQ ID NO: 27592 - protein, 7 aa, Artificial Sequence
  Synthetic construct
WIGPARF

SEQ ID NO: 27593 - protein, 7 aa, Artificial Sequence
  Synthetic construct
WIGPARY

SEQ ID NO: 27594 - protein, 7 aa, Artificial Sequence
  Synthetic construct
WIGPACF

SEQ ID NO: 27595 - protein, 7 aa, Artificial Sequence
  Synthetic construct
WIGPACY

SEQ ID NO: 27596 - protein, 7 aa, Artificial Sequence
  Synthetic construct
WIGPALF

SEQ ID NO: 27597 - protein, 7 aa, Artificial Sequence
  Synthetic construct
WIGPALY

SEQ ID NO: 27598 - protein, 7 aa, Artificial Sequence
  Synthetic construct
WIGPAAF

SEQ ID NO: 27599 - protein, 7 aa, Artificial Sequence
  Synthetic construct
WIGPAAY

SEQ ID NO: 27600 - protein, 7 aa, Artificial Sequence
  Synthetic construct
WIGPAQF

SEQ ID NO: 27601 - protein, 7 aa, Artificial Sequence
  Synthetic construct
WIGPAQY

SEQ ID NO: 27602 - protein, 7 aa, Artificial Sequence
  Synthetic construct
WIGPADF

SEQ ID NO: 27603 - protein, 7 aa, Artificial Sequence
  Synthetic construct
WIGPADY

SEQ ID NO: 27604 - protein, 7 aa, Artificial Sequence
  Synthetic construct
WIGPAVF

SEQ ID NO: 27605 - protein, 7 aa, Artificial Sequence
  Synthetic construct
WIGPAVY

SEQ ID NO: 27606 - protein, 7 aa, Artificial Sequence
  Synthetic construct
WIGPQFF

SEQ ID NO: 27607 - protein, 7 aa, Artificial Sequence
  Synthetic construct
WIGPQFY

SEQ ID NO: 27608 - protein, 7 aa, Artificial Sequence
  Synthetic construct
WIGPQRF

SEQ ID NO: 27609 - protein, 7 aa, Artificial Sequence
  Synthetic construct
WIGPQRY

SEQ ID NO: 27610 - protein, 7 aa, Artificial Sequence
  Synthetic construct
WIGPQCF

SEQ ID NO: 27611 - protein, 7 aa, Artificial Sequence
  Synthetic construct
WIGPQCY

SEQ ID NO: 27612 - protein, 7 aa, Artificial Sequence
  Synthetic construct
WIGPQLF

SEQ ID NO: 27613 - protein, 7 aa, Artificial Sequence
  Synthetic construct
WIGPQLY

SEQ ID NO: 27614 - protein, 7 aa, Artificial Sequence
  Synthetic construct
WIGPQAF

SEQ ID NO: 27615 - protein, 7 aa, Artificial Sequence
  Synthetic construct
WIGPQAY

SEQ ID NO: 27616 - protein, 7 aa, Artificial Sequence
  Synthetic construct
WIGPQQF

SEQ ID NO: 27617 - protein, 7 aa, Artificial Sequence
  Synthetic construct
WIGPQQY

SEQ ID NO: 27618 - protein, 7 aa, Artificial Sequence
  Synthetic construct
WIGPQDF

SEQ ID NO: 27619 - protein, 7 aa, Artificial Sequence
  Synthetic construct
WIGPQDY

SEQ ID NO: 27620 - protein, 7 aa, Artificial Sequence
  Synthetic construct
WIGPQVF

SEQ ID NO: 27621 - protein, 7 aa, Artificial Sequence
  Synthetic construct
WIGPQVY

SEQ ID NO: 27622 - protein, 7 aa, Artificial Sequence
  Synthetic construct
WIGHIFF

SEQ ID NO: 27623 - protein, 7 aa, Artificial Sequence
  Synthetic construct
WIGHIFY

SEQ ID NO: 27624 - protein, 7 aa, Artificial Sequence
  Synthetic construct
WIGHIRF

SEQ ID NO: 27625 - protein, 7 aa, Artificial Sequence
  Synthetic construct
WIGHIRY

SEQ ID NO: 27626 - protein, 7 aa, Artificial Sequence
  Synthetic construct
WIGHICF

SEQ ID NO: 27627 - protein, 7 aa, Artificial Sequence
  Synthetic construct
WIGHICY

SEQ ID NO: 27628 - protein, 7 aa, Artificial Sequence
  Synthetic construct
WIGHILF

SEQ ID NO: 27629 - protein, 7 aa, Artificial Sequence
  Synthetic construct
WIGHILY

SEQ ID NO: 27630 - protein, 7 aa, Artificial Sequence
  Synthetic construct
WIGHIAF

SEQ ID NO: 27631 - protein, 7 aa, Artificial Sequence
  Synthetic construct
WIGHIAY

SEQ ID NO: 27632 - protein, 7 aa, Artificial Sequence
  Synthetic construct
WIGHIQF

SEQ ID NO: 27633 - protein, 7 aa, Artificial Sequence
  Synthetic construct
WIGHIQY

SEQ ID NO: 27634 - protein, 7 aa, Artificial Sequence
  Synthetic construct
WIGHIDF

SEQ ID NO: 27635 - protein, 7 aa, Artificial Sequence
  Synthetic construct
WIGHIDY

SEQ ID NO: 27636 - protein, 7 aa, Artificial Sequence
  Synthetic construct
WIGHIVF

SEQ ID NO: 27637 - protein, 7 aa, Artificial Sequence
  Synthetic construct
WIGHIVY

SEQ ID NO: 27638 - protein, 7 aa, Artificial Sequence
  Synthetic construct
WIGHDFF

SEQ ID NO: 27639 - protein, 7 aa, Artificial Sequence
  Synthetic construct
WIGHDFY

SEQ ID NO: 27640 - protein, 7 aa, Artificial Sequence
  Synthetic construct
WIGHDRF

SEQ ID NO: 27641 - protein, 7 aa, Artificial Sequence
  Synthetic construct
WIGHDRY

SEQ ID NO: 27642 - protein, 7 aa, Artificial Sequence
  Synthetic construct
WIGHDCF

SEQ ID NO: 27643 - protein, 7 aa, Artificial Sequence
  Synthetic construct
WIGHDCY

SEQ ID NO: 27644 - protein, 7 aa, Artificial Sequence
  Synthetic construct
WIGHDLF

SEQ ID NO: 27645 - protein, 7 aa, Artificial Sequence
  Synthetic construct
WIGHDLY

SEQ ID NO: 27646 - protein, 7 aa, Artificial Sequence
  Synthetic construct
WIGHDAF

SEQ ID NO: 27647 - protein, 7 aa, Artificial Sequence
  Synthetic construct
WIGHDAY

SEQ ID NO: 27648 - protein, 7 aa, Artificial Sequence
  Synthetic construct
WIGHDQF

SEQ ID NO: 27649 - protein, 7 aa, Artificial Sequence
  Synthetic construct
WIGHDQY

SEQ ID NO: 27650 - protein, 7 aa, Artificial Sequence
  Synthetic construct
WIGHDDF

SEQ ID NO: 27651 - protein, 7 aa, Artificial Sequence
  Synthetic construct
WIGHDDY

SEQ ID NO: 27652 - protein, 7 aa, Artificial Sequence
  Synthetic construct
WIGHDVF

SEQ ID NO: 27653 - protein, 7 aa, Artificial Sequence
  Synthetic construct
WIGHDVY

SEQ ID NO: 27654 - protein, 7 aa, Artificial Sequence
  Synthetic construct
WIGHYFF

SEQ ID NO: 27655 - protein, 7 aa, Artificial Sequence
  Synthetic construct
WIGHYFY

SEQ ID NO: 27656 - protein, 7 aa, Artificial Sequence
  Synthetic construct
WIGHYRF

SEQ ID NO: 27657 - protein, 7 aa, Artificial Sequence
  Synthetic construct
WIGHYRY

SEQ ID NO: 27658 - protein, 7 aa, Artificial Sequence
  Synthetic construct
WIGHYCF

SEQ ID NO: 27659 - protein, 7 aa, Artificial Sequence
  Synthetic construct
WIGHYCY

SEQ ID NO: 27660 - protein, 7 aa, Artificial Sequence
  Synthetic construct
WIGHYLF

SEQ ID NO: 27661 - protein, 7 aa, Artificial Sequence
  Synthetic construct
WIGHYLY

SEQ ID NO: 27662 - protein, 7 aa, Artificial Sequence
  Synthetic construct
WIGHYAF

SEQ ID NO: 27663 - protein, 7 aa, Artificial Sequence
  Synthetic construct
WIGHYAY

SEQ ID NO: 27664 - protein, 7 aa, Artificial Sequence
  Synthetic construct
WIGHYQF

SEQ ID NO: 27665 - protein, 7 aa, Artificial Sequence
  Synthetic construct
WIGHYQY

SEQ ID NO: 27666 - protein, 7 aa, Artificial Sequence
  Synthetic construct
WIGHYDF

SEQ ID NO: 27667 - protein, 7 aa, Artificial Sequence
  Synthetic construct
WIGHYDY

SEQ ID NO: 27668 - protein, 7 aa, Artificial Sequence
  Synthetic construct
WIGHYVF

SEQ ID NO: 27669 - protein, 7 aa, Artificial Sequence
  Synthetic construct
WIGHYVY

SEQ ID NO: 27670 - protein, 7 aa, Artificial Sequence
  Synthetic construct
WIGHFFF

SEQ ID NO: 27671 - protein, 7 aa, Artificial Sequence
  Synthetic construct
WIGHFFY

SEQ ID NO: 27672 - protein, 7 aa, Artificial Sequence
  Synthetic construct
WIGHFRF

SEQ ID NO: 27673 - protein, 7 aa, Artificial Sequence
  Synthetic construct
WIGHFRY

SEQ ID NO: 27674 - protein, 7 aa, Artificial Sequence
  Synthetic construct
WIGHFCF

SEQ ID NO: 27675 - protein, 7 aa, Artificial Sequence
  Synthetic construct
WIGHFCY

SEQ ID NO: 27676 - protein, 7 aa, Artificial Sequence
  Synthetic construct
WIGHFLF

SEQ ID NO: 27677 - protein, 7 aa, Artificial Sequence
  Synthetic construct
WIGHFLY

SEQ ID NO: 27678 - protein, 7 aa, Artificial Sequence
  Synthetic construct
WIGHFAF

SEQ ID NO: 27679 - protein, 7 aa, Artificial Sequence
  Synthetic construct
WIGHFAY

SEQ ID NO: 27680 - protein, 7 aa, Artificial Sequence
  Synthetic construct
WIGHFQF

SEQ ID NO: 27681 - protein, 7 aa, Artificial Sequence
  Synthetic construct
WIGHFQY

SEQ ID NO: 27682 - protein, 7 aa, Artificial Sequence
  Synthetic construct
WIGHFDF

SEQ ID NO: 27683 - protein, 7 aa, Artificial Sequence
  Synthetic construct
WIGHFDY

SEQ ID NO: 27684 - protein, 7 aa, Artificial Sequence
  Synthetic construct
WIGHFVF

SEQ ID NO: 27685 - protein, 7 aa, Artificial Sequence
  Synthetic construct
WIGHFVY

SEQ ID NO: 27686 - protein, 7 aa, Artificial Sequence
  Synthetic construct
WIGHVFF

SEQ ID NO: 27687 - protein, 7 aa, Artificial Sequence
  Synthetic construct
WIGHVFY

SEQ ID NO: 27688 - protein, 7 aa, Artificial Sequence
  Synthetic construct
WIGHVRF

SEQ ID NO: 27689 - protein, 7 aa, Artificial Sequence
  Synthetic construct
WIGHVRY

SEQ ID NO: 27690 - protein, 7 aa, Artificial Sequence
  Synthetic construct
WIGHVCF

SEQ ID NO: 27691 - protein, 7 aa, Artificial Sequence
  Synthetic construct
WIGHVCY

SEQ ID NO: 27692 - protein, 7 aa, Artificial Sequence
  Synthetic construct
WIGHVLF

SEQ ID NO: 27693 - protein, 7 aa, Artificial Sequence
  Synthetic construct
WIGHVLY

SEQ ID NO: 27694 - protein, 7 aa, Artificial Sequence
  Synthetic construct
WIGHVAF

SEQ ID NO: 27695 - protein, 7 aa, Artificial Sequence
  Synthetic construct
WIGHVAY

SEQ ID NO: 27696 - protein, 7 aa, Artificial Sequence
  Synthetic construct
WIGHVQF

SEQ ID NO: 27697 - protein, 7 aa, Artificial Sequence
  Synthetic construct
WIGHVQY

SEQ ID NO: 27698 - protein, 7 aa, Artificial Sequence
  Synthetic construct
WIGHVDF

SEQ ID NO: 27699 - protein, 7 aa, Artificial Sequence
  Synthetic construct
WIGHVDY

SEQ ID NO: 27700 - protein, 7 aa, Artificial Sequence
  Synthetic construct
WIGHVVF

SEQ ID NO: 27701 - protein, 7 aa, Artificial Sequence
  Synthetic construct
WIGHVVY

SEQ ID NO: 27702 - protein, 7 aa, Artificial Sequence
  Synthetic construct
WIGHTFF

SEQ ID NO: 27703 - protein, 7 aa, Artificial Sequence
  Synthetic construct
WIGHTFY

SEQ ID NO: 27704 - protein, 7 aa, Artificial Sequence
  Synthetic construct
WIGHTRF

SEQ ID NO: 27705 - protein, 7 aa, Artificial Sequence
  Synthetic construct
WIGHTRY

SEQ ID NO: 27706 - protein, 7 aa, Artificial Sequence
  Synthetic construct
WIGHTCF

SEQ ID NO: 27707 - protein, 7 aa, Artificial Sequence
  Synthetic construct
WIGHTCY

SEQ ID NO: 27708 - protein, 7 aa, Artificial Sequence
  Synthetic construct
WIGHTLF

SEQ ID NO: 27709 - protein, 7 aa, Artificial Sequence
  Synthetic construct
WIGHTLY

SEQ ID NO: 27710 - protein, 7 aa, Artificial Sequence
  Synthetic construct
WIGHTAF

SEQ ID NO: 27711 - protein, 7 aa, Artificial Sequence
  Synthetic construct
WIGHTAY

SEQ ID NO: 27712 - protein, 7 aa, Artificial Sequence
  Synthetic construct
WIGHTQF

SEQ ID NO: 27713 - protein, 7 aa, Artificial Sequence
  Synthetic construct
WIGHTQY

SEQ ID NO: 27714 - protein, 7 aa, Artificial Sequence
  Synthetic construct
WIGHTDF

SEQ ID NO: 27715 - protein, 7 aa, Artificial Sequence
  Synthetic construct
WIGHTDY

SEQ ID NO: 27716 - protein, 7 aa, Artificial Sequence
  Synthetic construct
WIGHTVF

SEQ ID NO: 27717 - protein, 7 aa, Artificial Sequence
  Synthetic construct
WIGHTVY

SEQ ID NO: 27718 - protein, 7 aa, Artificial Sequence
  Synthetic construct
WIGHGFF

SEQ ID NO: 27719 - protein, 7 aa, Artificial Sequence
  Synthetic construct
WIGHGFY

SEQ ID NO: 27720 - protein, 7 aa, Artificial Sequence
  Synthetic construct
WIGHGRF

SEQ ID NO: 27721 - protein, 7 aa, Artificial Sequence
  Synthetic construct
WIGHGRY

SEQ ID NO: 27722 - protein, 7 aa, Artificial Sequence
  Synthetic construct
WIGHGCF

SEQ ID NO: 27723 - protein, 7 aa, Artificial Sequence
  Synthetic construct
WIGHGCY

SEQ ID NO: 27724 - protein, 7 aa, Artificial Sequence
  Synthetic construct
WIGHGLF

SEQ ID NO: 27725 - protein, 7 aa, Artificial Sequence
  Synthetic construct
WIGHGLY

SEQ ID NO: 27726 - protein, 7 aa, Artificial Sequence
  Synthetic construct
WIGHGAF

SEQ ID NO: 27727 - protein, 7 aa, Artificial Sequence
  Synthetic construct
WIGHGAY

SEQ ID NO: 27728 - protein, 7 aa, Artificial Sequence
  Synthetic construct
WIGHGQF

SEQ ID NO: 27729 - protein, 7 aa, Artificial Sequence
  Synthetic construct
WIGHGQY

SEQ ID NO: 27730 - protein, 7 aa, Artificial Sequence
  Synthetic construct
WIGHGDF

SEQ ID NO: 27731 - protein, 7 aa, Artificial Sequence
  Synthetic construct
WIGHGDY

SEQ ID NO: 27732 - protein, 7 aa, Artificial Sequence
  Synthetic construct
WIGHGVF

SEQ ID NO: 27733 - protein, 7 aa, Artificial Sequence
  Synthetic construct
WIGHGVY

SEQ ID NO: 27734 - protein, 7 aa, Artificial Sequence
  Synthetic construct
WIGHAFF

SEQ ID NO: 27735 - protein, 7 aa, Artificial Sequence
  Synthetic construct
WIGHAFY

SEQ ID NO: 27736 - protein, 7 aa, Artificial Sequence
  Synthetic construct
WIGHARF

SEQ ID NO: 27737 - protein, 7 aa, Artificial Sequence
  Synthetic construct
WIGHARY

SEQ ID NO: 27738 - protein, 7 aa, Artificial Sequence
  Synthetic construct
WIGHACF

SEQ ID NO: 27739 - protein, 7 aa, Artificial Sequence
  Synthetic construct
WIGHACY

SEQ ID NO: 27740 - protein, 7 aa, Artificial Sequence
  Synthetic construct
WIGHALF

SEQ ID NO: 27741 - protein, 7 aa, Artificial Sequence
  Synthetic construct
WIGHALY

SEQ ID NO: 27742 - protein, 7 aa, Artificial Sequence
  Synthetic construct
WIGHAAF

SEQ ID NO: 27743 - protein, 7 aa, Artificial Sequence
  Synthetic construct
WIGHAAY

SEQ ID NO: 27744 - protein, 7 aa, Artificial Sequence
  Synthetic construct
WIGHAQF

SEQ ID NO: 27745 - protein, 7 aa, Artificial Sequence
  Synthetic construct
WIGHAQY

SEQ ID NO: 27746 - protein, 7 aa, Artificial Sequence
  Synthetic construct
WIGHADF

SEQ ID NO: 27747 - protein, 7 aa, Artificial Sequence
  Synthetic construct
WIGHADY

SEQ ID NO: 27748 - protein, 7 aa, Artificial Sequence
  Synthetic construct
WIGHAVF

SEQ ID NO: 27749 - protein, 7 aa, Artificial Sequence
  Synthetic construct
WIGHAVY

SEQ ID NO: 27750 - protein, 7 aa, Artificial Sequence
  Synthetic construct
WIGHQFF

SEQ ID NO: 27751 - protein, 7 aa, Artificial Sequence
  Synthetic construct
WIGHQFY

SEQ ID NO: 27752 - protein, 7 aa, Artificial Sequence
  Synthetic construct
WIGHQRF

SEQ ID NO: 27753 - protein, 7 aa, Artificial Sequence
  Synthetic construct
WIGHQRY

SEQ ID NO: 27754 - protein, 7 aa, Artificial Sequence
  Synthetic construct
WIGHQCF

SEQ ID NO: 27755 - protein, 7 aa, Artificial Sequence
  Synthetic construct
WIGHQCY

SEQ ID NO: 27756 - protein, 7 aa, Artificial Sequence
  Synthetic construct
WIGHQLF

SEQ ID NO: 27757 - protein, 7 aa, Artificial Sequence
  Synthetic construct
WIGHQLY

SEQ ID NO: 27758 - protein, 7 aa, Artificial Sequence
  Synthetic construct
WIGHQAF

SEQ ID NO: 27759 - protein, 7 aa, Artificial Sequence
  Synthetic construct
WIGHQAY

SEQ ID NO: 27760 - protein, 7 aa, Artificial Sequence
  Synthetic construct
WIGHQQF

SEQ ID NO: 27761 - protein, 7 aa, Artificial Sequence
  Synthetic construct
WIGHQQY

SEQ ID NO: 27762 - protein, 7 aa, Artificial Sequence
  Synthetic construct
WIGHQDF

SEQ ID NO: 27763 - protein, 7 aa, Artificial Sequence
  Synthetic construct
WIGHQDY

SEQ ID NO: 27764 - protein, 7 aa, Artificial Sequence
  Synthetic construct
WIGHQVF

SEQ ID NO: 27765 - protein, 7 aa, Artificial Sequence
  Synthetic construct
WIGHQVY

SEQ ID NO: 27766 - protein, 7 aa, Artificial Sequence
  Synthetic construct
WIGLIFF

SEQ ID NO: 27767 - protein, 7 aa, Artificial Sequence
  Synthetic construct
WIGLIFY

SEQ ID NO: 27768 - protein, 7 aa, Artificial Sequence
  Synthetic construct
WIGLIRF

SEQ ID NO: 27769 - protein, 7 aa, Artificial Sequence
  Synthetic construct
WIGLIRY

SEQ ID NO: 27770 - protein, 7 aa, Artificial Sequence
  Synthetic construct
WIGLICF

SEQ ID NO: 27771 - protein, 7 aa, Artificial Sequence
  Synthetic construct
WIGLICY

SEQ ID NO: 27772 - protein, 7 aa, Artificial Sequence
  Synthetic construct
WIGLILF

SEQ ID NO: 27773 - protein, 7 aa, Artificial Sequence
  Synthetic construct
WIGLILY

SEQ ID NO: 27774 - protein, 7 aa, Artificial Sequence
  Synthetic construct
WIGLIAF

SEQ ID NO: 27775 - protein, 7 aa, Artificial Sequence
  Synthetic construct
WIGLIAY

SEQ ID NO: 27776 - protein, 7 aa, Artificial Sequence
  Synthetic construct
WIGLIQF

SEQ ID NO: 27777 - protein, 7 aa, Artificial Sequence
  Synthetic construct
WIGLIQY

SEQ ID NO: 27778 - protein, 7 aa, Artificial Sequence
  Synthetic construct
WIGLIDF

SEQ ID NO: 27779 - protein, 7 aa, Artificial Sequence
  Synthetic construct
WIGLIDY

SEQ ID NO: 27780 - protein, 7 aa, Artificial Sequence
  Synthetic construct
WIGLIVF

SEQ ID NO: 27781 - protein, 7 aa, Artificial Sequence
  Synthetic construct
WIGLIVY

SEQ ID NO: 27782 - protein, 7 aa, Artificial Sequence
  Synthetic construct
WIGLDFF

SEQ ID NO: 27783 - protein, 7 aa, Artificial Sequence
  Synthetic construct
WIGLDFY

SEQ ID NO: 27784 - protein, 7 aa, Artificial Sequence
  Synthetic construct
WIGLDRF

SEQ ID NO: 27785 - protein, 7 aa, Artificial Sequence
  Synthetic construct
WIGLDRY

SEQ ID NO: 27786 - protein, 7 aa, Artificial Sequence
  Synthetic construct
WIGLDCF

SEQ ID NO: 27787 - protein, 7 aa, Artificial Sequence
  Synthetic construct
WIGLDCY

SEQ ID NO: 27788 - protein, 7 aa, Artificial Sequence
  Synthetic construct
WIGLDLF

SEQ ID NO: 27789 - protein, 7 aa, Artificial Sequence
  Synthetic construct
WIGLDLY

SEQ ID NO: 27790 - protein, 7 aa, Artificial Sequence
  Synthetic construct
WIGLDAF

SEQ ID NO: 27791 - protein, 7 aa, Artificial Sequence
  Synthetic construct
WIGLDAY

SEQ ID NO: 27792 - protein, 7 aa, Artificial Sequence
  Synthetic construct
WIGLDQF

SEQ ID NO: 27793 - protein, 7 aa, Artificial Sequence
  Synthetic construct
WIGLDQY

SEQ ID NO: 27794 - protein, 7 aa, Artificial Sequence
  Synthetic construct
WIGLDDF

SEQ ID NO: 27795 - protein, 7 aa, Artificial Sequence
  Synthetic construct
WIGLDDY

SEQ ID NO: 27796 - protein, 7 aa, Artificial Sequence
  Synthetic construct
WIGLDVF

SEQ ID NO: 27797 - protein, 7 aa, Artificial Sequence
  Synthetic construct
WIGLDVY

SEQ ID NO: 27798 - protein, 7 aa, Artificial Sequence
  Synthetic construct
WIGLYFF

SEQ ID NO: 27799 - protein, 7 aa, Artificial Sequence
  Synthetic construct
WIGLYFY

SEQ ID NO: 27800 - protein, 7 aa, Artificial Sequence
  Synthetic construct
WIGLYRF

SEQ ID NO: 27801 - protein, 7 aa, Artificial Sequence
  Synthetic construct
WIGLYRY

SEQ ID NO: 27802 - protein, 7 aa, Artificial Sequence
  Synthetic construct
WIGLYCF

SEQ ID NO: 27803 - protein, 7 aa, Artificial Sequence
  Synthetic construct
WIGLYCY

SEQ ID NO: 27804 - protein, 7 aa, Artificial Sequence
  Synthetic construct
WIGLYLF

SEQ ID NO: 27805 - protein, 7 aa, Artificial Sequence
  Synthetic construct
WIGLYLY

SEQ ID NO: 27806 - protein, 7 aa, Artificial Sequence
  Synthetic construct
WIGLYAF

SEQ ID NO: 27807 - protein, 7 aa, Artificial Sequence
  Synthetic construct
WIGLYAY

SEQ ID NO: 27808 - protein, 7 aa, Artificial Sequence
  Synthetic construct
WIGLYQF

SEQ ID NO: 27809 - protein, 7 aa, Artificial Sequence
  Synthetic construct
WIGLYQY

SEQ ID NO: 27810 - protein, 7 aa, Artificial Sequence
  Synthetic construct
WIGLYDF

SEQ ID NO: 27811 - protein, 7 aa, Artificial Sequence
  Synthetic construct
WIGLYDY

SEQ ID NO: 27812 - protein, 7 aa, Artificial Sequence
  Synthetic construct
WIGLYVF

SEQ ID NO: 27813 - protein, 7 aa, Artificial Sequence
  Synthetic construct
WIGLYVY

SEQ ID NO: 27814 - protein, 7 aa, Artificial Sequence
  Synthetic construct
WIGLFFF

SEQ ID NO: 27815 - protein, 7 aa, Artificial Sequence
  Synthetic construct
WIGLFFY

SEQ ID NO: 27816 - protein, 7 aa, Artificial Sequence
  Synthetic construct
WIGLFRF

SEQ ID NO: 27817 - protein, 7 aa, Artificial Sequence
  Synthetic construct
WIGLFRY

SEQ ID NO: 27818 - protein, 7 aa, Artificial Sequence
  Synthetic construct
WIGLFCF

SEQ ID NO: 27819 - protein, 7 aa, Artificial Sequence
  Synthetic construct
WIGLFCY

SEQ ID NO: 27820 - protein, 7 aa, Artificial Sequence
  Synthetic construct
WIGLFLF

SEQ ID NO: 27821 - protein, 7 aa, Artificial Sequence
  Synthetic construct
WIGLFLY

SEQ ID NO: 27822 - protein, 7 aa, Artificial Sequence
  Synthetic construct
WIGLFAF

SEQ ID NO: 27823 - protein, 7 aa, Artificial Sequence
  Synthetic construct
WIGLFAY

SEQ ID NO: 27824 - protein, 7 aa, Artificial Sequence
  Synthetic construct
WIGLFQF

SEQ ID NO: 27825 - protein, 7 aa, Artificial Sequence
  Synthetic construct
WIGLFQY

SEQ ID NO: 27826 - protein, 7 aa, Artificial Sequence
  Synthetic construct
WIGLFDF

SEQ ID NO: 27827 - protein, 7 aa, Artificial Sequence
  Synthetic construct
WIGLFDY

SEQ ID NO: 27828 - protein, 7 aa, Artificial Sequence
  Synthetic construct
WIGLFVF

SEQ ID NO: 27829 - protein, 7 aa, Artificial Sequence
  Synthetic construct
WIGLFVY

SEQ ID NO: 27830 - protein, 7 aa, Artificial Sequence
  Synthetic construct
WIGLVFF

SEQ ID NO: 27831 - protein, 7 aa, Artificial Sequence
  Synthetic construct
WIGLVFY

SEQ ID NO: 27832 - protein, 7 aa, Artificial Sequence
  Synthetic construct
WIGLVRF

SEQ ID NO: 27833 - protein, 7 aa, Artificial Sequence
  Synthetic construct
WIGLVRY

SEQ ID NO: 27834 - protein, 7 aa, Artificial Sequence
  Synthetic construct
WIGLVCF

SEQ ID NO: 27835 - protein, 7 aa, Artificial Sequence
  Synthetic construct
WIGLVCY

SEQ ID NO: 27836 - protein, 7 aa, Artificial Sequence
  Synthetic construct
WIGLVLF

SEQ ID NO: 27837 - protein, 7 aa, Artificial Sequence
  Synthetic construct
WIGLVLY

SEQ ID NO: 27838 - protein, 7 aa, Artificial Sequence
  Synthetic construct
WIGLVAF

SEQ ID NO: 27839 - protein, 7 aa, Artificial Sequence
  Synthetic construct
WIGLVAY

SEQ ID NO: 27840 - protein, 7 aa, Artificial Sequence
  Synthetic construct
WIGLVQF

SEQ ID NO: 27841 - protein, 7 aa, Artificial Sequence
  Synthetic construct
WIGLVQY

SEQ ID NO: 27842 - protein, 7 aa, Artificial Sequence
  Synthetic construct
WIGLVDF

SEQ ID NO: 27843 - protein, 7 aa, Artificial Sequence
  Synthetic construct
WIGLVDY

SEQ ID NO: 27844 - protein, 7 aa, Artificial Sequence
  Synthetic construct
WIGLVVF

SEQ ID NO: 27845 - protein, 7 aa, Artificial Sequence
  Synthetic construct
WIGLVVY

SEQ ID NO: 27846 - protein, 7 aa, Artificial Sequence
  Synthetic construct
WIGLTFF

SEQ ID NO: 27847 - protein, 7 aa, Artificial Sequence
  Synthetic construct
WIGLTFY

SEQ ID NO: 27848 - protein, 7 aa, Artificial Sequence
  Synthetic construct
WIGLTRF

SEQ ID NO: 27849 - protein, 7 aa, Artificial Sequence
  Synthetic construct
WIGLTRY

SEQ ID NO: 27850 - protein, 7 aa, Artificial Sequence
  Synthetic construct
WIGLTCF

SEQ ID NO: 27851 - protein, 7 aa, Artificial Sequence
  Synthetic construct
WIGLTCY

SEQ ID NO: 27852 - protein, 7 aa, Artificial Sequence
  Synthetic construct
WIGLTLF

SEQ ID NO: 27853 - protein, 7 aa, Artificial Sequence
  Synthetic construct
WIGLTLY

SEQ ID NO: 27854 - protein, 7 aa, Artificial Sequence
  Synthetic construct
WIGLTAF

SEQ ID NO: 27855 - protein, 7 aa, Artificial Sequence
  Synthetic construct
WIGLTAY

SEQ ID NO: 27856 - protein, 7 aa, Artificial Sequence
  Synthetic construct
WIGLTQF

SEQ ID NO: 27857 - protein, 7 aa, Artificial Sequence
  Synthetic construct
WIGLTQY

SEQ ID NO: 27858 - protein, 7 aa, Artificial Sequence
  Synthetic construct
WIGLTDF

SEQ ID NO: 27859 - protein, 7 aa, Artificial Sequence
  Synthetic construct
WIGLTDY

SEQ ID NO: 27860 - protein, 7 aa, Artificial Sequence
  Synthetic construct
WIGLTVF

SEQ ID NO: 27861 - protein, 7 aa, Artificial Sequence
  Synthetic construct
WIGLTVY

SEQ ID NO: 27862 - protein, 7 aa, Artificial Sequence
  Synthetic construct
WIGLGFF

SEQ ID NO: 27863 - protein, 7 aa, Artificial Sequence
  Synthetic construct
WIGLGFY

SEQ ID NO: 27864 - protein, 7 aa, Artificial Sequence
  Synthetic construct
WIGLGRF

SEQ ID NO: 27865 - protein, 7 aa, Artificial Sequence
  Synthetic construct
WIGLGRY

SEQ ID NO: 27866 - protein, 7 aa, Artificial Sequence
  Synthetic construct
WIGLGCF

SEQ ID NO: 27867 - protein, 7 aa, Artificial Sequence
  Synthetic construct
WIGLGCY

SEQ ID NO: 27868 - protein, 7 aa, Artificial Sequence
  Synthetic construct
WIGLGLF

SEQ ID NO: 27869 - protein, 7 aa, Artificial Sequence
  Synthetic construct
WIGLGLY

SEQ ID NO: 27870 - protein, 7 aa, Artificial Sequence
  Synthetic construct
WIGLGAF

SEQ ID NO: 27871 - protein, 7 aa, Artificial Sequence
  Synthetic construct
WIGLGAY

SEQ ID NO: 27872 - protein, 7 aa, Artificial Sequence
  Synthetic construct
WIGLGQF

SEQ ID NO: 27873 - protein, 7 aa, Artificial Sequence
  Synthetic construct
WIGLGQY

SEQ ID NO: 27874 - protein, 7 aa, Artificial Sequence
  Synthetic construct
WIGLGDF

SEQ ID NO: 27875 - protein, 7 aa, Artificial Sequence
  Synthetic construct
WIGLGDY

SEQ ID NO: 27876 - protein, 7 aa, Artificial Sequence
  Synthetic construct
WIGLGVF

SEQ ID NO: 27877 - protein, 7 aa, Artificial Sequence
  Synthetic construct
WIGLGVY

SEQ ID NO: 27878 - protein, 7 aa, Artificial Sequence
  Synthetic construct
WIGLAFF

SEQ ID NO: 27879 - protein, 7 aa, Artificial Sequence
  Synthetic construct
WIGLAFY

SEQ ID NO: 27880 - protein, 7 aa, Artificial Sequence
  Synthetic construct
WIGLARF

SEQ ID NO: 27881 - protein, 7 aa, Artificial Sequence
  Synthetic construct
WIGLARY

SEQ ID NO: 27882 - protein, 7 aa, Artificial Sequence
  Synthetic construct
WIGLACF

SEQ ID NO: 27883 - protein, 7 aa, Artificial Sequence
  Synthetic construct
WIGLACY

SEQ ID NO: 27884 - protein, 7 aa, Artificial Sequence
  Synthetic construct
WIGLALF

SEQ ID NO: 27885 - protein, 7 aa, Artificial Sequence
  Synthetic construct
WIGLALY

SEQ ID NO: 27886 - protein, 7 aa, Artificial Sequence
  Synthetic construct
WIGLAAF

SEQ ID NO: 27887 - protein, 7 aa, Artificial Sequence
  Synthetic construct
WIGLAAY

SEQ ID NO: 27888 - protein, 7 aa, Artificial Sequence
  Synthetic construct
WIGLAQF

SEQ ID NO: 27889 - protein, 7 aa, Artificial Sequence
  Synthetic construct
WIGLAQY

SEQ ID NO: 27890 - protein, 7 aa, Artificial Sequence
  Synthetic construct
WIGLADF

SEQ ID NO: 27891 - protein, 7 aa, Artificial Sequence
  Synthetic construct
WIGLADY

SEQ ID NO: 27892 - protein, 7 aa, Artificial Sequence
  Synthetic construct
WIGLAVF

SEQ ID NO: 27893 - protein, 7 aa, Artificial Sequence
  Synthetic construct
WIGLAVY

SEQ ID NO: 27894 - protein, 7 aa, Artificial Sequence
  Synthetic construct
WIGLQFF

SEQ ID NO: 27895 - protein, 7 aa, Artificial Sequence
  Synthetic construct
WIGLQFY

SEQ ID NO: 27896 - protein, 7 aa, Artificial Sequence
  Synthetic construct
WIGLQRF

SEQ ID NO: 27897 - protein, 7 aa, Artificial Sequence
  Synthetic construct
WIGLQRY

SEQ ID NO: 27898 - protein, 7 aa, Artificial Sequence
  Synthetic construct
WIGLQCF

SEQ ID NO: 27899 - protein, 7 aa, Artificial Sequence
  Synthetic construct
WIGLQCY

SEQ ID NO: 27900 - protein, 7 aa, Artificial Sequence
  Synthetic construct
WIGLQLF

SEQ ID NO: 27901 - protein, 7 aa, Artificial Sequence
  Synthetic construct
WIGLQLY

SEQ ID NO: 27902 - protein, 7 aa, Artificial Sequence
  Synthetic construct
WIGLQAF

SEQ ID NO: 27903 - protein, 7 aa, Artificial Sequence
  Synthetic construct
WIGLQAY

SEQ ID NO: 27904 - protein, 7 aa, Artificial Sequence
  Synthetic construct
WIGLQQF

SEQ ID NO: 27905 - protein, 7 aa, Artificial Sequence
  Synthetic construct
WIGLQQY

SEQ ID NO: 27906 - protein, 7 aa, Artificial Sequence
  Synthetic construct
WIGLQDF

SEQ ID NO: 27907 - protein, 7 aa, Artificial Sequence
  Synthetic construct
WIGLQDY

SEQ ID NO: 27908 - protein, 7 aa, Artificial Sequence
  Synthetic construct
WIGLQVF

SEQ ID NO: 27909 - protein, 7 aa, Artificial Sequence
  Synthetic construct
WIGLQVY

SEQ ID NO: 27910 - protein, 7 aa, Artificial Sequence
  Synthetic construct
WIGFIFF

SEQ ID NO: 27911 - protein, 7 aa, Artificial Sequence
  Synthetic construct
WIGFIFY

SEQ ID NO: 27912 - protein, 7 aa, Artificial Sequence
  Synthetic construct
WIGFIRF

SEQ ID NO: 27913 - protein, 7 aa, Artificial Sequence
  Synthetic construct
WIGFIRY

SEQ ID NO: 27914 - protein, 7 aa, Artificial Sequence
  Synthetic construct
WIGFICF

SEQ ID NO: 27915 - protein, 7 aa, Artificial Sequence
  Synthetic construct
WIGFICY

SEQ ID NO: 27916 - protein, 7 aa, Artificial Sequence
  Synthetic construct
WIGFILF

SEQ ID NO: 27917 - protein, 7 aa, Artificial Sequence
  Synthetic construct
WIGFILY

SEQ ID NO: 27918 - protein, 7 aa, Artificial Sequence
  Synthetic construct
WIGFIAF

SEQ ID NO: 27919 - protein, 7 aa, Artificial Sequence
  Synthetic construct
WIGFIAY

SEQ ID NO: 27920 - protein, 7 aa, Artificial Sequence
  Synthetic construct
WIGFIQF

SEQ ID NO: 27921 - protein, 7 aa, Artificial Sequence
  Synthetic construct
WIGFIQY

SEQ ID NO: 27922 - protein, 7 aa, Artificial Sequence
  Synthetic construct
WIGFIDF

SEQ ID NO: 27923 - protein, 7 aa, Artificial Sequence
  Synthetic construct
WIGFIDY

SEQ ID NO: 27924 - protein, 7 aa, Artificial Sequence
  Synthetic construct
WIGFIVF

SEQ ID NO: 27925 - protein, 7 aa, Artificial Sequence
  Synthetic construct
WIGFIVY

SEQ ID NO: 27926 - protein, 7 aa, Artificial Sequence
  Synthetic construct
WIGFDFF

SEQ ID NO: 27927 - protein, 7 aa, Artificial Sequence
  Synthetic construct
WIGFDFY

SEQ ID NO: 27928 - protein, 7 aa, Artificial Sequence
  Synthetic construct
WIGFDRF

SEQ ID NO: 27929 - protein, 7 aa, Artificial Sequence
  Synthetic construct
WIGFDRY

SEQ ID NO: 27930 - protein, 7 aa, Artificial Sequence
  Synthetic construct
WIGFDCF

SEQ ID NO: 27931 - protein, 7 aa, Artificial Sequence
  Synthetic construct
WIGFDCY

SEQ ID NO: 27932 - protein, 7 aa, Artificial Sequence
  Synthetic construct
WIGFDLF

SEQ ID NO: 27933 - protein, 7 aa, Artificial Sequence
  Synthetic construct
WIGFDLY

SEQ ID NO: 27934 - protein, 7 aa, Artificial Sequence
  Synthetic construct
WIGFDAF

SEQ ID NO: 27935 - protein, 7 aa, Artificial Sequence
  Synthetic construct
WIGFDAY

SEQ ID NO: 27936 - protein, 7 aa, Artificial Sequence
  Synthetic construct
WIGFDQF

SEQ ID NO: 27937 - protein, 7 aa, Artificial Sequence
  Synthetic construct
WIGFDQY

SEQ ID NO: 27938 - protein, 7 aa, Artificial Sequence
  Synthetic construct
WIGFDDF

SEQ ID NO: 27939 - protein, 7 aa, Artificial Sequence
  Synthetic construct
WIGFDDY

SEQ ID NO: 27940 - protein, 7 aa, Artificial Sequence
  Synthetic construct
WIGFDVF

SEQ ID NO: 27941 - protein, 7 aa, Artificial Sequence
  Synthetic construct
WIGFDVY

SEQ ID NO: 27942 - protein, 7 aa, Artificial Sequence
  Synthetic construct
WIGFYFF

SEQ ID NO: 27943 - protein, 7 aa, Artificial Sequence
  Synthetic construct
WIGFYFY

SEQ ID NO: 27944 - protein, 7 aa, Artificial Sequence
  Synthetic construct
WIGFYRF

SEQ ID NO: 27945 - protein, 7 aa, Artificial Sequence
  Synthetic construct
WIGFYRY

SEQ ID NO: 27946 - protein, 7 aa, Artificial Sequence
  Synthetic construct
WIGFYCF

SEQ ID NO: 27947 - protein, 7 aa, Artificial Sequence
  Synthetic construct
WIGFYCY

SEQ ID NO: 27948 - protein, 7 aa, Artificial Sequence
  Synthetic construct
WIGFYLF

SEQ ID NO: 27949 - protein, 7 aa, Artificial Sequence
  Synthetic construct
WIGFYLY

SEQ ID NO: 27950 - protein, 7 aa, Artificial Sequence
  Synthetic construct
WIGFYAF

SEQ ID NO: 27951 - protein, 7 aa, Artificial Sequence
  Synthetic construct
WIGFYAY

SEQ ID NO: 27952 - protein, 7 aa, Artificial Sequence
  Synthetic construct
WIGFYQF

SEQ ID NO: 27953 - protein, 7 aa, Artificial Sequence
  Synthetic construct
WIGFYQY

SEQ ID NO: 27954 - protein, 7 aa, Artificial Sequence
  Synthetic construct
WIGFYDF

SEQ ID NO: 27955 - protein, 7 aa, Artificial Sequence
  Synthetic construct
WIGFYDY

SEQ ID NO: 27956 - protein, 7 aa, Artificial Sequence
  Synthetic construct
WIGFYVF

SEQ ID NO: 27957 - protein, 7 aa, Artificial Sequence
  Synthetic construct
WIGFYVY

SEQ ID NO: 27958 - protein, 7 aa, Artificial Sequence
  Synthetic construct
WIGFFFF

SEQ ID NO: 27959 - protein, 7 aa, Artificial Sequence
  Synthetic construct
WIGFFFY

SEQ ID NO: 27960 - protein, 7 aa, Artificial Sequence
  Synthetic construct
WIGFFRF

SEQ ID NO: 27961 - protein, 7 aa, Artificial Sequence
  Synthetic construct
WIGFFRY

SEQ ID NO: 27962 - protein, 7 aa, Artificial Sequence
  Synthetic construct
WIGFFCF

SEQ ID NO: 27963 - protein, 7 aa, Artificial Sequence
  Synthetic construct
WIGFFCY

SEQ ID NO: 27964 - protein, 7 aa, Artificial Sequence
  Synthetic construct
WIGFFLF

SEQ ID NO: 27965 - protein, 7 aa, Artificial Sequence
  Synthetic construct
WIGFFLY

SEQ ID NO: 27966 - protein, 7 aa, Artificial Sequence
  Synthetic construct
WIGFFAF

SEQ ID NO: 27967 - protein, 7 aa, Artificial Sequence
  Synthetic construct
WIGFFAY

SEQ ID NO: 27968 - protein, 7 aa, Artificial Sequence
  Synthetic construct
WIGFFQF

SEQ ID NO: 27969 - protein, 7 aa, Artificial Sequence
  Synthetic construct
WIGFFQY

SEQ ID NO: 27970 - protein, 7 aa, Artificial Sequence
  Synthetic construct
WIGFFDF

SEQ ID NO: 27971 - protein, 7 aa, Artificial Sequence
  Synthetic construct
WIGFFDY

SEQ ID NO: 27972 - protein, 7 aa, Artificial Sequence
  Synthetic construct
WIGFFVF

SEQ ID NO: 27973 - protein, 7 aa, Artificial Sequence
  Synthetic construct
WIGFFVY

SEQ ID NO: 27974 - protein, 7 aa, Artificial Sequence
  Synthetic construct
WIGFVFF

SEQ ID NO: 27975 - protein, 7 aa, Artificial Sequence
  Synthetic construct
WIGFVFY

SEQ ID NO: 27976 - protein, 7 aa, Artificial Sequence
  Synthetic construct
WIGFVRF

SEQ ID NO: 27977 - protein, 7 aa, Artificial Sequence
  Synthetic construct
WIGFVRY

SEQ ID NO: 27978 - protein, 7 aa, Artificial Sequence
  Synthetic construct
WIGFVCF

SEQ ID NO: 27979 - protein, 7 aa, Artificial Sequence
  Synthetic construct
WIGFVCY

SEQ ID NO: 27980 - protein, 7 aa, Artificial Sequence
  Synthetic construct
WIGFVLF

SEQ ID NO: 27981 - protein, 7 aa, Artificial Sequence
  Synthetic construct
WIGFVLY

SEQ ID NO: 27982 - protein, 7 aa, Artificial Sequence
  Synthetic construct
WIGFVAF

SEQ ID NO: 27983 - protein, 7 aa, Artificial Sequence
  Synthetic construct
WIGFVAY

SEQ ID NO: 27984 - protein, 7 aa, Artificial Sequence
  Synthetic construct
WIGFVQF

SEQ ID NO: 27985 - protein, 7 aa, Artificial Sequence
  Synthetic construct
WIGFVQY

SEQ ID NO: 27986 - protein, 7 aa, Artificial Sequence
  Synthetic construct
WIGFVDF

SEQ ID NO: 27987 - protein, 7 aa, Artificial Sequence
  Synthetic construct
WIGFVDY

SEQ ID NO: 27988 - protein, 7 aa, Artificial Sequence
  Synthetic construct
WIGFVVF

SEQ ID NO: 27989 - protein, 7 aa, Artificial Sequence
  Synthetic construct
WIGFVVY

SEQ ID NO: 27990 - protein, 7 aa, Artificial Sequence
  Synthetic construct
WIGFTFF

SEQ ID NO: 27991 - protein, 7 aa, Artificial Sequence
  Synthetic construct
WIGFTFY

SEQ ID NO: 27992 - protein, 7 aa, Artificial Sequence
  Synthetic construct
WIGFTRF

SEQ ID NO: 27993 - protein, 7 aa, Artificial Sequence
  Synthetic construct
WIGFTRY

SEQ ID NO: 27994 - protein, 7 aa, Artificial Sequence
  Synthetic construct
WIGFTCF

SEQ ID NO: 27995 - protein, 7 aa, Artificial Sequence
  Synthetic construct
WIGFTCY

SEQ ID NO: 27996 - protein, 7 aa, Artificial Sequence
  Synthetic construct
WIGFTLF

SEQ ID NO: 27997 - protein, 7 aa, Artificial Sequence
  Synthetic construct
WIGFTLY

SEQ ID NO: 27998 - protein, 7 aa, Artificial Sequence
  Synthetic construct
WIGFTAF

SEQ ID NO: 27999 - protein, 7 aa, Artificial Sequence
  Synthetic construct
WIGFTAY

SEQ ID NO: 28000 - protein, 7 aa, Artificial Sequence
  Synthetic construct
WIGFTQF

SEQ ID NO: 28001 - protein, 7 aa, Artificial Sequence
  Synthetic construct
WIGFTQY

SEQ ID NO: 28002 - protein, 7 aa, Artificial Sequence
  Synthetic construct
WIGFTDF

SEQ ID NO: 28003 - protein, 7 aa, Artificial Sequence
  Synthetic construct
WIGFTDY

SEQ ID NO: 28004 - protein, 7 aa, Artificial Sequence
  Synthetic construct
WIGFTVF

SEQ ID NO: 28005 - protein, 7 aa, Artificial Sequence
  Synthetic construct
WIGFTVY

SEQ ID NO: 28006 - protein, 7 aa, Artificial Sequence
  Synthetic construct
WIGFGFF

SEQ ID NO: 28007 - protein, 7 aa, Artificial Sequence
  Synthetic construct
WIGFGFY

SEQ ID NO: 28008 - protein, 7 aa, Artificial Sequence
  Synthetic construct
WIGFGRF

SEQ ID NO: 28009 - protein, 7 aa, Artificial Sequence
  Synthetic construct
WIGFGRY

SEQ ID NO: 28010 - protein, 7 aa, Artificial Sequence
  Synthetic construct
WIGFGCF

SEQ ID NO: 28011 - protein, 7 aa, Artificial Sequence
  Synthetic construct
WIGFGCY

SEQ ID NO: 28012 - protein, 7 aa, Artificial Sequence
  Synthetic construct
WIGFGLF

SEQ ID NO: 28013 - protein, 7 aa, Artificial Sequence
  Synthetic construct
WIGFGLY

SEQ ID NO: 28014 - protein, 7 aa, Artificial Sequence
  Synthetic construct
WIGFGAF

SEQ ID NO: 28015 - protein, 7 aa, Artificial Sequence
  Synthetic construct
WIGFGAY

SEQ ID NO: 28016 - protein, 7 aa, Artificial Sequence
  Synthetic construct
WIGFGQF

SEQ ID NO: 28017 - protein, 7 aa, Artificial Sequence
  Synthetic construct
WIGFGQY

SEQ ID NO: 28018 - protein, 7 aa, Artificial Sequence
  Synthetic construct
WIGFGDF

SEQ ID NO: 28019 - protein, 7 aa, Artificial Sequence
  Synthetic construct
WIGFGDY

SEQ ID NO: 28020 - protein, 7 aa, Artificial Sequence
  Synthetic construct
WIGFGVF

SEQ ID NO: 28021 - protein, 7 aa, Artificial Sequence
  Synthetic construct
WIGFGVY

SEQ ID NO: 28022 - protein, 7 aa, Artificial Sequence
  Synthetic construct
WIGFAFF

SEQ ID NO: 28023 - protein, 7 aa, Artificial Sequence
  Synthetic construct
WIGFAFY

SEQ ID NO: 28024 - protein, 7 aa, Artificial Sequence
  Synthetic construct
WIGFARF

SEQ ID NO: 28025 - protein, 7 aa, Artificial Sequence
  Synthetic construct
WIGFARY

SEQ ID NO: 28026 - protein, 7 aa, Artificial Sequence
  Synthetic construct
WIGFACF

SEQ ID NO: 28027 - protein, 7 aa, Artificial Sequence
  Synthetic construct
WIGFACY

SEQ ID NO: 28028 - protein, 7 aa, Artificial Sequence
  Synthetic construct
WIGFALF

SEQ ID NO: 28029 - protein, 7 aa, Artificial Sequence
  Synthetic construct
WIGFALY

SEQ ID NO: 28030 - protein, 7 aa, Artificial Sequence
  Synthetic construct
WIGFAAF

SEQ ID NO: 28031 - protein, 7 aa, Artificial Sequence
  Synthetic construct
WIGFAAY

SEQ ID NO: 28032 - protein, 7 aa, Artificial Sequence
  Synthetic construct
WIGFAQF

SEQ ID NO: 28033 - protein, 7 aa, Artificial Sequence
  Synthetic construct
WIGFAQY

SEQ ID NO: 28034 - protein, 7 aa, Artificial Sequence
  Synthetic construct
WIGFADF

SEQ ID NO: 28035 - protein, 7 aa, Artificial Sequence
  Synthetic construct
WIGFADY

SEQ ID NO: 28036 - protein, 7 aa, Artificial Sequence
  Synthetic construct
WIGFAVF

SEQ ID NO: 28037 - protein, 7 aa, Artificial Sequence
  Synthetic construct
WIGFAVY

SEQ ID NO: 28038 - protein, 7 aa, Artificial Sequence
  Synthetic construct
WIGFQFF

SEQ ID NO: 28039 - protein, 7 aa, Artificial Sequence
  Synthetic construct
WIGFQFY

SEQ ID NO: 28040 - protein, 7 aa, Artificial Sequence
  Synthetic construct
WIGFQRF

SEQ ID NO: 28041 - protein, 7 aa, Artificial Sequence
  Synthetic construct
WIGFQRY

SEQ ID NO: 28042 - protein, 7 aa, Artificial Sequence
  Synthetic construct
WIGFQCF

SEQ ID NO: 28043 - protein, 7 aa, Artificial Sequence
  Synthetic construct
WIGFQCY

SEQ ID NO: 28044 - protein, 7 aa, Artificial Sequence
  Synthetic construct
WIGFQLF

SEQ ID NO: 28045 - protein, 7 aa, Artificial Sequence
  Synthetic construct
WIGFQLY

SEQ ID NO: 28046 - protein, 7 aa, Artificial Sequence
  Synthetic construct
WIGFQAF

SEQ ID NO: 28047 - protein, 7 aa, Artificial Sequence
  Synthetic construct
WIGFQAY

SEQ ID NO: 28048 - protein, 7 aa, Artificial Sequence
  Synthetic construct
WIGFQQF

SEQ ID NO: 28049 - protein, 7 aa, Artificial Sequence
  Synthetic construct
WIGFQQY

SEQ ID NO: 28050 - protein, 7 aa, Artificial Sequence
  Synthetic construct
WIGFQDF

SEQ ID NO: 28051 - protein, 7 aa, Artificial Sequence
  Synthetic construct
WIGFQDY

SEQ ID NO: 28052 - protein, 7 aa, Artificial Sequence
  Synthetic construct
WIGFQVF

SEQ ID NO: 28053 - protein, 7 aa, Artificial Sequence
  Synthetic construct
WIGFQVY

SEQ ID NO: 28054 - protein, 7 aa, Artificial Sequence
  Synthetic construct
WFIYIFF

SEQ ID NO: 28055 - protein, 7 aa, Artificial Sequence
  Synthetic construct
WFIYIFY

SEQ ID NO: 28056 - protein, 7 aa, Artificial Sequence
  Synthetic construct
WFIYIRF

SEQ ID NO: 28057 - protein, 7 aa, Artificial Sequence
  Synthetic construct
WFIYIRY

SEQ ID NO: 28058 - protein, 7 aa, Artificial Sequence
  Synthetic construct
WFIYICF

SEQ ID NO: 28059 - protein, 7 aa, Artificial Sequence
  Synthetic construct
WFIYICY

SEQ ID NO: 28060 - protein, 7 aa, Artificial Sequence
  Synthetic construct
WFIYILF

SEQ ID NO: 28061 - protein, 7 aa, Artificial Sequence
  Synthetic construct
WFIYILY

SEQ ID NO: 28062 - protein, 7 aa, Artificial Sequence
  Synthetic construct
WFIYIAF

SEQ ID NO: 28063 - protein, 7 aa, Artificial Sequence
  Synthetic construct
WFIYIAY

SEQ ID NO: 28064 - protein, 7 aa, Artificial Sequence
  Synthetic construct
WFIYIQF

SEQ ID NO: 28065 - protein, 7 aa, Artificial Sequence
  Synthetic construct
WFIYIQY

SEQ ID NO: 28066 - protein, 7 aa, Artificial Sequence
  Synthetic construct
WFIYIDF

SEQ ID NO: 28067 - protein, 7 aa, Artificial Sequence
  Synthetic construct
WFIYIDY

SEQ ID NO: 28068 - protein, 7 aa, Artificial Sequence
  Synthetic construct
WFIYIVF

SEQ ID NO: 28069 - protein, 7 aa, Artificial Sequence
  Synthetic construct
WFIYIVY

SEQ ID NO: 28070 - protein, 7 aa, Artificial Sequence
  Synthetic construct
WFIYDFF

SEQ ID NO: 28071 - protein, 7 aa, Artificial Sequence
  Synthetic construct
WFIYDFY

SEQ ID NO: 28072 - protein, 7 aa, Artificial Sequence
  Synthetic construct
WFIYDRF

SEQ ID NO: 28073 - protein, 7 aa, Artificial Sequence
  Synthetic construct
WFIYDRY

SEQ ID NO: 28074 - protein, 7 aa, Artificial Sequence
  Synthetic construct
WFIYDCF

SEQ ID NO: 28075 - protein, 7 aa, Artificial Sequence
  Synthetic construct
WFIYDCY

SEQ ID NO: 28076 - protein, 7 aa, Artificial Sequence
  Synthetic construct
WFIYDLF

SEQ ID NO: 28077 - protein, 7 aa, Artificial Sequence
  Synthetic construct
WFIYDLY

SEQ ID NO: 28078 - protein, 7 aa, Artificial Sequence
  Synthetic construct
WFIYDAF

SEQ ID NO: 28079 - protein, 7 aa, Artificial Sequence
  Synthetic construct
WFIYDAY

SEQ ID NO: 28080 - protein, 7 aa, Artificial Sequence
  Synthetic construct
WFIYDQF

SEQ ID NO: 28081 - protein, 7 aa, Artificial Sequence
  Synthetic construct
WFIYDQY

SEQ ID NO: 28082 - protein, 7 aa, Artificial Sequence
  Synthetic construct
WFIYDDF

SEQ ID NO: 28083 - protein, 7 aa, Artificial Sequence
  Synthetic construct
WFIYDDY

SEQ ID NO: 28084 - protein, 7 aa, Artificial Sequence
  Synthetic construct
WFIYDVF

SEQ ID NO: 28085 - protein, 7 aa, Artificial Sequence
  Synthetic construct
WFIYDVY

SEQ ID NO: 28086 - protein, 7 aa, Artificial Sequence
  Synthetic construct
WFIYYFF

SEQ ID NO: 28087 - protein, 7 aa, Artificial Sequence
  Synthetic construct
WFIYYFY

SEQ ID NO: 28088 - protein, 7 aa, Artificial Sequence
  Synthetic construct
WFIYYRF

SEQ ID NO: 28089 - protein, 7 aa, Artificial Sequence
  Synthetic construct
WFIYYRY

SEQ ID NO: 28090 - protein, 7 aa, Artificial Sequence
  Synthetic construct
WFIYYCF

SEQ ID NO: 28091 - protein, 7 aa, Artificial Sequence
  Synthetic construct
WFIYYCY

SEQ ID NO: 28092 - protein, 7 aa, Artificial Sequence
  Synthetic construct
WFIYYLF

SEQ ID NO: 28093 - protein, 7 aa, Artificial Sequence
  Synthetic construct
WFIYYLY

SEQ ID NO: 28094 - protein, 7 aa, Artificial Sequence
  Synthetic construct
WFIYYAF

SEQ ID NO: 28095 - protein, 7 aa, Artificial Sequence
  Synthetic construct
WFIYYAY

SEQ ID NO: 28096 - protein, 7 aa, Artificial Sequence
  Synthetic construct
WFIYYQF

SEQ ID NO: 28097 - protein, 7 aa, Artificial Sequence
  Synthetic construct
WFIYYQY

SEQ ID NO: 28098 - protein, 7 aa, Artificial Sequence
  Synthetic construct
WFIYYDF

SEQ ID NO: 28099 - protein, 7 aa, Artificial Sequence
  Synthetic construct
WFIYYDY

SEQ ID NO: 28100 - protein, 7 aa, Artificial Sequence
  Synthetic construct
WFIYYVF

SEQ ID NO: 28101 - protein, 7 aa, Artificial Sequence
  Synthetic construct
WFIYYVY

SEQ ID NO: 28102 - protein, 7 aa, Artificial Sequence
  Synthetic construct
WFIYFFF

SEQ ID NO: 28103 - protein, 7 aa, Artificial Sequence
  Synthetic construct
WFIYFFY

SEQ ID NO: 28104 - protein, 7 aa, Artificial Sequence
  Synthetic construct
WFIYFRF

SEQ ID NO: 28105 - protein, 7 aa, Artificial Sequence
  Synthetic construct
WFIYFRY

SEQ ID NO: 28106 - protein, 7 aa, Artificial Sequence
  Synthetic construct
WFIYFCF

SEQ ID NO: 28107 - protein, 7 aa, Artificial Sequence
  Synthetic construct
WFIYFCY

SEQ ID NO: 28108 - protein, 7 aa, Artificial Sequence
  Synthetic construct
WFIYFLF

SEQ ID NO: 28109 - protein, 7 aa, Artificial Sequence
  Synthetic construct
WFIYFLY

SEQ ID NO: 28110 - protein, 7 aa, Artificial Sequence
  Synthetic construct
WFIYFAF

SEQ ID NO: 28111 - protein, 7 aa, Artificial Sequence
  Synthetic construct
WFIYFAY

SEQ ID NO: 28112 - protein, 7 aa, Artificial Sequence
  Synthetic construct
WFIYFQF

SEQ ID NO: 28113 - protein, 7 aa, Artificial Sequence
  Synthetic construct
WFIYFQY

SEQ ID NO: 28114 - protein, 7 aa, Artificial Sequence
  Synthetic construct
WFIYFDF

SEQ ID NO: 28115 - protein, 7 aa, Artificial Sequence
  Synthetic construct
WFIYFDY

SEQ ID NO: 28116 - protein, 7 aa, Artificial Sequence
  Synthetic construct
WFIYFVF

SEQ ID NO: 28117 - protein, 7 aa, Artificial Sequence
  Synthetic construct
WFIYFVY

SEQ ID NO: 28118 - protein, 7 aa, Artificial Sequence
  Synthetic construct
WFIYVFF

SEQ ID NO: 28119 - protein, 7 aa, Artificial Sequence
  Synthetic construct
WFIYVFY

SEQ ID NO: 28120 - protein, 7 aa, Artificial Sequence
  Synthetic construct
WFIYVRF

SEQ ID NO: 28121 - protein, 7 aa, Artificial Sequence
  Synthetic construct
WFIYVRY

SEQ ID NO: 28122 - protein, 7 aa, Artificial Sequence
  Synthetic construct
WFIYVCF

SEQ ID NO: 28123 - protein, 7 aa, Artificial Sequence
  Synthetic construct
WFIYVCY

SEQ ID NO: 28124 - protein, 7 aa, Artificial Sequence
  Synthetic construct
WFIYVLF

SEQ ID NO: 28125 - protein, 7 aa, Artificial Sequence
  Synthetic construct
WFIYVLY

SEQ ID NO: 28126 - protein, 7 aa, Artificial Sequence
  Synthetic construct
WFIYVAF

SEQ ID NO: 28127 - protein, 7 aa, Artificial Sequence
  Synthetic construct
WFIYVAY

SEQ ID NO: 28128 - protein, 7 aa, Artificial Sequence
  Synthetic construct
WFIYVQF

SEQ ID NO: 28129 - protein, 7 aa, Artificial Sequence
  Synthetic construct
WFIYVQY

SEQ ID NO: 28130 - protein, 7 aa, Artificial Sequence
  Synthetic construct
WFIYVDF

SEQ ID NO: 28131 - protein, 7 aa, Artificial Sequence
  Synthetic construct
WFIYVDY

SEQ ID NO: 28132 - protein, 7 aa, Artificial Sequence
  Synthetic construct
WFIYVVF

SEQ ID NO: 28133 - protein, 7 aa, Artificial Sequence
  Synthetic construct
WFIYVVY

SEQ ID NO: 28134 - protein, 7 aa, Artificial Sequence
  Synthetic construct
WFIYTFF

SEQ ID NO: 28135 - protein, 7 aa, Artificial Sequence
  Synthetic construct
WFIYTFY

SEQ ID NO: 28136 - protein, 7 aa, Artificial Sequence
  Synthetic construct
WFIYTRF

SEQ ID NO: 28137 - protein, 7 aa, Artificial Sequence
  Synthetic construct
WFIYTRY

SEQ ID NO: 28138 - protein, 7 aa, Artificial Sequence
  Synthetic construct
WFIYTCF

SEQ ID NO: 28139 - protein, 7 aa, Artificial Sequence
  Synthetic construct
WFIYTCY

SEQ ID NO: 28140 - protein, 7 aa, Artificial Sequence
  Synthetic construct
WFIYTLF

SEQ ID NO: 28141 - protein, 7 aa, Artificial Sequence
  Synthetic construct
WFIYTLY

SEQ ID NO: 28142 - protein, 7 aa, Artificial Sequence
  Synthetic construct
WFIYTAF

SEQ ID NO: 28143 - protein, 7 aa, Artificial Sequence
  Synthetic construct
WFIYTAY

SEQ ID NO: 28144 - protein, 7 aa, Artificial Sequence
  Synthetic construct
WFIYTQF

SEQ ID NO: 28145 - protein, 7 aa, Artificial Sequence
  Synthetic construct
WFIYTQY

SEQ ID NO: 28146 - protein, 7 aa, Artificial Sequence
  Synthetic construct
WFIYTDF

SEQ ID NO: 28147 - protein, 7 aa, Artificial Sequence
  Synthetic construct
WFIYTDY

SEQ ID NO: 28148 - protein, 7 aa, Artificial Sequence
  Synthetic construct
WFIYTVF

SEQ ID NO: 28149 - protein, 7 aa, Artificial Sequence
  Synthetic construct
WFIYTVY

SEQ ID NO: 28150 - protein, 7 aa, Artificial Sequence
  Synthetic construct
WFIYGFF

SEQ ID NO: 28151 - protein, 7 aa, Artificial Sequence
  Synthetic construct
WFIYGFY

SEQ ID NO: 28152 - protein, 7 aa, Artificial Sequence
  Synthetic construct
WFIYGRF

SEQ ID NO: 28153 - protein, 7 aa, Artificial Sequence
  Synthetic construct
WFIYGRY

SEQ ID NO: 28154 - protein, 7 aa, Artificial Sequence
  Synthetic construct
WFIYGCF

SEQ ID NO: 28155 - protein, 7 aa, Artificial Sequence
  Synthetic construct
WFIYGCY

SEQ ID NO: 28156 - protein, 7 aa, Artificial Sequence
  Synthetic construct
WFIYGLF

SEQ ID NO: 28157 - protein, 7 aa, Artificial Sequence
  Synthetic construct
WFIYGLY

SEQ ID NO: 28158 - protein, 7 aa, Artificial Sequence
  Synthetic construct
WFIYGAF

SEQ ID NO: 28159 - protein, 7 aa, Artificial Sequence
  Synthetic construct
WFIYGAY

SEQ ID NO: 28160 - protein, 7 aa, Artificial Sequence
  Synthetic construct
WFIYGQF

SEQ ID NO: 28161 - protein, 7 aa, Artificial Sequence
  Synthetic construct
WFIYGQY

SEQ ID NO: 28162 - protein, 7 aa, Artificial Sequence
  Synthetic construct
WFIYGDF

SEQ ID NO: 28163 - protein, 7 aa, Artificial Sequence
  Synthetic construct
WFIYGDY

SEQ ID NO: 28164 - protein, 7 aa, Artificial Sequence
  Synthetic construct
WFIYGVF

SEQ ID NO: 28165 - protein, 7 aa, Artificial Sequence
  Synthetic construct
WFIYGVY

SEQ ID NO: 28166 - protein, 7 aa, Artificial Sequence
  Synthetic construct
WFIYAFF

SEQ ID NO: 28167 - protein, 7 aa, Artificial Sequence
  Synthetic construct
WFIYAFY

SEQ ID NO: 28168 - protein, 7 aa, Artificial Sequence
  Synthetic construct
WFIYARF

SEQ ID NO: 28169 - protein, 7 aa, Artificial Sequence
  Synthetic construct
WFIYARY

SEQ ID NO: 28170 - protein, 7 aa, Artificial Sequence
  Synthetic construct
WFIYACF

SEQ ID NO: 28171 - protein, 7 aa, Artificial Sequence
  Synthetic construct
WFIYACY

SEQ ID NO: 28172 - protein, 7 aa, Artificial Sequence
  Synthetic construct
WFIYALF

SEQ ID NO: 28173 - protein, 7 aa, Artificial Sequence
  Synthetic construct
WFIYALY

SEQ ID NO: 28174 - protein, 7 aa, Artificial Sequence
  Synthetic construct
WFIYAAF

SEQ ID NO: 28175 - protein, 7 aa, Artificial Sequence
  Synthetic construct
WFIYAAY

SEQ ID NO: 28176 - protein, 7 aa, Artificial Sequence
  Synthetic construct
WFIYAQF

SEQ ID NO: 28177 - protein, 7 aa, Artificial Sequence
  Synthetic construct
WFIYAQY

SEQ ID NO: 28178 - protein, 7 aa, Artificial Sequence
  Synthetic construct
WFIYADF

SEQ ID NO: 28179 - protein, 7 aa, Artificial Sequence
  Synthetic construct
WFIYADY

SEQ ID NO: 28180 - protein, 7 aa, Artificial Sequence
  Synthetic construct
WFIYAVF

SEQ ID NO: 28181 - protein, 7 aa, Artificial Sequence
  Synthetic construct
WFIYAVY

SEQ ID NO: 28182 - protein, 7 aa, Artificial Sequence
  Synthetic construct
WFIYQFF

SEQ ID NO: 28183 - protein, 7 aa, Artificial Sequence
  Synthetic construct
WFIYQFY

SEQ ID NO: 28184 - protein, 7 aa, Artificial Sequence
  Synthetic construct
WFIYQRF

SEQ ID NO: 28185 - protein, 7 aa, Artificial Sequence
  Synthetic construct
WFIYQRY

SEQ ID NO: 28186 - protein, 7 aa, Artificial Sequence
  Synthetic construct
WFIYQCF

SEQ ID NO: 28187 - protein, 7 aa, Artificial Sequence
  Synthetic construct
WFIYQCY

SEQ ID NO: 28188 - protein, 7 aa, Artificial Sequence
  Synthetic construct
WFIYQLF

SEQ ID NO: 28189 - protein, 7 aa, Artificial Sequence
  Synthetic construct
WFIYQLY

SEQ ID NO: 28190 - protein, 7 aa, Artificial Sequence
  Synthetic construct
WFIYQAF

SEQ ID NO: 28191 - protein, 7 aa, Artificial Sequence
  Synthetic construct
WFIYQAY

SEQ ID NO: 28192 - protein, 7 aa, Artificial Sequence
  Synthetic construct
WFIYQQF

SEQ ID NO: 28193 - protein, 7 aa, Artificial Sequence
  Synthetic construct
WFIYQQY

SEQ ID NO: 28194 - protein, 7 aa, Artificial Sequence
  Synthetic construct
WFIYQDF

SEQ ID NO: 28195 - protein, 7 aa, Artificial Sequence
  Synthetic construct
WFIYQDY

SEQ ID NO: 28196 - protein, 7 aa, Artificial Sequence
  Synthetic construct
WFIYQVF

SEQ ID NO: 28197 - protein, 7 aa, Artificial Sequence
  Synthetic construct
WFIYQVY

SEQ ID NO: 28198 - protein, 7 aa, Artificial Sequence
  Synthetic construct
WFIPIFF

SEQ ID NO: 28199 - protein, 7 aa, Artificial Sequence
  Synthetic construct
WFIPIFY

SEQ ID NO: 28200 - protein, 7 aa, Artificial Sequence
  Synthetic construct
WFIPIRF

SEQ ID NO: 28201 - protein, 7 aa, Artificial Sequence
  Synthetic construct
WFIPIRY

SEQ ID NO: 28202 - protein, 7 aa, Artificial Sequence
  Synthetic construct
WFIPICF

SEQ ID NO: 28203 - protein, 7 aa, Artificial Sequence
  Synthetic construct
WFIPICY

SEQ ID NO: 28204 - protein, 7 aa, Artificial Sequence
  Synthetic construct
WFIPILF

SEQ ID NO: 28205 - protein, 7 aa, Artificial Sequence
  Synthetic construct
WFIPILY

SEQ ID NO: 28206 - protein, 7 aa, Artificial Sequence
  Synthetic construct
WFIPIAF

SEQ ID NO: 28207 - protein, 7 aa, Artificial Sequence
  Synthetic construct
WFIPIAY

SEQ ID NO: 28208 - protein, 7 aa, Artificial Sequence
  Synthetic construct
WFIPIQF

SEQ ID NO: 28209 - protein, 7 aa, Artificial Sequence
  Synthetic construct
WFIPIQY

SEQ ID NO: 28210 - protein, 7 aa, Artificial Sequence
  Synthetic construct
WFIPIDF

SEQ ID NO: 28211 - protein, 7 aa, Artificial Sequence
  Synthetic construct
WFIPIDY

SEQ ID NO: 28212 - protein, 7 aa, Artificial Sequence
  Synthetic construct
WFIPIVF

SEQ ID NO: 28213 - protein, 7 aa, Artificial Sequence
  Synthetic construct
WFIPIVY

SEQ ID NO: 28214 - protein, 7 aa, Artificial Sequence
  Synthetic construct
WFIPDFF

SEQ ID NO: 28215 - protein, 7 aa, Artificial Sequence
  Synthetic construct
WFIPDFY

SEQ ID NO: 28216 - protein, 7 aa, Artificial Sequence
  Synthetic construct
WFIPDRF

SEQ ID NO: 28217 - protein, 7 aa, Artificial Sequence
  Synthetic construct
WFIPDRY

SEQ ID NO: 28218 - protein, 7 aa, Artificial Sequence
  Synthetic construct
WFIPDCF

SEQ ID NO: 28219 - protein, 7 aa, Artificial Sequence
  Synthetic construct
WFIPDCY

SEQ ID NO: 28220 - protein, 7 aa, Artificial Sequence
  Synthetic construct
WFIPDLF

SEQ ID NO: 28221 - protein, 7 aa, Artificial Sequence
  Synthetic construct
WFIPDLY

SEQ ID NO: 28222 - protein, 7 aa, Artificial Sequence
  Synthetic construct
WFIPDAF

SEQ ID NO: 28223 - protein, 7 aa, Artificial Sequence
  Synthetic construct
WFIPDAY

SEQ ID NO: 28224 - protein, 7 aa, Artificial Sequence
  Synthetic construct
WFIPDQF

SEQ ID NO: 28225 - protein, 7 aa, Artificial Sequence
  Synthetic construct
WFIPDQY

SEQ ID NO: 28226 - protein, 7 aa, Artificial Sequence
  Synthetic construct
WFIPDDF

SEQ ID NO: 28227 - protein, 7 aa, Artificial Sequence
  Synthetic construct
WFIPDDY

SEQ ID NO: 28228 - protein, 7 aa, Artificial Sequence
  Synthetic construct
WFIPDVF

SEQ ID NO: 28229 - protein, 7 aa, Artificial Sequence
  Synthetic construct
WFIPDVY

SEQ ID NO: 28230 - protein, 7 aa, Artificial Sequence
  Synthetic construct
WFIPYFF

SEQ ID NO: 28231 - protein, 7 aa, Artificial Sequence
  Synthetic construct
WFIPYFY

SEQ ID NO: 28232 - protein, 7 aa, Artificial Sequence
  Synthetic construct
WFIPYRF

SEQ ID NO: 28233 - protein, 7 aa, Artificial Sequence
  Synthetic construct
WFIPYRY

SEQ ID NO: 28234 - protein, 7 aa, Artificial Sequence
  Synthetic construct
WFIPYCF

SEQ ID NO: 28235 - protein, 7 aa, Artificial Sequence
  Synthetic construct
WFIPYCY

SEQ ID NO: 28236 - protein, 7 aa, Artificial Sequence
  Synthetic construct
WFIPYLF

SEQ ID NO: 28237 - protein, 7 aa, Artificial Sequence
  Synthetic construct
WFIPYLY

SEQ ID NO: 28238 - protein, 7 aa, Artificial Sequence
  Synthetic construct
WFIPYAF

SEQ ID NO: 28239 - protein, 7 aa, Artificial Sequence
  Synthetic construct
WFIPYAY

SEQ ID NO: 28240 - protein, 7 aa, Artificial Sequence
  Synthetic construct
WFIPYQF

SEQ ID NO: 28241 - protein, 7 aa, Artificial Sequence
  Synthetic construct
WFIPYQY

SEQ ID NO: 28242 - protein, 7 aa, Artificial Sequence
  Synthetic construct
WFIPYDF

SEQ ID NO: 28243 - protein, 7 aa, Artificial Sequence
  Synthetic construct
WFIPYDY

SEQ ID NO: 28244 - protein, 7 aa, Artificial Sequence
  Synthetic construct
WFIPYVF

SEQ ID NO: 28245 - protein, 7 aa, Artificial Sequence
  Synthetic construct
WFIPYVY

SEQ ID NO: 28246 - protein, 7 aa, Artificial Sequence
  Synthetic construct
WFIPFFF

SEQ ID NO: 28247 - protein, 7 aa, Artificial Sequence
  Synthetic construct
WFIPFFY

SEQ ID NO: 28248 - protein, 7 aa, Artificial Sequence
  Synthetic construct
WFIPFRF

SEQ ID NO: 28249 - protein, 7 aa, Artificial Sequence
  Synthetic construct
WFIPFRY

SEQ ID NO: 28250 - protein, 7 aa, Artificial Sequence
  Synthetic construct
WFIPFCF

SEQ ID NO: 28251 - protein, 7 aa, Artificial Sequence
  Synthetic construct
WFIPFCY

SEQ ID NO: 28252 - protein, 7 aa, Artificial Sequence
  Synthetic construct
WFIPFLF

SEQ ID NO: 28253 - protein, 7 aa, Artificial Sequence
  Synthetic construct
WFIPFLY

SEQ ID NO: 28254 - protein, 7 aa, Artificial Sequence
  Synthetic construct
WFIPFAF

SEQ ID NO: 28255 - protein, 7 aa, Artificial Sequence
  Synthetic construct
WFIPFAY

SEQ ID NO: 28256 - protein, 7 aa, Artificial Sequence
  Synthetic construct
WFIPFQF

SEQ ID NO: 28257 - protein, 7 aa, Artificial Sequence
  Synthetic construct
WFIPFQY

SEQ ID NO: 28258 - protein, 7 aa, Artificial Sequence
  Synthetic construct
WFIPFDF

SEQ ID NO: 28259 - protein, 7 aa, Artificial Sequence
  Synthetic construct
WFIPFDY

SEQ ID NO: 28260 - protein, 7 aa, Artificial Sequence
  Synthetic construct
WFIPFVF

SEQ ID NO: 28261 - protein, 7 aa, Artificial Sequence
  Synthetic construct
WFIPFVY

SEQ ID NO: 28262 - protein, 7 aa, Artificial Sequence
  Synthetic construct
WFIPVFF

SEQ ID NO: 28263 - protein, 7 aa, Artificial Sequence
  Synthetic construct
WFIPVFY

SEQ ID NO: 28264 - protein, 7 aa, Artificial Sequence
  Synthetic construct
WFIPVRF

SEQ ID NO: 28265 - protein, 7 aa, Artificial Sequence
  Synthetic construct
WFIPVRY

SEQ ID NO: 28266 - protein, 7 aa, Artificial Sequence
  Synthetic construct
WFIPVCF

SEQ ID NO: 28267 - protein, 7 aa, Artificial Sequence
  Synthetic construct
WFIPVCY

SEQ ID NO: 28268 - protein, 7 aa, Artificial Sequence
  Synthetic construct
WFIPVLF

SEQ ID NO: 28269 - protein, 7 aa, Artificial Sequence
  Synthetic construct
WFIPVLY

SEQ ID NO: 28270 - protein, 7 aa, Artificial Sequence
  Synthetic construct
WFIPVAF

SEQ ID NO: 28271 - protein, 7 aa, Artificial Sequence
  Synthetic construct
WFIPVAY

SEQ ID NO: 28272 - protein, 7 aa, Artificial Sequence
  Synthetic construct
WFIPVQF

SEQ ID NO: 28273 - protein, 7 aa, Artificial Sequence
  Synthetic construct
WFIPVQY

SEQ ID NO: 28274 - protein, 7 aa, Artificial Sequence
  Synthetic construct
WFIPVDF

SEQ ID NO: 28275 - protein, 7 aa, Artificial Sequence
  Synthetic construct
WFIPVDY

SEQ ID NO: 28276 - protein, 7 aa, Artificial Sequence
  Synthetic construct
WFIPVVF

SEQ ID NO: 28277 - protein, 7 aa, Artificial Sequence
  Synthetic construct
WFIPVVY

SEQ ID NO: 28278 - protein, 7 aa, Artificial Sequence
  Synthetic construct
WFIPTFF

SEQ ID NO: 28279 - protein, 7 aa, Artificial Sequence
  Synthetic construct
WFIPTFY

SEQ ID NO: 28280 - protein, 7 aa, Artificial Sequence
  Synthetic construct
WFIPTRF

SEQ ID NO: 28281 - protein, 7 aa, Artificial Sequence
  Synthetic construct
WFIPTRY

SEQ ID NO: 28282 - protein, 7 aa, Artificial Sequence
  Synthetic construct
WFIPTCF

SEQ ID NO: 28283 - protein, 7 aa, Artificial Sequence
  Synthetic construct
WFIPTCY

SEQ ID NO: 28284 - protein, 7 aa, Artificial Sequence
  Synthetic construct
WFIPTLF

SEQ ID NO: 28285 - protein, 7 aa, Artificial Sequence
  Synthetic construct
WFIPTLY

SEQ ID NO: 28286 - protein, 7 aa, Artificial Sequence
  Synthetic construct
WFIPTAF

SEQ ID NO: 28287 - protein, 7 aa, Artificial Sequence
  Synthetic construct
WFIPTAY

SEQ ID NO: 28288 - protein, 7 aa, Artificial Sequence
  Synthetic construct
WFIPTQF

SEQ ID NO: 28289 - protein, 7 aa, Artificial Sequence
  Synthetic construct
WFIPTQY

SEQ ID NO: 28290 - protein, 7 aa, Artificial Sequence
  Synthetic construct
WFIPTDF

SEQ ID NO: 28291 - protein, 7 aa, Artificial Sequence
  Synthetic construct
WFIPTDY

SEQ ID NO: 28292 - protein, 7 aa, Artificial Sequence
  Synthetic construct
WFIPTVF

SEQ ID NO: 28293 - protein, 7 aa, Artificial Sequence
  Synthetic construct
WFIPTVY

SEQ ID NO: 28294 - protein, 7 aa, Artificial Sequence
  Synthetic construct
WFIPGFF

SEQ ID NO: 28295 - protein, 7 aa, Artificial Sequence
  Synthetic construct
WFIPGFY

SEQ ID NO: 28296 - protein, 7 aa, Artificial Sequence
  Synthetic construct
WFIPGRF

SEQ ID NO: 28297 - protein, 7 aa, Artificial Sequence
  Synthetic construct
WFIPGRY

SEQ ID NO: 28298 - protein, 7 aa, Artificial Sequence
  Synthetic construct
WFIPGCF

SEQ ID NO: 28299 - protein, 7 aa, Artificial Sequence
  Synthetic construct
WFIPGCY

SEQ ID NO: 28300 - protein, 7 aa, Artificial Sequence
  Synthetic construct
WFIPGLF

SEQ ID NO: 28301 - protein, 7 aa, Artificial Sequence
  Synthetic construct
WFIPGLY

SEQ ID NO: 28302 - protein, 7 aa, Artificial Sequence
  Synthetic construct
WFIPGAF

SEQ ID NO: 28303 - protein, 7 aa, Artificial Sequence
  Synthetic construct
WFIPGAY

SEQ ID NO: 28304 - protein, 7 aa, Artificial Sequence
  Synthetic construct
WFIPGQF

SEQ ID NO: 28305 - protein, 7 aa, Artificial Sequence
  Synthetic construct
WFIPGQY

SEQ ID NO: 28306 - protein, 7 aa, Artificial Sequence
  Synthetic construct
WFIPGDF

SEQ ID NO: 28307 - protein, 7 aa, Artificial Sequence
  Synthetic construct
WFIPGDY

SEQ ID NO: 28308 - protein, 7 aa, Artificial Sequence
  Synthetic construct
WFIPGVF

SEQ ID NO: 28309 - protein, 7 aa, Artificial Sequence
  Synthetic construct
WFIPGVY

SEQ ID NO: 28310 - protein, 7 aa, Artificial Sequence
  Synthetic construct
WFIPAFF

SEQ ID NO: 28311 - protein, 7 aa, Artificial Sequence
  Synthetic construct
WFIPAFY

SEQ ID NO: 28312 - protein, 7 aa, Artificial Sequence
  Synthetic construct
WFIPARF

SEQ ID NO: 28313 - protein, 7 aa, Artificial Sequence
  Synthetic construct
WFIPARY

SEQ ID NO: 28314 - protein, 7 aa, Artificial Sequence
  Synthetic construct
WFIPACF

SEQ ID NO: 28315 - protein, 7 aa, Artificial Sequence
  Synthetic construct
WFIPACY

SEQ ID NO: 28316 - protein, 7 aa, Artificial Sequence
  Synthetic construct
WFIPALF

SEQ ID NO: 28317 - protein, 7 aa, Artificial Sequence
  Synthetic construct
WFIPALY

SEQ ID NO: 28318 - protein, 7 aa, Artificial Sequence
  Synthetic construct
WFIPAAF

SEQ ID NO: 28319 - protein, 7 aa, Artificial Sequence
  Synthetic construct
WFIPAAY

SEQ ID NO: 28320 - protein, 7 aa, Artificial Sequence
  Synthetic construct
WFIPAQF

SEQ ID NO: 28321 - protein, 7 aa, Artificial Sequence
  Synthetic construct
WFIPAQY

SEQ ID NO: 28322 - protein, 7 aa, Artificial Sequence
  Synthetic construct
WFIPADF

SEQ ID NO: 28323 - protein, 7 aa, Artificial Sequence
  Synthetic construct
WFIPADY

SEQ ID NO: 28324 - protein, 7 aa, Artificial Sequence
  Synthetic construct
WFIPAVF

SEQ ID NO: 28325 - protein, 7 aa, Artificial Sequence
  Synthetic construct
WFIPAVY

SEQ ID NO: 28326 - protein, 7 aa, Artificial Sequence
  Synthetic construct
WFIPQFF

SEQ ID NO: 28327 - protein, 7 aa, Artificial Sequence
  Synthetic construct
WFIPQFY

SEQ ID NO: 28328 - protein, 7 aa, Artificial Sequence
  Synthetic construct
WFIPQRF

SEQ ID NO: 28329 - protein, 7 aa, Artificial Sequence
  Synthetic construct
WFIPQRY

SEQ ID NO: 28330 - protein, 7 aa, Artificial Sequence
  Synthetic construct
WFIPQCF

SEQ ID NO: 28331 - protein, 7 aa, Artificial Sequence
  Synthetic construct
WFIPQCY

SEQ ID NO: 28332 - protein, 7 aa, Artificial Sequence
  Synthetic construct
WFIPQLF

SEQ ID NO: 28333 - protein, 7 aa, Artificial Sequence
  Synthetic construct
WFIPQLY

SEQ ID NO: 28334 - protein, 7 aa, Artificial Sequence
  Synthetic construct
WFIPQAF

SEQ ID NO: 28335 - protein, 7 aa, Artificial Sequence
  Synthetic construct
WFIPQAY

SEQ ID NO: 28336 - protein, 7 aa, Artificial Sequence
  Synthetic construct
WFIPQQF

SEQ ID NO: 28337 - protein, 7 aa, Artificial Sequence
  Synthetic construct
WFIPQQY

SEQ ID NO: 28338 - protein, 7 aa, Artificial Sequence
  Synthetic construct
WFIPQDF

SEQ ID NO: 28339 - protein, 7 aa, Artificial Sequence
  Synthetic construct
WFIPQDY

SEQ ID NO: 28340 - protein, 7 aa, Artificial Sequence
  Synthetic construct
WFIPQVF

SEQ ID NO: 28341 - protein, 7 aa, Artificial Sequence
  Synthetic construct
WFIPQVY

SEQ ID NO: 28342 - protein, 7 aa, Artificial Sequence
  Synthetic construct
WFIHIFF

SEQ ID NO: 28343 - protein, 7 aa, Artificial Sequence
  Synthetic construct
WFIHIFY

SEQ ID NO: 28344 - protein, 7 aa, Artificial Sequence
  Synthetic construct
WFIHIRF

SEQ ID NO: 28345 - protein, 7 aa, Artificial Sequence
  Synthetic construct
WFIHIRY

SEQ ID NO: 28346 - protein, 7 aa, Artificial Sequence
  Synthetic construct
WFIHICF

SEQ ID NO: 28347 - protein, 7 aa, Artificial Sequence
  Synthetic construct
WFIHICY

SEQ ID NO: 28348 - protein, 7 aa, Artificial Sequence
  Synthetic construct
WFIHILF

SEQ ID NO: 28349 - protein, 7 aa, Artificial Sequence
  Synthetic construct
WFIHILY

SEQ ID NO: 28350 - protein, 7 aa, Artificial Sequence
  Synthetic construct
WFIHIAF

SEQ ID NO: 28351 - protein, 7 aa, Artificial Sequence
  Synthetic construct
WFIHIAY

SEQ ID NO: 28352 - protein, 7 aa, Artificial Sequence
  Synthetic construct
WFIHIQF

SEQ ID NO: 28353 - protein, 7 aa, Artificial Sequence
  Synthetic construct
WFIHIQY

SEQ ID NO: 28354 - protein, 7 aa, Artificial Sequence
  Synthetic construct
WFIHIDF

SEQ ID NO: 28355 - protein, 7 aa, Artificial Sequence
  Synthetic construct
WFIHIDY

SEQ ID NO: 28356 - protein, 7 aa, Artificial Sequence
  Synthetic construct
WFIHIVF

SEQ ID NO: 28357 - protein, 7 aa, Artificial Sequence
  Synthetic construct
WFIHIVY

SEQ ID NO: 28358 - protein, 7 aa, Artificial Sequence
  Synthetic construct
WFIHDFF

SEQ ID NO: 28359 - protein, 7 aa, Artificial Sequence
  Synthetic construct
WFIHDFY

SEQ ID NO: 28360 - protein, 7 aa, Artificial Sequence
  Synthetic construct
WFIHDRF

SEQ ID NO: 28361 - protein, 7 aa, Artificial Sequence
  Synthetic construct
WFIHDRY

SEQ ID NO: 28362 - protein, 7 aa, Artificial Sequence
  Synthetic construct
WFIHDCF

SEQ ID NO: 28363 - protein, 7 aa, Artificial Sequence
  Synthetic construct
WFIHDCY

SEQ ID NO: 28364 - protein, 7 aa, Artificial Sequence
  Synthetic construct
WFIHDLF

SEQ ID NO: 28365 - protein, 7 aa, Artificial Sequence
  Synthetic construct
WFIHDLY

SEQ ID NO: 28366 - protein, 7 aa, Artificial Sequence
  Synthetic construct
WFIHDAF

SEQ ID NO: 28367 - protein, 7 aa, Artificial Sequence
  Synthetic construct
WFIHDAY

SEQ ID NO: 28368 - protein, 7 aa, Artificial Sequence
  Synthetic construct
WFIHDQF

SEQ ID NO: 28369 - protein, 7 aa, Artificial Sequence
  Synthetic construct
WFIHDQY

SEQ ID NO: 28370 - protein, 7 aa, Artificial Sequence
  Synthetic construct
WFIHDDF

SEQ ID NO: 28371 - protein, 7 aa, Artificial Sequence
  Synthetic construct
WFIHDDY

SEQ ID NO: 28372 - protein, 7 aa, Artificial Sequence
  Synthetic construct
WFIHDVF

SEQ ID NO: 28373 - protein, 7 aa, Artificial Sequence
  Synthetic construct
WFIHDVY

SEQ ID NO: 28374 - protein, 7 aa, Artificial Sequence
  Synthetic construct
WFIHYFF

SEQ ID NO: 28375 - protein, 7 aa, Artificial Sequence
  Synthetic construct
WFIHYFY

SEQ ID NO: 28376 - protein, 7 aa, Artificial Sequence
  Synthetic construct
WFIHYRF

SEQ ID NO: 28377 - protein, 7 aa, Artificial Sequence
  Synthetic construct
WFIHYRY

SEQ ID NO: 28378 - protein, 7 aa, Artificial Sequence
  Synthetic construct
WFIHYCF

SEQ ID NO: 28379 - protein, 7 aa, Artificial Sequence
  Synthetic construct
WFIHYCY

SEQ ID NO: 28380 - protein, 7 aa, Artificial Sequence
  Synthetic construct
WFIHYLF

SEQ ID NO: 28381 - protein, 7 aa, Artificial Sequence
  Synthetic construct
WFIHYLY

SEQ ID NO: 28382 - protein, 7 aa, Artificial Sequence
  Synthetic construct
WFIHYAF

SEQ ID NO: 28383 - protein, 7 aa, Artificial Sequence
  Synthetic construct
WFIHYAY

SEQ ID NO: 28384 - protein, 7 aa, Artificial Sequence
  Synthetic construct
WFIHYQF

SEQ ID NO: 28385 - protein, 7 aa, Artificial Sequence
  Synthetic construct
WFIHYQY

SEQ ID NO: 28386 - protein, 7 aa, Artificial Sequence
  Synthetic construct
WFIHYDF

SEQ ID NO: 28387 - protein, 7 aa, Artificial Sequence
  Synthetic construct
WFIHYDY

SEQ ID NO: 28388 - protein, 7 aa, Artificial Sequence
  Synthetic construct
WFIHYVF

SEQ ID NO: 28389 - protein, 7 aa, Artificial Sequence
  Synthetic construct
WFIHYVY

SEQ ID NO: 28390 - protein, 7 aa, Artificial Sequence
  Synthetic construct
WFIHFFF

SEQ ID NO: 28391 - protein, 7 aa, Artificial Sequence
  Synthetic construct
WFIHFFY

SEQ ID NO: 28392 - protein, 7 aa, Artificial Sequence
  Synthetic construct
WFIHFRF

SEQ ID NO: 28393 - protein, 7 aa, Artificial Sequence
  Synthetic construct
WFIHFRY

SEQ ID NO: 28394 - protein, 7 aa, Artificial Sequence
  Synthetic construct
WFIHFCF

SEQ ID NO: 28395 - protein, 7 aa, Artificial Sequence
  Synthetic construct
WFIHFCY

SEQ ID NO: 28396 - protein, 7 aa, Artificial Sequence
  Synthetic construct
WFIHFLF

SEQ ID NO: 28397 - protein, 7 aa, Artificial Sequence
  Synthetic construct
WFIHFLY

SEQ ID NO: 28398 - protein, 7 aa, Artificial Sequence
  Synthetic construct
WFIHFAF

SEQ ID NO: 28399 - protein, 7 aa, Artificial Sequence
  Synthetic construct
WFIHFAY

SEQ ID NO: 28400 - protein, 7 aa, Artificial Sequence
  Synthetic construct
WFIHFQF

SEQ ID NO: 28401 - protein, 7 aa, Artificial Sequence
  Synthetic construct
WFIHFQY

SEQ ID NO: 28402 - protein, 7 aa, Artificial Sequence
  Synthetic construct
WFIHFDF

SEQ ID NO: 28403 - protein, 7 aa, Artificial Sequence
  Synthetic construct
WFIHFDY

SEQ ID NO: 28404 - protein, 7 aa, Artificial Sequence
  Synthetic construct
WFIHFVF

SEQ ID NO: 28405 - protein, 7 aa, Artificial Sequence
  Synthetic construct
WFIHFVY

SEQ ID NO: 28406 - protein, 7 aa, Artificial Sequence
  Synthetic construct
WFIHVFF

SEQ ID NO: 28407 - protein, 7 aa, Artificial Sequence
  Synthetic construct
WFIHVFY

SEQ ID NO: 28408 - protein, 7 aa, Artificial Sequence
  Synthetic construct
WFIHVRF

SEQ ID NO: 28409 - protein, 7 aa, Artificial Sequence
  Synthetic construct
WFIHVRY

SEQ ID NO: 28410 - protein, 7 aa, Artificial Sequence
  Synthetic construct
WFIHVCF

SEQ ID NO: 28411 - protein, 7 aa, Artificial Sequence
  Synthetic construct
WFIHVCY

SEQ ID NO: 28412 - protein, 7 aa, Artificial Sequence
  Synthetic construct
WFIHVLF

SEQ ID NO: 28413 - protein, 7 aa, Artificial Sequence
  Synthetic construct
WFIHVLY

SEQ ID NO: 28414 - protein, 7 aa, Artificial Sequence
  Synthetic construct
WFIHVAF

SEQ ID NO: 28415 - protein, 7 aa, Artificial Sequence
  Synthetic construct
WFIHVAY

SEQ ID NO: 28416 - protein, 7 aa, Artificial Sequence
  Synthetic construct
WFIHVQF

SEQ ID NO: 28417 - protein, 7 aa, Artificial Sequence
  Synthetic construct
WFIHVQY

SEQ ID NO: 28418 - protein, 7 aa, Artificial Sequence
  Synthetic construct
WFIHVDF

SEQ ID NO: 28419 - protein, 7 aa, Artificial Sequence
  Synthetic construct
WFIHVDY

SEQ ID NO: 28420 - protein, 7 aa, Artificial Sequence
  Synthetic construct
WFIHVVF

SEQ ID NO: 28421 - protein, 7 aa, Artificial Sequence
  Synthetic construct
WFIHVVY

SEQ ID NO: 28422 - protein, 7 aa, Artificial Sequence
  Synthetic construct
WFIHTFF

SEQ ID NO: 28423 - protein, 7 aa, Artificial Sequence
  Synthetic construct
WFIHTFY

SEQ ID NO: 28424 - protein, 7 aa, Artificial Sequence
  Synthetic construct
WFIHTRF

SEQ ID NO: 28425 - protein, 7 aa, Artificial Sequence
  Synthetic construct
WFIHTRY

SEQ ID NO: 28426 - protein, 7 aa, Artificial Sequence
  Synthetic construct
WFIHTCF

SEQ ID NO: 28427 - protein, 7 aa, Artificial Sequence
  Synthetic construct
WFIHTCY

SEQ ID NO: 28428 - protein, 7 aa, Artificial Sequence
  Synthetic construct
WFIHTLF

SEQ ID NO: 28429 - protein, 7 aa, Artificial Sequence
  Synthetic construct
WFIHTLY

SEQ ID NO: 28430 - protein, 7 aa, Artificial Sequence
  Synthetic construct
WFIHTAF

SEQ ID NO: 28431 - protein, 7 aa, Artificial Sequence
  Synthetic construct
WFIHTAY

SEQ ID NO: 28432 - protein, 7 aa, Artificial Sequence
  Synthetic construct
WFIHTQF

SEQ ID NO: 28433 - protein, 7 aa, Artificial Sequence
  Synthetic construct
WFIHTQY

SEQ ID NO: 28434 - protein, 7 aa, Artificial Sequence
  Synthetic construct
WFIHTDF

SEQ ID NO: 28435 - protein, 7 aa, Artificial Sequence
  Synthetic construct
WFIHTDY

SEQ ID NO: 28436 - protein, 7 aa, Artificial Sequence
  Synthetic construct
WFIHTVF

SEQ ID NO: 28437 - protein, 7 aa, Artificial Sequence
  Synthetic construct
WFIHTVY

SEQ ID NO: 28438 - protein, 7 aa, Artificial Sequence
  Synthetic construct
WFIHGFF

SEQ ID NO: 28439 - protein, 7 aa, Artificial Sequence
  Synthetic construct
WFIHGFY

SEQ ID NO: 28440 - protein, 7 aa, Artificial Sequence
  Synthetic construct
WFIHGRF

SEQ ID NO: 28441 - protein, 7 aa, Artificial Sequence
  Synthetic construct
WFIHGRY

SEQ ID NO: 28442 - protein, 7 aa, Artificial Sequence
  Synthetic construct
WFIHGCF

SEQ ID NO: 28443 - protein, 7 aa, Artificial Sequence
  Synthetic construct
WFIHGCY

SEQ ID NO: 28444 - protein, 7 aa, Artificial Sequence
  Synthetic construct
WFIHGLF

SEQ ID NO: 28445 - protein, 7 aa, Artificial Sequence
  Synthetic construct
WFIHGLY

SEQ ID NO: 28446 - protein, 7 aa, Artificial Sequence
  Synthetic construct
WFIHGAF

SEQ ID NO: 28447 - protein, 7 aa, Artificial Sequence
  Synthetic construct
WFIHGAY

SEQ ID NO: 28448 - protein, 7 aa, Artificial Sequence
  Synthetic construct
WFIHGQF

SEQ ID NO: 28449 - protein, 7 aa, Artificial Sequence
  Synthetic construct
WFIHGQY

SEQ ID NO: 28450 - protein, 7 aa, Artificial Sequence
  Synthetic construct
WFIHGDF

SEQ ID NO: 28451 - protein, 7 aa, Artificial Sequence
  Synthetic construct
WFIHGDY

SEQ ID NO: 28452 - protein, 7 aa, Artificial Sequence
  Synthetic construct
WFIHGVF

SEQ ID NO: 28453 - protein, 7 aa, Artificial Sequence
  Synthetic construct
WFIHGVY

SEQ ID NO: 28454 - protein, 7 aa, Artificial Sequence
  Synthetic construct
WFIHAFF

SEQ ID NO: 28455 - protein, 7 aa, Artificial Sequence
  Synthetic construct
WFIHAFY

SEQ ID NO: 28456 - protein, 7 aa, Artificial Sequence
  Synthetic construct
WFIHARF

SEQ ID NO: 28457 - protein, 7 aa, Artificial Sequence
  Synthetic construct
WFIHARY

SEQ ID NO: 28458 - protein, 7 aa, Artificial Sequence
  Synthetic construct
WFIHACF

SEQ ID NO: 28459 - protein, 7 aa, Artificial Sequence
  Synthetic construct
WFIHACY

SEQ ID NO: 28460 - protein, 7 aa, Artificial Sequence
  Synthetic construct
WFIHALF

SEQ ID NO: 28461 - protein, 7 aa, Artificial Sequence
  Synthetic construct
WFIHALY

SEQ ID NO: 28462 - protein, 7 aa, Artificial Sequence
  Synthetic construct
WFIHAAF

SEQ ID NO: 28463 - protein, 7 aa, Artificial Sequence
  Synthetic construct
WFIHAAY

SEQ ID NO: 28464 - protein, 7 aa, Artificial Sequence
  Synthetic construct
WFIHAQF

SEQ ID NO: 28465 - protein, 7 aa, Artificial Sequence
  Synthetic construct
WFIHAQY

SEQ ID NO: 28466 - protein, 7 aa, Artificial Sequence
  Synthetic construct
WFIHADF

SEQ ID NO: 28467 - protein, 7 aa, Artificial Sequence
  Synthetic construct
WFIHADY

SEQ ID NO: 28468 - protein, 7 aa, Artificial Sequence
  Synthetic construct
WFIHAVF

SEQ ID NO: 28469 - protein, 7 aa, Artificial Sequence
  Synthetic construct
WFIHAVY

SEQ ID NO: 28470 - protein, 7 aa, Artificial Sequence
  Synthetic construct
WFIHQFF

SEQ ID NO: 28471 - protein, 7 aa, Artificial Sequence
  Synthetic construct
WFIHQFY

SEQ ID NO: 28472 - protein, 7 aa, Artificial Sequence
  Synthetic construct
WFIHQRF

SEQ ID NO: 28473 - protein, 7 aa, Artificial Sequence
  Synthetic construct
WFIHQRY

SEQ ID NO: 28474 - protein, 7 aa, Artificial Sequence
  Synthetic construct
WFIHQCF

SEQ ID NO: 28475 - protein, 7 aa, Artificial Sequence
  Synthetic construct
WFIHQCY

SEQ ID NO: 28476 - protein, 7 aa, Artificial Sequence
  Synthetic construct
WFIHQLF

SEQ ID NO: 28477 - protein, 7 aa, Artificial Sequence
  Synthetic construct
WFIHQLY

SEQ ID NO: 28478 - protein, 7 aa, Artificial Sequence
  Synthetic construct
WFIHQAF

SEQ ID NO: 28479 - protein, 7 aa, Artificial Sequence
  Synthetic construct
WFIHQAY

SEQ ID NO: 28480 - protein, 7 aa, Artificial Sequence
  Synthetic construct
WFIHQQF

SEQ ID NO: 28481 - protein, 7 aa, Artificial Sequence
  Synthetic construct
WFIHQQY

SEQ ID NO: 28482 - protein, 7 aa, Artificial Sequence
  Synthetic construct
WFIHQDF

SEQ ID NO: 28483 - protein, 7 aa, Artificial Sequence
  Synthetic construct
WFIHQDY

SEQ ID NO: 28484 - protein, 7 aa, Artificial Sequence
  Synthetic construct
WFIHQVF

SEQ ID NO: 28485 - protein, 7 aa, Artificial Sequence
  Synthetic construct
WFIHQVY

SEQ ID NO: 28486 - protein, 7 aa, Artificial Sequence
  Synthetic construct
WFILIFF

SEQ ID NO: 28487 - protein, 7 aa, Artificial Sequence
  Synthetic construct
WFILIFY

SEQ ID NO: 28488 - protein, 7 aa, Artificial Sequence
  Synthetic construct
WFILIRF

SEQ ID NO: 28489 - protein, 7 aa, Artificial Sequence
  Synthetic construct
WFILIRY

SEQ ID NO: 28490 - protein, 7 aa, Artificial Sequence
  Synthetic construct
WFILICF

SEQ ID NO: 28491 - protein, 7 aa, Artificial Sequence
  Synthetic construct
WFILICY

SEQ ID NO: 28492 - protein, 7 aa, Artificial Sequence
  Synthetic construct
WFILILF

SEQ ID NO: 28493 - protein, 7 aa, Artificial Sequence
  Synthetic construct
WFILILY

SEQ ID NO: 28494 - protein, 7 aa, Artificial Sequence
  Synthetic construct
WFILIAF

SEQ ID NO: 28495 - protein, 7 aa, Artificial Sequence
  Synthetic construct
WFILIAY

SEQ ID NO: 28496 - protein, 7 aa, Artificial Sequence
  Synthetic construct
WFILIQF

SEQ ID NO: 28497 - protein, 7 aa, Artificial Sequence
  Synthetic construct
WFILIQY

SEQ ID NO: 28498 - protein, 7 aa, Artificial Sequence
  Synthetic construct
WFILIDF

SEQ ID NO: 28499 - protein, 7 aa, Artificial Sequence
  Synthetic construct
WFILIDY

SEQ ID NO: 28500 - protein, 7 aa, Artificial Sequence
  Synthetic construct
WFILIVF

SEQ ID NO: 28501 - protein, 7 aa, Artificial Sequence
  Synthetic construct
WFILIVY

SEQ ID NO: 28502 - protein, 7 aa, Artificial Sequence
  Synthetic construct
WFILDFF

SEQ ID NO: 28503 - protein, 7 aa, Artificial Sequence
  Synthetic construct
WFILDFY

SEQ ID NO: 28504 - protein, 7 aa, Artificial Sequence
  Synthetic construct
WFILDRF

SEQ ID NO: 28505 - protein, 7 aa, Artificial Sequence
  Synthetic construct
WFILDRY

SEQ ID NO: 28506 - protein, 7 aa, Artificial Sequence
  Synthetic construct
WFILDCF

SEQ ID NO: 28507 - protein, 7 aa, Artificial Sequence
  Synthetic construct
WFILDCY

SEQ ID NO: 28508 - protein, 7 aa, Artificial Sequence
  Synthetic construct
WFILDLF

SEQ ID NO: 28509 - protein, 7 aa, Artificial Sequence
  Synthetic construct
WFILDLY

SEQ ID NO: 28510 - protein, 7 aa, Artificial Sequence
  Synthetic construct
WFILDAF

SEQ ID NO: 28511 - protein, 7 aa, Artificial Sequence
  Synthetic construct
WFILDAY

SEQ ID NO: 28512 - protein, 7 aa, Artificial Sequence
  Synthetic construct
WFILDQF

SEQ ID NO: 28513 - protein, 7 aa, Artificial Sequence
  Synthetic construct
WFILDQY

SEQ ID NO: 28514 - protein, 7 aa, Artificial Sequence
  Synthetic construct
WFILDDF

SEQ ID NO: 28515 - protein, 7 aa, Artificial Sequence
  Synthetic construct
WFILDDY

SEQ ID NO: 28516 - protein, 7 aa, Artificial Sequence
  Synthetic construct
WFILDVF

SEQ ID NO: 28517 - protein, 7 aa, Artificial Sequence
  Synthetic construct
WFILDVY

SEQ ID NO: 28518 - protein, 7 aa, Artificial Sequence
  Synthetic construct
WFILYFF

SEQ ID NO: 28519 - protein, 7 aa, Artificial Sequence
  Synthetic construct
WFILYFY

SEQ ID NO: 28520 - protein, 7 aa, Artificial Sequence
  Synthetic construct
WFILYRF

SEQ ID NO: 28521 - protein, 7 aa, Artificial Sequence
  Synthetic construct
WFILYRY

SEQ ID NO: 28522 - protein, 7 aa, Artificial Sequence
  Synthetic construct
WFILYCF

SEQ ID NO: 28523 - protein, 7 aa, Artificial Sequence
  Synthetic construct
WFILYCY

SEQ ID NO: 28524 - protein, 7 aa, Artificial Sequence
  Synthetic construct
WFILYLF

SEQ ID NO: 28525 - protein, 7 aa, Artificial Sequence
  Synthetic construct
WFILYLY

SEQ ID NO: 28526 - protein, 7 aa, Artificial Sequence
  Synthetic construct
WFILYAF

SEQ ID NO: 28527 - protein, 7 aa, Artificial Sequence
  Synthetic construct
WFILYAY

SEQ ID NO: 28528 - protein, 7 aa, Artificial Sequence
  Synthetic construct
WFILYQF

SEQ ID NO: 28529 - protein, 7 aa, Artificial Sequence
  Synthetic construct
WFILYQY

SEQ ID NO: 28530 - protein, 7 aa, Artificial Sequence
  Synthetic construct
WFILYDF

SEQ ID NO: 28531 - protein, 7 aa, Artificial Sequence
  Synthetic construct
WFILYDY

SEQ ID NO: 28532 - protein, 7 aa, Artificial Sequence
  Synthetic construct
WFILYVF

SEQ ID NO: 28533 - protein, 7 aa, Artificial Sequence
  Synthetic construct
WFILYVY

SEQ ID NO: 28534 - protein, 7 aa, Artificial Sequence
  Synthetic construct
WFILFFF

SEQ ID NO: 28535 - protein, 7 aa, Artificial Sequence
  Synthetic construct
WFILFFY

SEQ ID NO: 28536 - protein, 7 aa, Artificial Sequence
  Synthetic construct
WFILFRF

SEQ ID NO: 28537 - protein, 7 aa, Artificial Sequence
  Synthetic construct
WFILFRY

SEQ ID NO: 28538 - protein, 7 aa, Artificial Sequence
  Synthetic construct
WFILFCF

SEQ ID NO: 28539 - protein, 7 aa, Artificial Sequence
  Synthetic construct
WFILFCY

SEQ ID NO: 28540 - protein, 7 aa, Artificial Sequence
  Synthetic construct
WFILFLF

SEQ ID NO: 28541 - protein, 7 aa, Artificial Sequence
  Synthetic construct
WFILFLY

SEQ ID NO: 28542 - protein, 7 aa, Artificial Sequence
  Synthetic construct
WFILFAF

SEQ ID NO: 28543 - protein, 7 aa, Artificial Sequence
  Synthetic construct
WFILFAY

SEQ ID NO: 28544 - protein, 7 aa, Artificial Sequence
  Synthetic construct
WFILFQF

SEQ ID NO: 28545 - protein, 7 aa, Artificial Sequence
  Synthetic construct
WFILFQY

SEQ ID NO: 28546 - protein, 7 aa, Artificial Sequence
  Synthetic construct
WFILFDF

SEQ ID NO: 28547 - protein, 7 aa, Artificial Sequence
  Synthetic construct
WFILFDY

SEQ ID NO: 28548 - protein, 7 aa, Artificial Sequence
  Synthetic construct
WFILFVF

SEQ ID NO: 28549 - protein, 7 aa, Artificial Sequence
  Synthetic construct
WFILFVY

SEQ ID NO: 28550 - protein, 7 aa, Artificial Sequence
  Synthetic construct
WFILVFF

SEQ ID NO: 28551 - protein, 7 aa, Artificial Sequence
  Synthetic construct
WFILVFY

SEQ ID NO: 28552 - protein, 7 aa, Artificial Sequence
  Synthetic construct
WFILVRF

SEQ ID NO: 28553 - protein, 7 aa, Artificial Sequence
  Synthetic construct
WFILVRY

SEQ ID NO: 28554 - protein, 7 aa, Artificial Sequence
  Synthetic construct
WFILVCF

SEQ ID NO: 28555 - protein, 7 aa, Artificial Sequence
  Synthetic construct
WFILVCY

SEQ ID NO: 28556 - protein, 7 aa, Artificial Sequence
  Synthetic construct
WFILVLF

SEQ ID NO: 28557 - protein, 7 aa, Artificial Sequence
  Synthetic construct
WFILVLY

SEQ ID NO: 28558 - protein, 7 aa, Artificial Sequence
  Synthetic construct
WFILVAF

SEQ ID NO: 28559 - protein, 7 aa, Artificial Sequence
  Synthetic construct
WFILVAY

SEQ ID NO: 28560 - protein, 7 aa, Artificial Sequence
  Synthetic construct
WFILVQF

SEQ ID NO: 28561 - protein, 7 aa, Artificial Sequence
  Synthetic construct
WFILVQY

SEQ ID NO: 28562 - protein, 7 aa, Artificial Sequence
  Synthetic construct
WFILVDF

SEQ ID NO: 28563 - protein, 7 aa, Artificial Sequence
  Synthetic construct
WFILVDY

SEQ ID NO: 28564 - protein, 7 aa, Artificial Sequence
  Synthetic construct
WFILVVF

SEQ ID NO: 28565 - protein, 7 aa, Artificial Sequence
  Synthetic construct
WFILVVY

SEQ ID NO: 28566 - protein, 7 aa, Artificial Sequence
  Synthetic construct
WFILTFF

SEQ ID NO: 28567 - protein, 7 aa, Artificial Sequence
  Synthetic construct
WFILTFY

SEQ ID NO: 28568 - protein, 7 aa, Artificial Sequence
  Synthetic construct
WFILTRF

SEQ ID NO: 28569 - protein, 7 aa, Artificial Sequence
  Synthetic construct
WFILTRY

SEQ ID NO: 28570 - protein, 7 aa, Artificial Sequence
  Synthetic construct
WFILTCF

SEQ ID NO: 28571 - protein, 7 aa, Artificial Sequence
  Synthetic construct
WFILTCY

SEQ ID NO: 28572 - protein, 7 aa, Artificial Sequence
  Synthetic construct
WFILTLF

SEQ ID NO: 28573 - protein, 7 aa, Artificial Sequence
  Synthetic construct
WFILTLY

SEQ ID NO: 28574 - protein, 7 aa, Artificial Sequence
  Synthetic construct
WFILTAF

SEQ ID NO: 28575 - protein, 7 aa, Artificial Sequence
  Synthetic construct
WFILTAY

SEQ ID NO: 28576 - protein, 7 aa, Artificial Sequence
  Synthetic construct
WFILTQF

SEQ ID NO: 28577 - protein, 7 aa, Artificial Sequence
  Synthetic construct
WFILTQY

SEQ ID NO: 28578 - protein, 7 aa, Artificial Sequence
  Synthetic construct
WFILTDF

SEQ ID NO: 28579 - protein, 7 aa, Artificial Sequence
  Synthetic construct
WFILTDY

SEQ ID NO: 28580 - protein, 7 aa, Artificial Sequence
  Synthetic construct
WFILTVF

SEQ ID NO: 28581 - protein, 7 aa, Artificial Sequence
  Synthetic construct
WFILTVY

SEQ ID NO: 28582 - protein, 7 aa, Artificial Sequence
  Synthetic construct
WFILGFF

SEQ ID NO: 28583 - protein, 7 aa, Artificial Sequence
  Synthetic construct
WFILGFY

SEQ ID NO: 28584 - protein, 7 aa, Artificial Sequence
  Synthetic construct
WFILGRF

SEQ ID NO: 28585 - protein, 7 aa, Artificial Sequence
  Synthetic construct
WFILGRY

SEQ ID NO: 28586 - protein, 7 aa, Artificial Sequence
  Synthetic construct
WFILGCF

SEQ ID NO: 28587 - protein, 7 aa, Artificial Sequence
  Synthetic construct
WFILGCY

SEQ ID NO: 28588 - protein, 7 aa, Artificial Sequence
  Synthetic construct
WFILGLF

SEQ ID NO: 28589 - protein, 7 aa, Artificial Sequence
  Synthetic construct
WFILGLY

SEQ ID NO: 28590 - protein, 7 aa, Artificial Sequence
  Synthetic construct
WFILGAF

SEQ ID NO: 28591 - protein, 7 aa, Artificial Sequence
  Synthetic construct
WFILGAY

SEQ ID NO: 28592 - protein, 7 aa, Artificial Sequence
  Synthetic construct
WFILGQF

SEQ ID NO: 28593 - protein, 7 aa, Artificial Sequence
  Synthetic construct
WFILGQY

SEQ ID NO: 28594 - protein, 7 aa, Artificial Sequence
  Synthetic construct
WFILGDF

SEQ ID NO: 28595 - protein, 7 aa, Artificial Sequence
  Synthetic construct
WFILGDY

SEQ ID NO: 28596 - protein, 7 aa, Artificial Sequence
  Synthetic construct
WFILGVF

SEQ ID NO: 28597 - protein, 7 aa, Artificial Sequence
  Synthetic construct
WFILGVY

SEQ ID NO: 28598 - protein, 7 aa, Artificial Sequence
  Synthetic construct
WFILAFF

SEQ ID NO: 28599 - protein, 7 aa, Artificial Sequence
  Synthetic construct
WFILAFY

SEQ ID NO: 28600 - protein, 7 aa, Artificial Sequence
  Synthetic construct
WFILARF

SEQ ID NO: 28601 - protein, 7 aa, Artificial Sequence
  Synthetic construct
WFILARY

SEQ ID NO: 28602 - protein, 7 aa, Artificial Sequence
  Synthetic construct
WFILACF

SEQ ID NO: 28603 - protein, 7 aa, Artificial Sequence
  Synthetic construct
WFILACY

SEQ ID NO: 28604 - protein, 7 aa, Artificial Sequence
  Synthetic construct
WFILALF

SEQ ID NO: 28605 - protein, 7 aa, Artificial Sequence
  Synthetic construct
WFILALY

SEQ ID NO: 28606 - protein, 7 aa, Artificial Sequence
  Synthetic construct
WFILAAF

SEQ ID NO: 28607 - protein, 7 aa, Artificial Sequence
  Synthetic construct
WFILAAY

SEQ ID NO: 28608 - protein, 7 aa, Artificial Sequence
  Synthetic construct
WFILAQF

SEQ ID NO: 28609 - protein, 7 aa, Artificial Sequence
  Synthetic construct
WFILAQY

SEQ ID NO: 28610 - protein, 7 aa, Artificial Sequence
  Synthetic construct
WFILADF

SEQ ID NO: 28611 - protein, 7 aa, Artificial Sequence
  Synthetic construct
WFILADY

SEQ ID NO: 28612 - protein, 7 aa, Artificial Sequence
  Synthetic construct
WFILAVF

SEQ ID NO: 28613 - protein, 7 aa, Artificial Sequence
  Synthetic construct
WFILAVY

SEQ ID NO: 28614 - protein, 7 aa, Artificial Sequence
  Synthetic construct
WFILQFF

SEQ ID NO: 28615 - protein, 7 aa, Artificial Sequence
  Synthetic construct
WFILQFY

SEQ ID NO: 28616 - protein, 7 aa, Artificial Sequence
  Synthetic construct
WFILQRF

SEQ ID NO: 28617 - protein, 7 aa, Artificial Sequence
  Synthetic construct
WFILQRY

SEQ ID NO: 28618 - protein, 7 aa, Artificial Sequence
  Synthetic construct
WFILQCF

SEQ ID NO: 28619 - protein, 7 aa, Artificial Sequence
  Synthetic construct
WFILQCY

SEQ ID NO: 28620 - protein, 7 aa, Artificial Sequence
  Synthetic construct
WFILQLF

SEQ ID NO: 28621 - protein, 7 aa, Artificial Sequence
  Synthetic construct
WFILQLY

SEQ ID NO: 28622 - protein, 7 aa, Artificial Sequence
  Synthetic construct
WFILQAF

SEQ ID NO: 28623 - protein, 7 aa, Artificial Sequence
  Synthetic construct
WFILQAY

SEQ ID NO: 28624 - protein, 7 aa, Artificial Sequence
  Synthetic construct
WFILQQF

SEQ ID NO: 28625 - protein, 7 aa, Artificial Sequence
  Synthetic construct
WFILQQY

SEQ ID NO: 28626 - protein, 7 aa, Artificial Sequence
  Synthetic construct
WFILQDF

SEQ ID NO: 28627 - protein, 7 aa, Artificial Sequence
  Synthetic construct
WFILQDY

SEQ ID NO: 28628 - protein, 7 aa, Artificial Sequence
  Synthetic construct
WFILQVF

SEQ ID NO: 28629 - protein, 7 aa, Artificial Sequence
  Synthetic construct
WFILQVY

SEQ ID NO: 28630 - protein, 7 aa, Artificial Sequence
  Synthetic construct
WFIFIFF

SEQ ID NO: 28631 - protein, 7 aa, Artificial Sequence
  Synthetic construct
WFIFIFY

SEQ ID NO: 28632 - protein, 7 aa, Artificial Sequence
  Synthetic construct
WFIFIRF

SEQ ID NO: 28633 - protein, 7 aa, Artificial Sequence
  Synthetic construct
WFIFIRY

SEQ ID NO: 28634 - protein, 7 aa, Artificial Sequence
  Synthetic construct
WFIFICF

SEQ ID NO: 28635 - protein, 7 aa, Artificial Sequence
  Synthetic construct
WFIFICY

SEQ ID NO: 28636 - protein, 7 aa, Artificial Sequence
  Synthetic construct
WFIFILF

SEQ ID NO: 28637 - protein, 7 aa, Artificial Sequence
  Synthetic construct
WFIFILY

SEQ ID NO: 28638 - protein, 7 aa, Artificial Sequence
  Synthetic construct
WFIFIAF

SEQ ID NO: 28639 - protein, 7 aa, Artificial Sequence
  Synthetic construct
WFIFIAY

SEQ ID NO: 28640 - protein, 7 aa, Artificial Sequence
  Synthetic construct
WFIFIQF

SEQ ID NO: 28641 - protein, 7 aa, Artificial Sequence
  Synthetic construct
WFIFIQY

SEQ ID NO: 28642 - protein, 7 aa, Artificial Sequence
  Synthetic construct
WFIFIDF

SEQ ID NO: 28643 - protein, 7 aa, Artificial Sequence
  Synthetic construct
WFIFIDY

SEQ ID NO: 28644 - protein, 7 aa, Artificial Sequence
  Synthetic construct
WFIFIVF

SEQ ID NO: 28645 - protein, 7 aa, Artificial Sequence
  Synthetic construct
WFIFIVY

SEQ ID NO: 28646 - protein, 7 aa, Artificial Sequence
  Synthetic construct
WFIFDFF

SEQ ID NO: 28647 - protein, 7 aa, Artificial Sequence
  Synthetic construct
WFIFDFY

SEQ ID NO: 28648 - protein, 7 aa, Artificial Sequence
  Synthetic construct
WFIFDRF

SEQ ID NO: 28649 - protein, 7 aa, Artificial Sequence
  Synthetic construct
WFIFDRY

SEQ ID NO: 28650 - protein, 7 aa, Artificial Sequence
  Synthetic construct
WFIFDCF

SEQ ID NO: 28651 - protein, 7 aa, Artificial Sequence
  Synthetic construct
WFIFDCY

SEQ ID NO: 28652 - protein, 7 aa, Artificial Sequence
  Synthetic construct
WFIFDLF

SEQ ID NO: 28653 - protein, 7 aa, Artificial Sequence
  Synthetic construct
WFIFDLY

SEQ ID NO: 28654 - protein, 7 aa, Artificial Sequence
  Synthetic construct
WFIFDAF

SEQ ID NO: 28655 - protein, 7 aa, Artificial Sequence
  Synthetic construct
WFIFDAY

SEQ ID NO: 28656 - protein, 7 aa, Artificial Sequence
  Synthetic construct
WFIFDQF

SEQ ID NO: 28657 - protein, 7 aa, Artificial Sequence
  Synthetic construct
WFIFDQY

SEQ ID NO: 28658 - protein, 7 aa, Artificial Sequence
  Synthetic construct
WFIFDDF

SEQ ID NO: 28659 - protein, 7 aa, Artificial Sequence
  Synthetic construct
WFIFDDY

SEQ ID NO: 28660 - protein, 7 aa, Artificial Sequence
  Synthetic construct
WFIFDVF

SEQ ID NO: 28661 - protein, 7 aa, Artificial Sequence
  Synthetic construct
WFIFDVY

SEQ ID NO: 28662 - protein, 7 aa, Artificial Sequence
  Synthetic construct
WFIFYFF

SEQ ID NO: 28663 - protein, 7 aa, Artificial Sequence
  Synthetic construct
WFIFYFY

SEQ ID NO: 28664 - protein, 7 aa, Artificial Sequence
  Synthetic construct
WFIFYRF

SEQ ID NO: 28665 - protein, 7 aa, Artificial Sequence
  Synthetic construct
WFIFYRY

SEQ ID NO: 28666 - protein, 7 aa, Artificial Sequence
  Synthetic construct
WFIFYCF

SEQ ID NO: 28667 - protein, 7 aa, Artificial Sequence
  Synthetic construct
WFIFYCY

SEQ ID NO: 28668 - protein, 7 aa, Artificial Sequence
  Synthetic construct
WFIFYLF

SEQ ID NO: 28669 - protein, 7 aa, Artificial Sequence
  Synthetic construct
WFIFYLY

SEQ ID NO: 28670 - protein, 7 aa, Artificial Sequence
  Synthetic construct
WFIFYAF

SEQ ID NO: 28671 - protein, 7 aa, Artificial Sequence
  Synthetic construct
WFIFYAY

SEQ ID NO: 28672 - protein, 7 aa, Artificial Sequence
  Synthetic construct
WFIFYQF

SEQ ID NO: 28673 - protein, 7 aa, Artificial Sequence
  Synthetic construct
WFIFYQY

SEQ ID NO: 28674 - protein, 7 aa, Artificial Sequence
  Synthetic construct
WFIFYDF

SEQ ID NO: 28675 - protein, 7 aa, Artificial Sequence
  Synthetic construct
WFIFYDY

SEQ ID NO: 28676 - protein, 7 aa, Artificial Sequence
  Synthetic construct
WFIFYVF

SEQ ID NO: 28677 - protein, 7 aa, Artificial Sequence
  Synthetic construct
WFIFYVY

SEQ ID NO: 28678 - protein, 7 aa, Artificial Sequence
  Synthetic construct
WFIFFFF

SEQ ID NO: 28679 - protein, 7 aa, Artificial Sequence
  Synthetic construct
WFIFFFY

SEQ ID NO: 28680 - protein, 7 aa, Artificial Sequence
  Synthetic construct
WFIFFRF

SEQ ID NO: 28681 - protein, 7 aa, Artificial Sequence
  Synthetic construct
WFIFFRY

SEQ ID NO: 28682 - protein, 7 aa, Artificial Sequence
  Synthetic construct
WFIFFCF

SEQ ID NO: 28683 - protein, 7 aa, Artificial Sequence
  Synthetic construct
WFIFFCY

SEQ ID NO: 28684 - protein, 7 aa, Artificial Sequence
  Synthetic construct
WFIFFLF

SEQ ID NO: 28685 - protein, 7 aa, Artificial Sequence
  Synthetic construct
WFIFFLY

SEQ ID NO: 28686 - protein, 7 aa, Artificial Sequence
  Synthetic construct
WFIFFAF

SEQ ID NO: 28687 - protein, 7 aa, Artificial Sequence
  Synthetic construct
WFIFFAY

SEQ ID NO: 28688 - protein, 7 aa, Artificial Sequence
  Synthetic construct
WFIFFQF

SEQ ID NO: 28689 - protein, 7 aa, Artificial Sequence
  Synthetic construct
WFIFFQY

SEQ ID NO: 28690 - protein, 7 aa, Artificial Sequence
  Synthetic construct
WFIFFDF

SEQ ID NO: 28691 - protein, 7 aa, Artificial Sequence
  Synthetic construct
WFIFFDY

SEQ ID NO: 28692 - protein, 7 aa, Artificial Sequence
  Synthetic construct
WFIFFVF

SEQ ID NO: 28693 - protein, 7 aa, Artificial Sequence
  Synthetic construct
WFIFFVY

SEQ ID NO: 28694 - protein, 7 aa, Artificial Sequence
  Synthetic construct
WFIFVFF

SEQ ID NO: 28695 - protein, 7 aa, Artificial Sequence
  Synthetic construct
WFIFVFY

SEQ ID NO: 28696 - protein, 7 aa, Artificial Sequence
  Synthetic construct
WFIFVRF

SEQ ID NO: 28697 - protein, 7 aa, Artificial Sequence
  Synthetic construct
WFIFVRY

SEQ ID NO: 28698 - protein, 7 aa, Artificial Sequence
  Synthetic construct
WFIFVCF

SEQ ID NO: 28699 - protein, 7 aa, Artificial Sequence
  Synthetic construct
WFIFVCY

SEQ ID NO: 28700 - protein, 7 aa, Artificial Sequence
  Synthetic construct
WFIFVLF

SEQ ID NO: 28701 - protein, 7 aa, Artificial Sequence
  Synthetic construct
WFIFVLY

SEQ ID NO: 28702 - protein, 7 aa, Artificial Sequence
  Synthetic construct
WFIFVAF

SEQ ID NO: 28703 - protein, 7 aa, Artificial Sequence
  Synthetic construct
WFIFVAY

SEQ ID NO: 28704 - protein, 7 aa, Artificial Sequence
  Synthetic construct
WFIFVQF

SEQ ID NO: 28705 - protein, 7 aa, Artificial Sequence
  Synthetic construct
WFIFVQY

SEQ ID NO: 28706 - protein, 7 aa, Artificial Sequence
  Synthetic construct
WFIFVDF

SEQ ID NO: 28707 - protein, 7 aa, Artificial Sequence
  Synthetic construct
WFIFVDY

SEQ ID NO: 28708 - protein, 7 aa, Artificial Sequence
  Synthetic construct
WFIFVVF

SEQ ID NO: 28709 - protein, 7 aa, Artificial Sequence
  Synthetic construct
WFIFVVY

SEQ ID NO: 28710 - protein, 7 aa, Artificial Sequence
  Synthetic construct
WFIFTFF

SEQ ID NO: 28711 - protein, 7 aa, Artificial Sequence
  Synthetic construct
WFIFTFY

SEQ ID NO: 28712 - protein, 7 aa, Artificial Sequence
  Synthetic construct
WFIFTRF

SEQ ID NO: 28713 - protein, 7 aa, Artificial Sequence
  Synthetic construct
WFIFTRY

SEQ ID NO: 28714 - protein, 7 aa, Artificial Sequence
  Synthetic construct
WFIFTCF

SEQ ID NO: 28715 - protein, 7 aa, Artificial Sequence
  Synthetic construct
WFIFTCY

SEQ ID NO: 28716 - protein, 7 aa, Artificial Sequence
  Synthetic construct
WFIFTLF

SEQ ID NO: 28717 - protein, 7 aa, Artificial Sequence
  Synthetic construct
WFIFTLY

SEQ ID NO: 28718 - protein, 7 aa, Artificial Sequence
  Synthetic construct
WFIFTAF

SEQ ID NO: 28719 - protein, 7 aa, Artificial Sequence
  Synthetic construct
WFIFTAY

SEQ ID NO: 28720 - protein, 7 aa, Artificial Sequence
  Synthetic construct
WFIFTQF

SEQ ID NO: 28721 - protein, 7 aa, Artificial Sequence
  Synthetic construct
WFIFTQY

SEQ ID NO: 28722 - protein, 7 aa, Artificial Sequence
  Synthetic construct
WFIFTDF

SEQ ID NO: 28723 - protein, 7 aa, Artificial Sequence
  Synthetic construct
WFIFTDY

SEQ ID NO: 28724 - protein, 7 aa, Artificial Sequence
  Synthetic construct
WFIFTVF

SEQ ID NO: 28725 - protein, 7 aa, Artificial Sequence
  Synthetic construct
WFIFTVY

SEQ ID NO: 28726 - protein, 7 aa, Artificial Sequence
  Synthetic construct
WFIFGFF

SEQ ID NO: 28727 - protein, 7 aa, Artificial Sequence
  Synthetic construct
WFIFGFY

SEQ ID NO: 28728 - protein, 7 aa, Artificial Sequence
  Synthetic construct
WFIFGRF

SEQ ID NO: 28729 - protein, 7 aa, Artificial Sequence
  Synthetic construct
WFIFGRY

SEQ ID NO: 28730 - protein, 7 aa, Artificial Sequence
  Synthetic construct
WFIFGCF

SEQ ID NO: 28731 - protein, 7 aa, Artificial Sequence
  Synthetic construct
WFIFGCY

SEQ ID NO: 28732 - protein, 7 aa, Artificial Sequence
  Synthetic construct
WFIFGLF

SEQ ID NO: 28733 - protein, 7 aa, Artificial Sequence
  Synthetic construct
WFIFGLY

SEQ ID NO: 28734 - protein, 7 aa, Artificial Sequence
  Synthetic construct
WFIFGAF

SEQ ID NO: 28735 - protein, 7 aa, Artificial Sequence
  Synthetic construct
WFIFGAY

SEQ ID NO: 28736 - protein, 7 aa, Artificial Sequence
  Synthetic construct
WFIFGQF

SEQ ID NO: 28737 - protein, 7 aa, Artificial Sequence
  Synthetic construct
WFIFGQY

SEQ ID NO: 28738 - protein, 7 aa, Artificial Sequence
  Synthetic construct
WFIFGDF

SEQ ID NO: 28739 - protein, 7 aa, Artificial Sequence
  Synthetic construct
WFIFGDY

SEQ ID NO: 28740 - protein, 7 aa, Artificial Sequence
  Synthetic construct
WFIFGVF

SEQ ID NO: 28741 - protein, 7 aa, Artificial Sequence
  Synthetic construct
WFIFGVY

SEQ ID NO: 28742 - protein, 7 aa, Artificial Sequence
  Synthetic construct
WFIFAFF

SEQ ID NO: 28743 - protein, 7 aa, Artificial Sequence
  Synthetic construct
WFIFAFY

SEQ ID NO: 28744 - protein, 7 aa, Artificial Sequence
  Synthetic construct
WFIFARF

SEQ ID NO: 28745 - protein, 7 aa, Artificial Sequence
  Synthetic construct
WFIFARY

SEQ ID NO: 28746 - protein, 7 aa, Artificial Sequence
  Synthetic construct
WFIFACF

SEQ ID NO: 28747 - protein, 7 aa, Artificial Sequence
  Synthetic construct
WFIFACY

SEQ ID NO: 28748 - protein, 7 aa, Artificial Sequence
  Synthetic construct
WFIFALF

SEQ ID NO: 28749 - protein, 7 aa, Artificial Sequence
  Synthetic construct
WFIFALY

SEQ ID NO: 28750 - protein, 7 aa, Artificial Sequence
  Synthetic construct
WFIFAAF

SEQ ID NO: 28751 - protein, 7 aa, Artificial Sequence
  Synthetic construct
WFIFAAY

SEQ ID NO: 28752 - protein, 7 aa, Artificial Sequence
  Synthetic construct
WFIFAQF

SEQ ID NO: 28753 - protein, 7 aa, Artificial Sequence
  Synthetic construct
WFIFAQY

SEQ ID NO: 28754 - protein, 7 aa, Artificial Sequence
  Synthetic construct
WFIFADF

SEQ ID NO: 28755 - protein, 7 aa, Artificial Sequence
  Synthetic construct
WFIFADY

SEQ ID NO: 28756 - protein, 7 aa, Artificial Sequence
  Synthetic construct
WFIFAVF

SEQ ID NO: 28757 - protein, 7 aa, Artificial Sequence
  Synthetic construct
WFIFAVY

SEQ ID NO: 28758 - protein, 7 aa, Artificial Sequence
  Synthetic construct
WFIFQFF

SEQ ID NO: 28759 - protein, 7 aa, Artificial Sequence
  Synthetic construct
WFIFQFY

SEQ ID NO: 28760 - protein, 7 aa, Artificial Sequence
  Synthetic construct
WFIFQRF

SEQ ID NO: 28761 - protein, 7 aa, Artificial Sequence
  Synthetic construct
WFIFQRY

SEQ ID NO: 28762 - protein, 7 aa, Artificial Sequence
  Synthetic construct
WFIFQCF

SEQ ID NO: 28763 - protein, 7 aa, Artificial Sequence
  Synthetic construct
WFIFQCY

SEQ ID NO: 28764 - protein, 7 aa, Artificial Sequence
  Synthetic construct
WFIFQLF

SEQ ID NO: 28765 - protein, 7 aa, Artificial Sequence
  Synthetic construct
WFIFQLY

SEQ ID NO: 28766 - protein, 7 aa, Artificial Sequence
  Synthetic construct
WFIFQAF

SEQ ID NO: 28767 - protein, 7 aa, Artificial Sequence
  Synthetic construct
WFIFQAY

SEQ ID NO: 28768 - protein, 7 aa, Artificial Sequence
  Synthetic construct
WFIFQQF

SEQ ID NO: 28769 - protein, 7 aa, Artificial Sequence
  Synthetic construct
WFIFQQY

SEQ ID NO: 28770 - protein, 7 aa, Artificial Sequence
  Synthetic construct
WFIFQDF

SEQ ID NO: 28771 - protein, 7 aa, Artificial Sequence
  Synthetic construct
WFIFQDY

SEQ ID NO: 28772 - protein, 7 aa, Artificial Sequence
  Synthetic construct
WFIFQVF

SEQ ID NO: 28773 - protein, 7 aa, Artificial Sequence
  Synthetic construct
WFIFQVY

SEQ ID NO: 28774 - protein, 7 aa, Artificial Sequence
  Synthetic construct
WFGYIFF

SEQ ID NO: 28775 - protein, 7 aa, Artificial Sequence
  Synthetic construct
WFGYIFY

SEQ ID NO: 28776 - protein, 7 aa, Artificial Sequence
  Synthetic construct
WFGYIRF

SEQ ID NO: 28777 - protein, 7 aa, Artificial Sequence
  Synthetic construct
WFGYIRY

SEQ ID NO: 28778 - protein, 7 aa, Artificial Sequence
  Synthetic construct
WFGYICF

SEQ ID NO: 28779 - protein, 7 aa, Artificial Sequence
  Synthetic construct
WFGYICY

SEQ ID NO: 28780 - protein, 7 aa, Artificial Sequence
  Synthetic construct
WFGYILF

SEQ ID NO: 28781 - protein, 7 aa, Artificial Sequence
  Synthetic construct
WFGYILY

SEQ ID NO: 28782 - protein, 7 aa, Artificial Sequence
  Synthetic construct
WFGYIAF

SEQ ID NO: 28783 - protein, 7 aa, Artificial Sequence
  Synthetic construct
WFGYIAY

SEQ ID NO: 28784 - protein, 7 aa, Artificial Sequence
  Synthetic construct
WFGYIQF

SEQ ID NO: 28785 - protein, 7 aa, Artificial Sequence
  Synthetic construct
WFGYIQY

SEQ ID NO: 28786 - protein, 7 aa, Artificial Sequence
  Synthetic construct
WFGYIDF

SEQ ID NO: 28787 - protein, 7 aa, Artificial Sequence
  Synthetic construct
WFGYIDY

SEQ ID NO: 28788 - protein, 7 aa, Artificial Sequence
  Synthetic construct
WFGYIVF

SEQ ID NO: 28789 - protein, 7 aa, Artificial Sequence
  Synthetic construct
WFGYIVY

SEQ ID NO: 28790 - protein, 7 aa, Artificial Sequence
  Synthetic construct
WFGYDFF

SEQ ID NO: 28791 - protein, 7 aa, Artificial Sequence
  Synthetic construct
WFGYDFY

SEQ ID NO: 28792 - protein, 7 aa, Artificial Sequence
  Synthetic construct
WFGYDRF

SEQ ID NO: 28793 - protein, 7 aa, Artificial Sequence
  Synthetic construct
WFGYDRY

SEQ ID NO: 28794 - protein, 7 aa, Artificial Sequence
  Synthetic construct
WFGYDCF

SEQ ID NO: 28795 - protein, 7 aa, Artificial Sequence
  Synthetic construct
WFGYDCY

SEQ ID NO: 28796 - protein, 7 aa, Artificial Sequence
  Synthetic construct
WFGYDLF

SEQ ID NO: 28797 - protein, 7 aa, Artificial Sequence
  Synthetic construct
WFGYDLY

SEQ ID NO: 28798 - protein, 7 aa, Artificial Sequence
  Synthetic construct
WFGYDAF

SEQ ID NO: 28799 - protein, 7 aa, Artificial Sequence
  Synthetic construct
WFGYDAY

SEQ ID NO: 28800 - protein, 7 aa, Artificial Sequence
  Synthetic construct
WFGYDQF

SEQ ID NO: 28801 - protein, 7 aa, Artificial Sequence
  Synthetic construct
WFGYDQY

SEQ ID NO: 28802 - protein, 7 aa, Artificial Sequence
  Synthetic construct
WFGYDDF

SEQ ID NO: 28803 - protein, 7 aa, Artificial Sequence
  Synthetic construct
WFGYDDY

SEQ ID NO: 28804 - protein, 7 aa, Artificial Sequence
  Synthetic construct
WFGYDVF

SEQ ID NO: 28805 - protein, 7 aa, Artificial Sequence
  Synthetic construct
WFGYDVY

SEQ ID NO: 28806 - protein, 7 aa, Artificial Sequence
  Synthetic construct
WFGYYFF

SEQ ID NO: 28807 - protein, 7 aa, Artificial Sequence
  Synthetic construct
WFGYYFY

SEQ ID NO: 28808 - protein, 7 aa, Artificial Sequence
  Synthetic construct
WFGYYRF

SEQ ID NO: 28809 - protein, 7 aa, Artificial Sequence
  Synthetic construct
WFGYYRY

SEQ ID NO: 28810 - protein, 7 aa, Artificial Sequence
  Synthetic construct
WFGYYCF

SEQ ID NO: 28811 - protein, 7 aa, Artificial Sequence
  Synthetic construct
WFGYYCY

SEQ ID NO: 28812 - protein, 7 aa, Artificial Sequence
  Synthetic construct
WFGYYLF

SEQ ID NO: 28813 - protein, 7 aa, Artificial Sequence
  Synthetic construct
WFGYYLY

SEQ ID NO: 28814 - protein, 7 aa, Artificial Sequence
  Synthetic construct
WFGYYAF

SEQ ID NO: 28815 - protein, 7 aa, Artificial Sequence
  Synthetic construct
WFGYYAY

SEQ ID NO: 28816 - protein, 7 aa, Artificial Sequence
  Synthetic construct
WFGYYQF

SEQ ID NO: 28817 - protein, 7 aa, Artificial Sequence
  Synthetic construct
WFGYYQY

SEQ ID NO: 28818 - protein, 7 aa, Artificial Sequence
  Synthetic construct
WFGYYDF

SEQ ID NO: 28819 - protein, 7 aa, Artificial Sequence
  Synthetic construct
WFGYYDY

SEQ ID NO: 28820 - protein, 7 aa, Artificial Sequence
  Synthetic construct
WFGYYVF

SEQ ID NO: 28821 - protein, 7 aa, Artificial Sequence
  Synthetic construct
WFGYYVY

SEQ ID NO: 28822 - protein, 7 aa, Artificial Sequence
  Synthetic construct
WFGYFFF

SEQ ID NO: 28823 - protein, 7 aa, Artificial Sequence
  Synthetic construct
WFGYFFY

SEQ ID NO: 28824 - protein, 7 aa, Artificial Sequence
  Synthetic construct
WFGYFRF

SEQ ID NO: 28825 - protein, 7 aa, Artificial Sequence
  Synthetic construct
WFGYFRY

SEQ ID NO: 28826 - protein, 7 aa, Artificial Sequence
  Synthetic construct
WFGYFCF

SEQ ID NO: 28827 - protein, 7 aa, Artificial Sequence
  Synthetic construct
WFGYFCY

SEQ ID NO: 28828 - protein, 7 aa, Artificial Sequence
  Synthetic construct
WFGYFLF

SEQ ID NO: 28829 - protein, 7 aa, Artificial Sequence
  Synthetic construct
WFGYFLY

SEQ ID NO: 28830 - protein, 7 aa, Artificial Sequence
  Synthetic construct
WFGYFAF

SEQ ID NO: 28831 - protein, 7 aa, Artificial Sequence
  Synthetic construct
WFGYFAY

SEQ ID NO: 28832 - protein, 7 aa, Artificial Sequence
  Synthetic construct
WFGYFQF

SEQ ID NO: 28833 - protein, 7 aa, Artificial Sequence
  Synthetic construct
WFGYFQY

SEQ ID NO: 28834 - protein, 7 aa, Artificial Sequence
  Synthetic construct
WFGYFDF

SEQ ID NO: 28835 - protein, 7 aa, Artificial Sequence
  Synthetic construct
WFGYFDY

SEQ ID NO: 28836 - protein, 7 aa, Artificial Sequence
  Synthetic construct
WFGYFVF

SEQ ID NO: 28837 - protein, 7 aa, Artificial Sequence
  Synthetic construct
WFGYFVY

SEQ ID NO: 28838 - protein, 7 aa, Artificial Sequence
  Synthetic construct
WFGYVFF

SEQ ID NO: 28839 - protein, 7 aa, Artificial Sequence
  Synthetic construct
WFGYVFY

SEQ ID NO: 28840 - protein, 7 aa, Artificial Sequence
  Synthetic construct
WFGYVRF

SEQ ID NO: 28841 - protein, 7 aa, Artificial Sequence
  Synthetic construct
WFGYVRY

SEQ ID NO: 28842 - protein, 7 aa, Artificial Sequence
  Synthetic construct
WFGYVCF

SEQ ID NO: 28843 - protein, 7 aa, Artificial Sequence
  Synthetic construct
WFGYVCY

SEQ ID NO: 28844 - protein, 7 aa, Artificial Sequence
  Synthetic construct
WFGYVLF

SEQ ID NO: 28845 - protein, 7 aa, Artificial Sequence
  Synthetic construct
WFGYVLY

SEQ ID NO: 28846 - protein, 7 aa, Artificial Sequence
  Synthetic construct
WFGYVAF

SEQ ID NO: 28847 - protein, 7 aa, Artificial Sequence
  Synthetic construct
WFGYVAY

SEQ ID NO: 28848 - protein, 7 aa, Artificial Sequence
  Synthetic construct
WFGYVQF

SEQ ID NO: 28849 - protein, 7 aa, Artificial Sequence
  Synthetic construct
WFGYVQY

SEQ ID NO: 28850 - protein, 7 aa, Artificial Sequence
  Synthetic construct
WFGYVDF

SEQ ID NO: 28851 - protein, 7 aa, Artificial Sequence
  Synthetic construct
WFGYVDY

SEQ ID NO: 28852 - protein, 7 aa, Artificial Sequence
  Synthetic construct
WFGYVVF

SEQ ID NO: 28853 - protein, 7 aa, Artificial Sequence
  Synthetic construct
WFGYVVY

SEQ ID NO: 28854 - protein, 7 aa, Artificial Sequence
  Synthetic construct
WFGYTFF

SEQ ID NO: 28855 - protein, 7 aa, Artificial Sequence
  Synthetic construct
WFGYTFY

SEQ ID NO: 28856 - protein, 7 aa, Artificial Sequence
  Synthetic construct
WFGYTRF

SEQ ID NO: 28857 - protein, 7 aa, Artificial Sequence
  Synthetic construct
WFGYTRY

SEQ ID NO: 28858 - protein, 7 aa, Artificial Sequence
  Synthetic construct
WFGYTCF

SEQ ID NO: 28859 - protein, 7 aa, Artificial Sequence
  Synthetic construct
WFGYTCY

SEQ ID NO: 28860 - protein, 7 aa, Artificial Sequence
  Synthetic construct
WFGYTLF

SEQ ID NO: 28861 - protein, 7 aa, Artificial Sequence
  Synthetic construct
WFGYTLY

SEQ ID NO: 28862 - protein, 7 aa, Artificial Sequence
  Synthetic construct
WFGYTAF

SEQ ID NO: 28863 - protein, 7 aa, Artificial Sequence
  Synthetic construct
WFGYTAY

SEQ ID NO: 28864 - protein, 7 aa, Artificial Sequence
  Synthetic construct
WFGYTQF

SEQ ID NO: 28865 - protein, 7 aa, Artificial Sequence
  Synthetic construct
WFGYTQY

SEQ ID NO: 28866 - protein, 7 aa, Artificial Sequence
  Synthetic construct
WFGYTDF

SEQ ID NO: 28867 - protein, 7 aa, Artificial Sequence
  Synthetic construct
WFGYTDY

SEQ ID NO: 28868 - protein, 7 aa, Artificial Sequence
  Synthetic construct
WFGYTVF

SEQ ID NO: 28869 - protein, 7 aa, Artificial Sequence
  Synthetic construct
WFGYTVY

SEQ ID NO: 28870 - protein, 7 aa, Artificial Sequence
  Synthetic construct
WFGYGFF

SEQ ID NO: 28871 - protein, 7 aa, Artificial Sequence
  Synthetic construct
WFGYGFY

SEQ ID NO: 28872 - protein, 7 aa, Artificial Sequence
  Synthetic construct
WFGYGRF

SEQ ID NO: 28873 - protein, 7 aa, Artificial Sequence
  Synthetic construct
WFGYGRY

SEQ ID NO: 28874 - protein, 7 aa, Artificial Sequence
  Synthetic construct
WFGYGCF

SEQ ID NO: 28875 - protein, 7 aa, Artificial Sequence
  Synthetic construct
WFGYGCY

SEQ ID NO: 28876 - protein, 7 aa, Artificial Sequence
  Synthetic construct
WFGYGLF

SEQ ID NO: 28877 - protein, 7 aa, Artificial Sequence
  Synthetic construct
WFGYGLY

SEQ ID NO: 28878 - protein, 7 aa, Artificial Sequence
  Synthetic construct
WFGYGAF

SEQ ID NO: 28879 - protein, 7 aa, Artificial Sequence
  Synthetic construct
WFGYGAY

SEQ ID NO: 28880 - protein, 7 aa, Artificial Sequence
  Synthetic construct
WFGYGQF

SEQ ID NO: 28881 - protein, 7 aa, Artificial Sequence
  Synthetic construct
WFGYGQY

SEQ ID NO: 28882 - protein, 7 aa, Artificial Sequence
  Synthetic construct
WFGYGDF

SEQ ID NO: 28883 - protein, 7 aa, Artificial Sequence
  Synthetic construct
WFGYGDY

SEQ ID NO: 28884 - protein, 7 aa, Artificial Sequence
  Synthetic construct
WFGYGVF

SEQ ID NO: 28885 - protein, 7 aa, Artificial Sequence
  Synthetic construct
WFGYGVY

SEQ ID NO: 28886 - protein, 7 aa, Artificial Sequence
  Synthetic construct
WFGYAFF

SEQ ID NO: 28887 - protein, 7 aa, Artificial Sequence
  Synthetic construct
WFGYAFY

SEQ ID NO: 28888 - protein, 7 aa, Artificial Sequence
  Synthetic construct
WFGYARF

SEQ ID NO: 28889 - protein, 7 aa, Artificial Sequence
  Synthetic construct
WFGYARY

SEQ ID NO: 28890 - protein, 7 aa, Artificial Sequence
  Synthetic construct
WFGYACF

SEQ ID NO: 28891 - protein, 7 aa, Artificial Sequence
  Synthetic construct
WFGYACY

SEQ ID NO: 28892 - protein, 7 aa, Artificial Sequence
  Synthetic construct
WFGYALF

SEQ ID NO: 28893 - protein, 7 aa, Artificial Sequence
  Synthetic construct
WFGYALY

SEQ ID NO: 28894 - protein, 7 aa, Artificial Sequence
  Synthetic construct
WFGYAAF

SEQ ID NO: 28895 - protein, 7 aa, Artificial Sequence
  Synthetic construct
WFGYAAY

SEQ ID NO: 28896 - protein, 7 aa, Artificial Sequence
  Synthetic construct
WFGYAQF

SEQ ID NO: 28897 - protein, 7 aa, Artificial Sequence
  Synthetic construct
WFGYAQY

SEQ ID NO: 28898 - protein, 7 aa, Artificial Sequence
  Synthetic construct
WFGYADF

SEQ ID NO: 28899 - protein, 7 aa, Artificial Sequence
  Synthetic construct
WFGYADY

SEQ ID NO: 28900 - protein, 7 aa, Artificial Sequence
  Synthetic construct
WFGYAVF

SEQ ID NO: 28901 - protein, 7 aa, Artificial Sequence
  Synthetic construct
WFGYAVY

SEQ ID NO: 28902 - protein, 7 aa, Artificial Sequence
  Synthetic construct
WFGYQFF

SEQ ID NO: 28903 - protein, 7 aa, Artificial Sequence
  Synthetic construct
WFGYQFY

SEQ ID NO: 28904 - protein, 7 aa, Artificial Sequence
  Synthetic construct
WFGYQRF

SEQ ID NO: 28905 - protein, 7 aa, Artificial Sequence
  Synthetic construct
WFGYQRY

SEQ ID NO: 28906 - protein, 7 aa, Artificial Sequence
  Synthetic construct
WFGYQCF

SEQ ID NO: 28907 - protein, 7 aa, Artificial Sequence
  Synthetic construct
WFGYQCY

SEQ ID NO: 28908 - protein, 7 aa, Artificial Sequence
  Synthetic construct
WFGYQLF

SEQ ID NO: 28909 - protein, 7 aa, Artificial Sequence
  Synthetic construct
WFGYQLY

SEQ ID NO: 28910 - protein, 7 aa, Artificial Sequence
  Synthetic construct
WFGYQAF

SEQ ID NO: 28911 - protein, 7 aa, Artificial Sequence
  Synthetic construct
WFGYQAY

SEQ ID NO: 28912 - protein, 7 aa, Artificial Sequence
  Synthetic construct
WFGYQQF

SEQ ID NO: 28913 - protein, 7 aa, Artificial Sequence
  Synthetic construct
WFGYQQY

SEQ ID NO: 28914 - protein, 7 aa, Artificial Sequence
  Synthetic construct
WFGYQDF

SEQ ID NO: 28915 - protein, 7 aa, Artificial Sequence
  Synthetic construct
WFGYQDY

SEQ ID NO: 28916 - protein, 7 aa, Artificial Sequence
  Synthetic construct
WFGYQVF

SEQ ID NO: 28917 - protein, 7 aa, Artificial Sequence
  Synthetic construct
WFGYQVY

SEQ ID NO: 28918 - protein, 7 aa, Artificial Sequence
  Synthetic construct
WFGPIFF

SEQ ID NO: 28919 - protein, 7 aa, Artificial Sequence
  Synthetic construct
WFGPIFY

SEQ ID NO: 28920 - protein, 7 aa, Artificial Sequence
  Synthetic construct
WFGPIRF

SEQ ID NO: 28921 - protein, 7 aa, Artificial Sequence
  Synthetic construct
WFGPIRY

SEQ ID NO: 28922 - protein, 7 aa, Artificial Sequence
  Synthetic construct
WFGPICF

SEQ ID NO: 28923 - protein, 7 aa, Artificial Sequence
  Synthetic construct
WFGPICY

SEQ ID NO: 28924 - protein, 7 aa, Artificial Sequence
  Synthetic construct
WFGPILF

SEQ ID NO: 28925 - protein, 7 aa, Artificial Sequence
  Synthetic construct
WFGPILY

SEQ ID NO: 28926 - protein, 7 aa, Artificial Sequence
  Synthetic construct
WFGPIAF

SEQ ID NO: 28927 - protein, 7 aa, Artificial Sequence
  Synthetic construct
WFGPIAY

SEQ ID NO: 28928 - protein, 7 aa, Artificial Sequence
  Synthetic construct
WFGPIQF

SEQ ID NO: 28929 - protein, 7 aa, Artificial Sequence
  Synthetic construct
WFGPIQY

SEQ ID NO: 28930 - protein, 7 aa, Artificial Sequence
  Synthetic construct
WFGPIDF

SEQ ID NO: 28931 - protein, 7 aa, Artificial Sequence
  Synthetic construct
WFGPIDY

SEQ ID NO: 28932 - protein, 7 aa, Artificial Sequence
  Synthetic construct
WFGPIVF

SEQ ID NO: 28933 - protein, 7 aa, Artificial Sequence
  Synthetic construct
WFGPIVY

SEQ ID NO: 28934 - protein, 7 aa, Artificial Sequence
  Synthetic construct
WFGPDFF

SEQ ID NO: 28935 - protein, 7 aa, Artificial Sequence
  Synthetic construct
WFGPDFY

SEQ ID NO: 28936 - protein, 7 aa, Artificial Sequence
  Synthetic construct
WFGPDRF

SEQ ID NO: 28937 - protein, 7 aa, Artificial Sequence
  Synthetic construct
WFGPDRY

SEQ ID NO: 28938 - protein, 7 aa, Artificial Sequence
  Synthetic construct
WFGPDCF

SEQ ID NO: 28939 - protein, 7 aa, Artificial Sequence
  Synthetic construct
WFGPDCY

SEQ ID NO: 28940 - protein, 7 aa, Artificial Sequence
  Synthetic construct
WFGPDLF

SEQ ID NO: 28941 - protein, 7 aa, Artificial Sequence
  Synthetic construct
WFGPDLY

SEQ ID NO: 28942 - protein, 7 aa, Artificial Sequence
  Synthetic construct
WFGPDAF

SEQ ID NO: 28943 - protein, 7 aa, Artificial Sequence
  Synthetic construct
WFGPDAY

SEQ ID NO: 28944 - protein, 7 aa, Artificial Sequence
  Synthetic construct
WFGPDQF

SEQ ID NO: 28945 - protein, 7 aa, Artificial Sequence
  Synthetic construct
WFGPDQY

SEQ ID NO: 28946 - protein, 7 aa, Artificial Sequence
  Synthetic construct
WFGPDDF

SEQ ID NO: 28947 - protein, 7 aa, Artificial Sequence
  Synthetic construct
WFGPDDY

SEQ ID NO: 28948 - protein, 7 aa, Artificial Sequence
  Synthetic construct
WFGPDVF

SEQ ID NO: 28949 - protein, 7 aa, Artificial Sequence
  Synthetic construct
WFGPDVY

SEQ ID NO: 28950 - protein, 7 aa, Artificial Sequence
  Synthetic construct
WFGPYFF

SEQ ID NO: 28951 - protein, 7 aa, Artificial Sequence
  Synthetic construct
WFGPYFY

SEQ ID NO: 28952 - protein, 7 aa, Artificial Sequence
  Synthetic construct
WFGPYRF

SEQ ID NO: 28953 - protein, 7 aa, Artificial Sequence
  Synthetic construct
WFGPYRY

SEQ ID NO: 28954 - protein, 7 aa, Artificial Sequence
  Synthetic construct
WFGPYCF

SEQ ID NO: 28955 - protein, 7 aa, Artificial Sequence
  Synthetic construct
WFGPYCY

SEQ ID NO: 28956 - protein, 7 aa, Artificial Sequence
  Synthetic construct
WFGPYLF

SEQ ID NO: 28957 - protein, 7 aa, Artificial Sequence
  Synthetic construct
WFGPYLY

SEQ ID NO: 28958 - protein, 7 aa, Artificial Sequence
  Synthetic construct
WFGPYAF

SEQ ID NO: 28959 - protein, 7 aa, Artificial Sequence
  Synthetic construct
WFGPYAY

SEQ ID NO: 28960 - protein, 7 aa, Artificial Sequence
  Synthetic construct
WFGPYQF

SEQ ID NO: 28961 - protein, 7 aa, Artificial Sequence
  Synthetic construct
WFGPYQY

SEQ ID NO: 28962 - protein, 7 aa, Artificial Sequence
  Synthetic construct
WFGPYDF

SEQ ID NO: 28963 - protein, 7 aa, Artificial Sequence
  Synthetic construct
WFGPYDY

SEQ ID NO: 28964 - protein, 7 aa, Artificial Sequence
  Synthetic construct
WFGPYVF

SEQ ID NO: 28965 - protein, 7 aa, Artificial Sequence
  Synthetic construct
WFGPYVY

SEQ ID NO: 28966 - protein, 7 aa, Artificial Sequence
  Synthetic construct
WFGPFFF

SEQ ID NO: 28967 - protein, 7 aa, Artificial Sequence
  Synthetic construct
WFGPFFY

SEQ ID NO: 28968 - protein, 7 aa, Artificial Sequence
  Synthetic construct
WFGPFRF

SEQ ID NO: 28969 - protein, 7 aa, Artificial Sequence
  Synthetic construct
WFGPFRY

SEQ ID NO: 28970 - protein, 7 aa, Artificial Sequence
  Synthetic construct
WFGPFCF

SEQ ID NO: 28971 - protein, 7 aa, Artificial Sequence
  Synthetic construct
WFGPFCY

SEQ ID NO: 28972 - protein, 7 aa, Artificial Sequence
  Synthetic construct
WFGPFLF

SEQ ID NO: 28973 - protein, 7 aa, Artificial Sequence
  Synthetic construct
WFGPFLY

SEQ ID NO: 28974 - protein, 7 aa, Artificial Sequence
  Synthetic construct
WFGPFAF

SEQ ID NO: 28975 - protein, 7 aa, Artificial Sequence
  Synthetic construct
WFGPFAY

SEQ ID NO: 28976 - protein, 7 aa, Artificial Sequence
  Synthetic construct
WFGPFQF

SEQ ID NO: 28977 - protein, 7 aa, Artificial Sequence
  Synthetic construct
WFGPFQY

SEQ ID NO: 28978 - protein, 7 aa, Artificial Sequence
  Synthetic construct
WFGPFDF

SEQ ID NO: 28979 - protein, 7 aa, Artificial Sequence
  Synthetic construct
WFGPFDY

SEQ ID NO: 28980 - protein, 7 aa, Artificial Sequence
  Synthetic construct
WFGPFVF

SEQ ID NO: 28981 - protein, 7 aa, Artificial Sequence
  Synthetic construct
WFGPFVY

SEQ ID NO: 28982 - protein, 7 aa, Artificial Sequence
  Synthetic construct
WFGPVFF

SEQ ID NO: 28983 - protein, 7 aa, Artificial Sequence
  Synthetic construct
WFGPVFY

SEQ ID NO: 28984 - protein, 7 aa, Artificial Sequence
  Synthetic construct
WFGPVRF

SEQ ID NO: 28985 - protein, 7 aa, Artificial Sequence
  Synthetic construct
WFGPVRY

SEQ ID NO: 28986 - protein, 7 aa, Artificial Sequence
  Synthetic construct
WFGPVCF

SEQ ID NO: 28987 - protein, 7 aa, Artificial Sequence
  Synthetic construct
WFGPVCY

SEQ ID NO: 28988 - protein, 7 aa, Artificial Sequence
  Synthetic construct
WFGPVLF

SEQ ID NO: 28989 - protein, 7 aa, Artificial Sequence
  Synthetic construct
WFGPVLY

SEQ ID NO: 28990 - protein, 7 aa, Artificial Sequence
  Synthetic construct
WFGPVAF

SEQ ID NO: 28991 - protein, 7 aa, Artificial Sequence
  Synthetic construct
WFGPVAY

SEQ ID NO: 28992 - protein, 7 aa, Artificial Sequence
  Synthetic construct
WFGPVQF

SEQ ID NO: 28993 - protein, 7 aa, Artificial Sequence
  Synthetic construct
WFGPVQY

SEQ ID NO: 28994 - protein, 7 aa, Artificial Sequence
  Synthetic construct
WFGPVDF

SEQ ID NO: 28995 - protein, 7 aa, Artificial Sequence
  Synthetic construct
WFGPVDY

SEQ ID NO: 28996 - protein, 7 aa, Artificial Sequence
  Synthetic construct
WFGPVVF

SEQ ID NO: 28997 - protein, 7 aa, Artificial Sequence
  Synthetic construct
WFGPVVY

SEQ ID NO: 28998 - protein, 7 aa, Artificial Sequence
  Synthetic construct
WFGPTFF

SEQ ID NO: 28999 - protein, 7 aa, Artificial Sequence
  Synthetic construct
WFGPTFY

SEQ ID NO: 29000 - protein, 7 aa, Artificial Sequence
  Synthetic construct
WFGPTRF

SEQ ID NO: 29001 - protein, 7 aa, Artificial Sequence
  Synthetic construct
WFGPTRY

SEQ ID NO: 29002 - protein, 7 aa, Artificial Sequence
  Synthetic construct
WFGPTCF

SEQ ID NO: 29003 - protein, 7 aa, Artificial Sequence
  Synthetic construct
WFGPTCY

SEQ ID NO: 29004 - protein, 7 aa, Artificial Sequence
  Synthetic construct
WFGPTLF

SEQ ID NO: 29005 - protein, 7 aa, Artificial Sequence
  Synthetic construct
WFGPTLY

SEQ ID NO: 29006 - protein, 7 aa, Artificial Sequence
  Synthetic construct
WFGPTAF

SEQ ID NO: 29007 - protein, 7 aa, Artificial Sequence
  Synthetic construct
WFGPTAY

SEQ ID NO: 29008 - protein, 7 aa, Artificial Sequence
  Synthetic construct
WFGPTQF

SEQ ID NO: 29009 - protein, 7 aa, Artificial Sequence
  Synthetic construct
WFGPTQY

SEQ ID NO: 29010 - protein, 7 aa, Artificial Sequence
  Synthetic construct
WFGPTDF

SEQ ID NO: 29011 - protein, 7 aa, Artificial Sequence
  Synthetic construct
WFGPTDY

SEQ ID NO: 29012 - protein, 7 aa, Artificial Sequence
  Synthetic construct
WFGPTVF

SEQ ID NO: 29013 - protein, 7 aa, Artificial Sequence
  Synthetic construct
WFGPTVY

SEQ ID NO: 29014 - protein, 7 aa, Artificial Sequence
  Synthetic construct
WFGPGFF

SEQ ID NO: 29015 - protein, 7 aa, Artificial Sequence
  Synthetic construct
WFGPGFY

SEQ ID NO: 29016 - protein, 7 aa, Artificial Sequence
  Synthetic construct
WFGPGRF

SEQ ID NO: 29017 - protein, 7 aa, Artificial Sequence
  Synthetic construct
WFGPGRY

SEQ ID NO: 29018 - protein, 7 aa, Artificial Sequence
  Synthetic construct
WFGPGCF

SEQ ID NO: 29019 - protein, 7 aa, Artificial Sequence
  Synthetic construct
WFGPGCY

SEQ ID NO: 29020 - protein, 7 aa, Artificial Sequence
  Synthetic construct
WFGPGLF

SEQ ID NO: 29021 - protein, 7 aa, Artificial Sequence
  Synthetic construct
WFGPGLY

SEQ ID NO: 29022 - protein, 7 aa, Artificial Sequence
  Synthetic construct
WFGPGAF

SEQ ID NO: 29023 - protein, 7 aa, Artificial Sequence
  Synthetic construct
WFGPGAY

SEQ ID NO: 29024 - protein, 7 aa, Artificial Sequence
  Synthetic construct
WFGPGQF

SEQ ID NO: 29025 - protein, 7 aa, Artificial Sequence
  Synthetic construct
WFGPGQY

SEQ ID NO: 29026 - protein, 7 aa, Artificial Sequence
  Synthetic construct
WFGPGDF

SEQ ID NO: 29027 - protein, 7 aa, Artificial Sequence
  Synthetic construct
WFGPGDY

SEQ ID NO: 29028 - protein, 7 aa, Artificial Sequence
  Synthetic construct
WFGPGVF

SEQ ID NO: 29029 - protein, 7 aa, Artificial Sequence
  Synthetic construct
WFGPGVY

SEQ ID NO: 29030 - protein, 7 aa, Artificial Sequence
  Synthetic construct
WFGPAFF

SEQ ID NO: 29031 - protein, 7 aa, Artificial Sequence
  Synthetic construct
WFGPAFY

SEQ ID NO: 29032 - protein, 7 aa, Artificial Sequence
  Synthetic construct
WFGPARF

SEQ ID NO: 29033 - protein, 7 aa, Artificial Sequence
  Synthetic construct
WFGPARY

SEQ ID NO: 29034 - protein, 7 aa, Artificial Sequence
  Synthetic construct
WFGPACF

SEQ ID NO: 29035 - protein, 7 aa, Artificial Sequence
  Synthetic construct
WFGPACY

SEQ ID NO: 29036 - protein, 7 aa, Artificial Sequence
  Synthetic construct
WFGPALF

SEQ ID NO: 29037 - protein, 7 aa, Artificial Sequence
  Synthetic construct
WFGPALY

SEQ ID NO: 29038 - protein, 7 aa, Artificial Sequence
  Synthetic construct
WFGPAAF

SEQ ID NO: 29039 - protein, 7 aa, Artificial Sequence
  Synthetic construct
WFGPAAY

SEQ ID NO: 29040 - protein, 7 aa, Artificial Sequence
  Synthetic construct
WFGPAQF

SEQ ID NO: 29041 - protein, 7 aa, Artificial Sequence
  Synthetic construct
WFGPAQY

SEQ ID NO: 29042 - protein, 7 aa, Artificial Sequence
  Synthetic construct
WFGPADF

SEQ ID NO: 29043 - protein, 7 aa, Artificial Sequence
  Synthetic construct
WFGPADY

SEQ ID NO: 29044 - protein, 7 aa, Artificial Sequence
  Synthetic construct
WFGPAVF

SEQ ID NO: 29045 - protein, 7 aa, Artificial Sequence
  Synthetic construct
WFGPAVY

SEQ ID NO: 29046 - protein, 7 aa, Artificial Sequence
  Synthetic construct
WFGPQFF

SEQ ID NO: 29047 - protein, 7 aa, Artificial Sequence
  Synthetic construct
WFGPQFY

SEQ ID NO: 29048 - protein, 7 aa, Artificial Sequence
  Synthetic construct
WFGPQRF

SEQ ID NO: 29049 - protein, 7 aa, Artificial Sequence
  Synthetic construct
WFGPQRY

SEQ ID NO: 29050 - protein, 7 aa, Artificial Sequence
  Synthetic construct
WFGPQCF

SEQ ID NO: 29051 - protein, 7 aa, Artificial Sequence
  Synthetic construct
WFGPQCY

SEQ ID NO: 29052 - protein, 7 aa, Artificial Sequence
  Synthetic construct
WFGPQLF

SEQ ID NO: 29053 - protein, 7 aa, Artificial Sequence
  Synthetic construct
WFGPQLY

SEQ ID NO: 29054 - protein, 7 aa, Artificial Sequence
  Synthetic construct
WFGPQAF

SEQ ID NO: 29055 - protein, 7 aa, Artificial Sequence
  Synthetic construct
WFGPQAY

SEQ ID NO: 29056 - protein, 7 aa, Artificial Sequence
  Synthetic construct
WFGPQQF

SEQ ID NO: 29057 - protein, 7 aa, Artificial Sequence
  Synthetic construct
WFGPQQY

SEQ ID NO: 29058 - protein, 7 aa, Artificial Sequence
  Synthetic construct
WFGPQDF

SEQ ID NO: 29059 - protein, 7 aa, Artificial Sequence
  Synthetic construct
WFGPQDY

SEQ ID NO: 29060 - protein, 7 aa, Artificial Sequence
  Synthetic construct
WFGPQVF

SEQ ID NO: 29061 - protein, 7 aa, Artificial Sequence
  Synthetic construct
WFGPQVY

SEQ ID NO: 29062 - protein, 7 aa, Artificial Sequence
  Synthetic construct
WFGHIFF

SEQ ID NO: 29063 - protein, 7 aa, Artificial Sequence
  Synthetic construct
WFGHIFY

SEQ ID NO: 29064 - protein, 7 aa, Artificial Sequence
  Synthetic construct
WFGHIRF

SEQ ID NO: 29065 - protein, 7 aa, Artificial Sequence
  Synthetic construct
WFGHIRY

SEQ ID NO: 29066 - protein, 7 aa, Artificial Sequence
  Synthetic construct
WFGHICF

SEQ ID NO: 29067 - protein, 7 aa, Artificial Sequence
  Synthetic construct
WFGHICY

SEQ ID NO: 29068 - protein, 7 aa, Artificial Sequence
  Synthetic construct
WFGHILF

SEQ ID NO: 29069 - protein, 7 aa, Artificial Sequence
  Synthetic construct
WFGHILY

SEQ ID NO: 29070 - protein, 7 aa, Artificial Sequence
  Synthetic construct
WFGHIAF

SEQ ID NO: 29071 - protein, 7 aa, Artificial Sequence
  Synthetic construct
WFGHIAY

SEQ ID NO: 29072 - protein, 7 aa, Artificial Sequence
  Synthetic construct
WFGHIQF

SEQ ID NO: 29073 - protein, 7 aa, Artificial Sequence
  Synthetic construct
WFGHIQY

SEQ ID NO: 29074 - protein, 7 aa, Artificial Sequence
  Synthetic construct
WFGHIDF

SEQ ID NO: 29075 - protein, 7 aa, Artificial Sequence
  Synthetic construct
WFGHIDY

SEQ ID NO: 29076 - protein, 7 aa, Artificial Sequence
  Synthetic construct
WFGHIVF

SEQ ID NO: 29077 - protein, 7 aa, Artificial Sequence
  Synthetic construct
WFGHIVY

SEQ ID NO: 29078 - protein, 7 aa, Artificial Sequence
  Synthetic construct
WFGHDFF

SEQ ID NO: 29079 - protein, 7 aa, Artificial Sequence
  Synthetic construct
WFGHDFY

SEQ ID NO: 29080 - protein, 7 aa, Artificial Sequence
  Synthetic construct
WFGHDRF

SEQ ID NO: 29081 - protein, 7 aa, Artificial Sequence
  Synthetic construct
WFGHDRY

SEQ ID NO: 29082 - protein, 7 aa, Artificial Sequence
  Synthetic construct
WFGHDCF

SEQ ID NO: 29083 - protein, 7 aa, Artificial Sequence
  Synthetic construct
WFGHDCY

SEQ ID NO: 29084 - protein, 7 aa, Artificial Sequence
  Synthetic construct
WFGHDLF

SEQ ID NO: 29085 - protein, 7 aa, Artificial Sequence
  Synthetic construct
WFGHDLY

SEQ ID NO: 29086 - protein, 7 aa, Artificial Sequence
  Synthetic construct
WFGHDAF

SEQ ID NO: 29087 - protein, 7 aa, Artificial Sequence
  Synthetic construct
WFGHDAY

SEQ ID NO: 29088 - protein, 7 aa, Artificial Sequence
  Synthetic construct
WFGHDQF

SEQ ID NO: 29089 - protein, 7 aa, Artificial Sequence
  Synthetic construct
WFGHDQY

SEQ ID NO: 29090 - protein, 7 aa, Artificial Sequence
  Synthetic construct
WFGHDDF

SEQ ID NO: 29091 - protein, 7 aa, Artificial Sequence
  Synthetic construct
WFGHDDY

SEQ ID NO: 29092 - protein, 7 aa, Artificial Sequence
  Synthetic construct
WFGHDVF

SEQ ID NO: 29093 - protein, 7 aa, Artificial Sequence
  Synthetic construct
WFGHDVY

SEQ ID NO: 29094 - protein, 7 aa, Artificial Sequence
  Synthetic construct
WFGHYFF

SEQ ID NO: 29095 - protein, 7 aa, Artificial Sequence
  Synthetic construct
WFGHYFY

SEQ ID NO: 29096 - protein, 7 aa, Artificial Sequence
  Synthetic construct
WFGHYRF

SEQ ID NO: 29097 - protein, 7 aa, Artificial Sequence
  Synthetic construct
WFGHYRY

SEQ ID NO: 29098 - protein, 7 aa, Artificial Sequence
  Synthetic construct
WFGHYCF

SEQ ID NO: 29099 - protein, 7 aa, Artificial Sequence
  Synthetic construct
WFGHYCY

SEQ ID NO: 29100 - protein, 7 aa, Artificial Sequence
  Synthetic construct
WFGHYLF

SEQ ID NO: 29101 - protein, 7 aa, Artificial Sequence
  Synthetic construct
WFGHYLY

SEQ ID NO: 29102 - protein, 7 aa, Artificial Sequence
  Synthetic construct
WFGHYAF

SEQ ID NO: 29103 - protein, 7 aa, Artificial Sequence
  Synthetic construct
WFGHYAY

SEQ ID NO: 29104 - protein, 7 aa, Artificial Sequence
  Synthetic construct
WFGHYQF

SEQ ID NO: 29105 - protein, 7 aa, Artificial Sequence
  Synthetic construct
WFGHYQY

SEQ ID NO: 29106 - protein, 7 aa, Artificial Sequence
  Synthetic construct
WFGHYDF

SEQ ID NO: 29107 - protein, 7 aa, Artificial Sequence
  Synthetic construct
WFGHYDY

SEQ ID NO: 29108 - protein, 7 aa, Artificial Sequence
  Synthetic construct
WFGHYVF

SEQ ID NO: 29109 - protein, 7 aa, Artificial Sequence
  Synthetic construct
WFGHYVY

SEQ ID NO: 29110 - protein, 7 aa, Artificial Sequence
  Synthetic construct
WFGHFFF

SEQ ID NO: 29111 - protein, 7 aa, Artificial Sequence
  Synthetic construct
WFGHFFY

SEQ ID NO: 29112 - protein, 7 aa, Artificial Sequence
  Synthetic construct
WFGHFRF

SEQ ID NO: 29113 - protein, 7 aa, Artificial Sequence
  Synthetic construct
WFGHFRY

SEQ ID NO: 29114 - protein, 7 aa, Artificial Sequence
  Synthetic construct
WFGHFCF

SEQ ID NO: 29115 - protein, 7 aa, Artificial Sequence
  Synthetic construct
WFGHFCY

SEQ ID NO: 29116 - protein, 7 aa, Artificial Sequence
  Synthetic construct
WFGHFLF

SEQ ID NO: 29117 - protein, 7 aa, Artificial Sequence
  Synthetic construct
WFGHFLY

SEQ ID NO: 29118 - protein, 7 aa, Artificial Sequence
  Synthetic construct
WFGHFAF

SEQ ID NO: 29119 - protein, 7 aa, Artificial Sequence
  Synthetic construct
WFGHFAY

SEQ ID NO: 29120 - protein, 7 aa, Artificial Sequence
  Synthetic construct
WFGHFQF

SEQ ID NO: 29121 - protein, 7 aa, Artificial Sequence
  Synthetic construct
WFGHFQY

SEQ ID NO: 29122 - protein, 7 aa, Artificial Sequence
  Synthetic construct
WFGHFDF

SEQ ID NO: 29123 - protein, 7 aa, Artificial Sequence
  Synthetic construct
WFGHFDY

SEQ ID NO: 29124 - protein, 7 aa, Artificial Sequence
  Synthetic construct
WFGHFVF

SEQ ID NO: 29125 - protein, 7 aa, Artificial Sequence
  Synthetic construct
WFGHFVY

SEQ ID NO: 29126 - protein, 7 aa, Artificial Sequence
  Synthetic construct
WFGHVFF

SEQ ID NO: 29127 - protein, 7 aa, Artificial Sequence
  Synthetic construct
WFGHVFY

SEQ ID NO: 29128 - protein, 7 aa, Artificial Sequence
  Synthetic construct
WFGHVRF

SEQ ID NO: 29129 - protein, 7 aa, Artificial Sequence
  Synthetic construct
WFGHVRY

SEQ ID NO: 29130 - protein, 7 aa, Artificial Sequence
  Synthetic construct
WFGHVCF

SEQ ID NO: 29131 - protein, 7 aa, Artificial Sequence
  Synthetic construct
WFGHVCY

SEQ ID NO: 29132 - protein, 7 aa, Artificial Sequence
  Synthetic construct
WFGHVLF

SEQ ID NO: 29133 - protein, 7 aa, Artificial Sequence
  Synthetic construct
WFGHVLY

SEQ ID NO: 29134 - protein, 7 aa, Artificial Sequence
  Synthetic construct
WFGHVAF

SEQ ID NO: 29135 - protein, 7 aa, Artificial Sequence
  Synthetic construct
WFGHVAY

SEQ ID NO: 29136 - protein, 7 aa, Artificial Sequence
  Synthetic construct
WFGHVQF

SEQ ID NO: 29137 - protein, 7 aa, Artificial Sequence
  Synthetic construct
WFGHVQY

SEQ ID NO: 29138 - protein, 7 aa, Artificial Sequence
  Synthetic construct
WFGHVDF

SEQ ID NO: 29139 - protein, 7 aa, Artificial Sequence
  Synthetic construct
WFGHVDY

SEQ ID NO: 29140 - protein, 7 aa, Artificial Sequence
  Synthetic construct
WFGHVVF

SEQ ID NO: 29141 - protein, 7 aa, Artificial Sequence
  Synthetic construct
WFGHVVY

SEQ ID NO: 29142 - protein, 7 aa, Artificial Sequence
  Synthetic construct
WFGHTFF

SEQ ID NO: 29143 - protein, 7 aa, Artificial Sequence
  Synthetic construct
WFGHTFY

SEQ ID NO: 29144 - protein, 7 aa, Artificial Sequence
  Synthetic construct
WFGHTRF

SEQ ID NO: 29145 - protein, 7 aa, Artificial Sequence
  Synthetic construct
WFGHTRY

SEQ ID NO: 29146 - protein, 7 aa, Artificial Sequence
  Synthetic construct
WFGHTCF

SEQ ID NO: 29147 - protein, 7 aa, Artificial Sequence
  Synthetic construct
WFGHTCY

SEQ ID NO: 29148 - protein, 7 aa, Artificial Sequence
  Synthetic construct
WFGHTLF

SEQ ID NO: 29149 - protein, 7 aa, Artificial Sequence
  Synthetic construct
WFGHTLY

SEQ ID NO: 29150 - protein, 7 aa, Artificial Sequence
  Synthetic construct
WFGHTAF

SEQ ID NO: 29151 - protein, 7 aa, Artificial Sequence
  Synthetic construct
WFGHTAY

SEQ ID NO: 29152 - protein, 7 aa, Artificial Sequence
  Synthetic construct
WFGHTQF

SEQ ID NO: 29153 - protein, 7 aa, Artificial Sequence
  Synthetic construct
WFGHTQY

SEQ ID NO: 29154 - protein, 7 aa, Artificial Sequence
  Synthetic construct
WFGHTDF

SEQ ID NO: 29155 - protein, 7 aa, Artificial Sequence
  Synthetic construct
WFGHTDY

SEQ ID NO: 29156 - protein, 7 aa, Artificial Sequence
  Synthetic construct
WFGHTVF

SEQ ID NO: 29157 - protein, 7 aa, Artificial Sequence
  Synthetic construct
WFGHTVY

SEQ ID NO: 29158 - protein, 7 aa, Artificial Sequence
  Synthetic construct
WFGHGFF

SEQ ID NO: 29159 - protein, 7 aa, Artificial Sequence
  Synthetic construct
WFGHGFY

SEQ ID NO: 29160 - protein, 7 aa, Artificial Sequence
  Synthetic construct
WFGHGRF

SEQ ID NO: 29161 - protein, 7 aa, Artificial Sequence
  Synthetic construct
WFGHGRY

SEQ ID NO: 29162 - protein, 7 aa, Artificial Sequence
  Synthetic construct
WFGHGCF

SEQ ID NO: 29163 - protein, 7 aa, Artificial Sequence
  Synthetic construct
WFGHGCY

SEQ ID NO: 29164 - protein, 7 aa, Artificial Sequence
  Synthetic construct
WFGHGLF

SEQ ID NO: 29165 - protein, 7 aa, Artificial Sequence
  Synthetic construct
WFGHGLY

SEQ ID NO: 29166 - protein, 7 aa, Artificial Sequence
  Synthetic construct
WFGHGAF

SEQ ID NO: 29167 - protein, 7 aa, Artificial Sequence
  Synthetic construct
WFGHGAY

SEQ ID NO: 29168 - protein, 7 aa, Artificial Sequence
  Synthetic construct
WFGHGQF

SEQ ID NO: 29169 - protein, 7 aa, Artificial Sequence
  Synthetic construct
WFGHGQY

SEQ ID NO: 29170 - protein, 7 aa, Artificial Sequence
  Synthetic construct
WFGHGDF

SEQ ID NO: 29171 - protein, 7 aa, Artificial Sequence
  Synthetic construct
WFGHGDY

SEQ ID NO: 29172 - protein, 7 aa, Artificial Sequence
  Synthetic construct
WFGHGVF

SEQ ID NO: 29173 - protein, 7 aa, Artificial Sequence
  Synthetic construct
WFGHGVY

SEQ ID NO: 29174 - protein, 7 aa, Artificial Sequence
  Synthetic construct
WFGHAFF

SEQ ID NO: 29175 - protein, 7 aa, Artificial Sequence
  Synthetic construct
WFGHAFY

SEQ ID NO: 29176 - protein, 7 aa, Artificial Sequence
  Synthetic construct
WFGHARF

SEQ ID NO: 29177 - protein, 7 aa, Artificial Sequence
  Synthetic construct
WFGHARY

SEQ ID NO: 29178 - protein, 7 aa, Artificial Sequence
  Synthetic construct
WFGHACF

SEQ ID NO: 29179 - protein, 7 aa, Artificial Sequence
  Synthetic construct
WFGHACY

SEQ ID NO: 29180 - protein, 7 aa, Artificial Sequence
  Synthetic construct
WFGHALF

SEQ ID NO: 29181 - protein, 7 aa, Artificial Sequence
  Synthetic construct
WFGHALY

SEQ ID NO: 29182 - protein, 7 aa, Artificial Sequence
  Synthetic construct
WFGHAAF

SEQ ID NO: 29183 - protein, 7 aa, Artificial Sequence
  Synthetic construct
WFGHAAY

SEQ ID NO: 29184 - protein, 7 aa, Artificial Sequence
  Synthetic construct
WFGHAQF

SEQ ID NO: 29185 - protein, 7 aa, Artificial Sequence
  Synthetic construct
WFGHAQY

SEQ ID NO: 29186 - protein, 7 aa, Artificial Sequence
  Synthetic construct
WFGHADF

SEQ ID NO: 29187 - protein, 7 aa, Artificial Sequence
  Synthetic construct
WFGHADY

SEQ ID NO: 29188 - protein, 7 aa, Artificial Sequence
  Synthetic construct
WFGHAVF

SEQ ID NO: 29189 - protein, 7 aa, Artificial Sequence
  Synthetic construct
WFGHAVY

SEQ ID NO: 29190 - protein, 7 aa, Artificial Sequence
  Synthetic construct
WFGHQFF

SEQ ID NO: 29191 - protein, 7 aa, Artificial Sequence
  Synthetic construct
WFGHQFY

SEQ ID NO: 29192 - protein, 7 aa, Artificial Sequence
  Synthetic construct
WFGHQRF

SEQ ID NO: 29193 - protein, 7 aa, Artificial Sequence
  Synthetic construct
WFGHQRY

SEQ ID NO: 29194 - protein, 7 aa, Artificial Sequence
  Synthetic construct
WFGHQCF

SEQ ID NO: 29195 - protein, 7 aa, Artificial Sequence
  Synthetic construct
WFGHQCY

SEQ ID NO: 29196 - protein, 7 aa, Artificial Sequence
  Synthetic construct
WFGHQLF

SEQ ID NO: 29197 - protein, 7 aa, Artificial Sequence
  Synthetic construct
WFGHQLY

SEQ ID NO: 29198 - protein, 7 aa, Artificial Sequence
  Synthetic construct
WFGHQAF

SEQ ID NO: 29199 - protein, 7 aa, Artificial Sequence
  Synthetic construct
WFGHQAY

SEQ ID NO: 29200 - protein, 7 aa, Artificial Sequence
  Synthetic construct
WFGHQQF

SEQ ID NO: 29201 - protein, 7 aa, Artificial Sequence
  Synthetic construct
WFGHQQY

SEQ ID NO: 29202 - protein, 7 aa, Artificial Sequence
  Synthetic construct
WFGHQDF

SEQ ID NO: 29203 - protein, 7 aa, Artificial Sequence
  Synthetic construct
WFGHQDY

SEQ ID NO: 29204 - protein, 7 aa, Artificial Sequence
  Synthetic construct
WFGHQVF

SEQ ID NO: 29205 - protein, 7 aa, Artificial Sequence
  Synthetic construct
WFGHQVY

SEQ ID NO: 29206 - protein, 7 aa, Artificial Sequence
  Synthetic construct
WFGLIFF

SEQ ID NO: 29207 - protein, 7 aa, Artificial Sequence
  Synthetic construct
WFGLIFY

SEQ ID NO: 29208 - protein, 7 aa, Artificial Sequence
  Synthetic construct
WFGLIRF

SEQ ID NO: 29209 - protein, 7 aa, Artificial Sequence
  Synthetic construct
WFGLIRY

SEQ ID NO: 29210 - protein, 7 aa, Artificial Sequence
  Synthetic construct
WFGLICF

SEQ ID NO: 29211 - protein, 7 aa, Artificial Sequence
  Synthetic construct
WFGLICY

SEQ ID NO: 29212 - protein, 7 aa, Artificial Sequence
  Synthetic construct
WFGLILF

SEQ ID NO: 29213 - protein, 7 aa, Artificial Sequence
  Synthetic construct
WFGLILY

SEQ ID NO: 29214 - protein, 7 aa, Artificial Sequence
  Synthetic construct
WFGLIAF

SEQ ID NO: 29215 - protein, 7 aa, Artificial Sequence
  Synthetic construct
WFGLIAY

SEQ ID NO: 29216 - protein, 7 aa, Artificial Sequence
  Synthetic construct
WFGLIQF

SEQ ID NO: 29217 - protein, 7 aa, Artificial Sequence
  Synthetic construct
WFGLIQY

SEQ ID NO: 29218 - protein, 7 aa, Artificial Sequence
  Synthetic construct
WFGLIDF

SEQ ID NO: 29219 - protein, 7 aa, Artificial Sequence
  Synthetic construct
WFGLIDY

SEQ ID NO: 29220 - protein, 7 aa, Artificial Sequence
  Synthetic construct
WFGLIVF

SEQ ID NO: 29221 - protein, 7 aa, Artificial Sequence
  Synthetic construct
WFGLIVY

SEQ ID NO: 29222 - protein, 7 aa, Artificial Sequence
  Synthetic construct
WFGLDFF

SEQ ID NO: 29223 - protein, 7 aa, Artificial Sequence
  Synthetic construct
WFGLDFY

SEQ ID NO: 29224 - protein, 7 aa, Artificial Sequence
  Synthetic construct
WFGLDRF

SEQ ID NO: 29225 - protein, 7 aa, Artificial Sequence
  Synthetic construct
WFGLDRY

SEQ ID NO: 29226 - protein, 7 aa, Artificial Sequence
  Synthetic construct
WFGLDCF

SEQ ID NO: 29227 - protein, 7 aa, Artificial Sequence
  Synthetic construct
WFGLDCY

SEQ ID NO: 29228 - protein, 7 aa, Artificial Sequence
  Synthetic construct
WFGLDLF

SEQ ID NO: 29229 - protein, 7 aa, Artificial Sequence
  Synthetic construct
WFGLDLY

SEQ ID NO: 29230 - protein, 7 aa, Artificial Sequence
  Synthetic construct
WFGLDAF

SEQ ID NO: 29231 - protein, 7 aa, Artificial Sequence
  Synthetic construct
WFGLDAY

SEQ ID NO: 29232 - protein, 7 aa, Artificial Sequence
  Synthetic construct
WFGLDQF

SEQ ID NO: 29233 - protein, 7 aa, Artificial Sequence
  Synthetic construct
WFGLDQY

SEQ ID NO: 29234 - protein, 7 aa, Artificial Sequence
  Synthetic construct
WFGLDDF

SEQ ID NO: 29235 - protein, 7 aa, Artificial Sequence
  Synthetic construct
WFGLDDY

SEQ ID NO: 29236 - protein, 7 aa, Artificial Sequence
  Synthetic construct
WFGLDVF

SEQ ID NO: 29237 - protein, 7 aa, Artificial Sequence
  Synthetic construct
WFGLDVY

SEQ ID NO: 29238 - protein, 7 aa, Artificial Sequence
  Synthetic construct
WFGLYFF

SEQ ID NO: 29239 - protein, 7 aa, Artificial Sequence
  Synthetic construct
WFGLYFY

SEQ ID NO: 29240 - protein, 7 aa, Artificial Sequence
  Synthetic construct
WFGLYRF

SEQ ID NO: 29241 - protein, 7 aa, Artificial Sequence
  Synthetic construct
WFGLYRY

SEQ ID NO: 29242 - protein, 7 aa, Artificial Sequence
  Synthetic construct
WFGLYCF

SEQ ID NO: 29243 - protein, 7 aa, Artificial Sequence
  Synthetic construct
WFGLYCY

SEQ ID NO: 29244 - protein, 7 aa, Artificial Sequence
  Synthetic construct
WFGLYLF

SEQ ID NO: 29245 - protein, 7 aa, Artificial Sequence
  Synthetic construct
WFGLYLY

SEQ ID NO: 29246 - protein, 7 aa, Artificial Sequence
  Synthetic construct
WFGLYAF

SEQ ID NO: 29247 - protein, 7 aa, Artificial Sequence
  Synthetic construct
WFGLYAY

SEQ ID NO: 29248 - protein, 7 aa, Artificial Sequence
  Synthetic construct
WFGLYQF

SEQ ID NO: 29249 - protein, 7 aa, Artificial Sequence
  Synthetic construct
WFGLYQY

SEQ ID NO: 29250 - protein, 7 aa, Artificial Sequence
  Synthetic construct
WFGLYDF

SEQ ID NO: 29251 - protein, 7 aa, Artificial Sequence
  Synthetic construct
WFGLYDY

SEQ ID NO: 29252 - protein, 7 aa, Artificial Sequence
  Synthetic construct
WFGLYVF

SEQ ID NO: 29253 - protein, 7 aa, Artificial Sequence
  Synthetic construct
WFGLYVY

SEQ ID NO: 29254 - protein, 7 aa, Artificial Sequence
  Synthetic construct
WFGLFFF

SEQ ID NO: 29255 - protein, 7 aa, Artificial Sequence
  Synthetic construct
WFGLFFY

SEQ ID NO: 29256 - protein, 7 aa, Artificial Sequence
  Synthetic construct
WFGLFRF

SEQ ID NO: 29257 - protein, 7 aa, Artificial Sequence
  Synthetic construct
WFGLFRY

SEQ ID NO: 29258 - protein, 7 aa, Artificial Sequence
  Synthetic construct
WFGLFCF

SEQ ID NO: 29259 - protein, 7 aa, Artificial Sequence
  Synthetic construct
WFGLFCY

SEQ ID NO: 29260 - protein, 7 aa, Artificial Sequence
  Synthetic construct
WFGLFLF

SEQ ID NO: 29261 - protein, 7 aa, Artificial Sequence
  Synthetic construct
WFGLFLY

SEQ ID NO: 29262 - protein, 7 aa, Artificial Sequence
  Synthetic construct
WFGLFAF

SEQ ID NO: 29263 - protein, 7 aa, Artificial Sequence
  Synthetic construct
WFGLFAY

SEQ ID NO: 29264 - protein, 7 aa, Artificial Sequence
  Synthetic construct
WFGLFQF

SEQ ID NO: 29265 - protein, 7 aa, Artificial Sequence
  Synthetic construct
WFGLFQY

SEQ ID NO: 29266 - protein, 7 aa, Artificial Sequence
  Synthetic construct
WFGLFDF

SEQ ID NO: 29267 - protein, 7 aa, Artificial Sequence
  Synthetic construct
WFGLFDY

SEQ ID NO: 29268 - protein, 7 aa, Artificial Sequence
  Synthetic construct
WFGLFVF

SEQ ID NO: 29269 - protein, 7 aa, Artificial Sequence
  Synthetic construct
WFGLFVY

SEQ ID NO: 29270 - protein, 7 aa, Artificial Sequence
  Synthetic construct
WFGLVFF

SEQ ID NO: 29271 - protein, 7 aa, Artificial Sequence
  Synthetic construct
WFGLVFY

SEQ ID NO: 29272 - protein, 7 aa, Artificial Sequence
  Synthetic construct
WFGLVRF

SEQ ID NO: 29273 - protein, 7 aa, Artificial Sequence
  Synthetic construct
WFGLVRY

SEQ ID NO: 29274 - protein, 7 aa, Artificial Sequence
  Synthetic construct
WFGLVCF

SEQ ID NO: 29275 - protein, 7 aa, Artificial Sequence
  Synthetic construct
WFGLVCY

SEQ ID NO: 29276 - protein, 7 aa, Artificial Sequence
  Synthetic construct
WFGLVLF

SEQ ID NO: 29277 - protein, 7 aa, Artificial Sequence
  Synthetic construct
WFGLVLY

SEQ ID NO: 29278 - protein, 7 aa, Artificial Sequence
  Synthetic construct
WFGLVAF

SEQ ID NO: 29279 - protein, 7 aa, Artificial Sequence
  Synthetic construct
WFGLVAY

SEQ ID NO: 29280 - protein, 7 aa, Artificial Sequence
  Synthetic construct
WFGLVQF

SEQ ID NO: 29281 - protein, 7 aa, Artificial Sequence
  Synthetic construct
WFGLVQY

SEQ ID NO: 29282 - protein, 7 aa, Artificial Sequence
  Synthetic construct
WFGLVDF

SEQ ID NO: 29283 - protein, 7 aa, Artificial Sequence
  Synthetic construct
WFGLVDY

SEQ ID NO: 29284 - protein, 7 aa, Artificial Sequence
  Synthetic construct
WFGLVVF

SEQ ID NO: 29285 - protein, 7 aa, Artificial Sequence
  Synthetic construct
WFGLVVY

SEQ ID NO: 29286 - protein, 7 aa, Artificial Sequence
  Synthetic construct
WFGLTFF

SEQ ID NO: 29287 - protein, 7 aa, Artificial Sequence
  Synthetic construct
WFGLTFY

SEQ ID NO: 29288 - protein, 7 aa, Artificial Sequence
  Synthetic construct
WFGLTRF

SEQ ID NO: 29289 - protein, 7 aa, Artificial Sequence
  Synthetic construct
WFGLTRY

SEQ ID NO: 29290 - protein, 7 aa, Artificial Sequence
  Synthetic construct
WFGLTCF

SEQ ID NO: 29291 - protein, 7 aa, Artificial Sequence
  Synthetic construct
WFGLTCY

SEQ ID NO: 29292 - protein, 7 aa, Artificial Sequence
  Synthetic construct
WFGLTLF

SEQ ID NO: 29293 - protein, 7 aa, Artificial Sequence
  Synthetic construct
WFGLTLY

SEQ ID NO: 29294 - protein, 7 aa, Artificial Sequence
  Synthetic construct
WFGLTAF

SEQ ID NO: 29295 - protein, 7 aa, Artificial Sequence
  Synthetic construct
WFGLTAY

SEQ ID NO: 29296 - protein, 7 aa, Artificial Sequence
  Synthetic construct
WFGLTQF

SEQ ID NO: 29297 - protein, 7 aa, Artificial Sequence
  Synthetic construct
WFGLTQY

SEQ ID NO: 29298 - protein, 7 aa, Artificial Sequence
  Synthetic construct
WFGLTDF

SEQ ID NO: 29299 - protein, 7 aa, Artificial Sequence
  Synthetic construct
WFGLTDY

SEQ ID NO: 29300 - protein, 7 aa, Artificial Sequence
  Synthetic construct
WFGLTVF

SEQ ID NO: 29301 - protein, 7 aa, Artificial Sequence
  Synthetic construct
WFGLTVY

SEQ ID NO: 29302 - protein, 7 aa, Artificial Sequence
  Synthetic construct
WFGLGFF

SEQ ID NO: 29303 - protein, 7 aa, Artificial Sequence
  Synthetic construct
WFGLGFY

SEQ ID NO: 29304 - protein, 7 aa, Artificial Sequence
  Synthetic construct
WFGLGRF

SEQ ID NO: 29305 - protein, 7 aa, Artificial Sequence
  Synthetic construct
WFGLGRY

SEQ ID NO: 29306 - protein, 7 aa, Artificial Sequence
  Synthetic construct
WFGLGCF

SEQ ID NO: 29307 - protein, 7 aa, Artificial Sequence
  Synthetic construct
WFGLGCY

SEQ ID NO: 29308 - protein, 7 aa, Artificial Sequence
  Synthetic construct
WFGLGLF

SEQ ID NO: 29309 - protein, 7 aa, Artificial Sequence
  Synthetic construct
WFGLGLY

SEQ ID NO: 29310 - protein, 7 aa, Artificial Sequence
  Synthetic construct
WFGLGAF

SEQ ID NO: 29311 - protein, 7 aa, Artificial Sequence
  Synthetic construct
WFGLGAY

SEQ ID NO: 29312 - protein, 7 aa, Artificial Sequence
  Synthetic construct
WFGLGQF

SEQ ID NO: 29313 - protein, 7 aa, Artificial Sequence
  Synthetic construct
WFGLGQY

SEQ ID NO: 29314 - protein, 7 aa, Artificial Sequence
  Synthetic construct
WFGLGDF

SEQ ID NO: 29315 - protein, 7 aa, Artificial Sequence
  Synthetic construct
WFGLGDY

SEQ ID NO: 29316 - protein, 7 aa, Artificial Sequence
  Synthetic construct
WFGLGVF

SEQ ID NO: 29317 - protein, 7 aa, Artificial Sequence
  Synthetic construct
WFGLGVY

SEQ ID NO: 29318 - protein, 7 aa, Artificial Sequence
  Synthetic construct
WFGLAFF

SEQ ID NO: 29319 - protein, 7 aa, Artificial Sequence
  Synthetic construct
WFGLAFY

SEQ ID NO: 29320 - protein, 7 aa, Artificial Sequence
  Synthetic construct
WFGLARF

SEQ ID NO: 29321 - protein, 7 aa, Artificial Sequence
  Synthetic construct
WFGLARY

SEQ ID NO: 29322 - protein, 7 aa, Artificial Sequence
  Synthetic construct
WFGLACF

SEQ ID NO: 29323 - protein, 7 aa, Artificial Sequence
  Synthetic construct
WFGLACY

SEQ ID NO: 29324 - protein, 7 aa, Artificial Sequence
  Synthetic construct
WFGLALF

SEQ ID NO: 29325 - protein, 7 aa, Artificial Sequence
  Synthetic construct
WFGLALY

SEQ ID NO: 29326 - protein, 7 aa, Artificial Sequence
  Synthetic construct
WFGLAAF

SEQ ID NO: 29327 - protein, 7 aa, Artificial Sequence
  Synthetic construct
WFGLAAY

SEQ ID NO: 29328 - protein, 7 aa, Artificial Sequence
  Synthetic construct
WFGLAQF

SEQ ID NO: 29329 - protein, 7 aa, Artificial Sequence
  Synthetic construct
WFGLAQY

SEQ ID NO: 29330 - protein, 7 aa, Artificial Sequence
  Synthetic construct
WFGLADF

SEQ ID NO: 29331 - protein, 7 aa, Artificial Sequence
  Synthetic construct
WFGLADY

SEQ ID NO: 29332 - protein, 7 aa, Artificial Sequence
  Synthetic construct
WFGLAVF

SEQ ID NO: 29333 - protein, 7 aa, Artificial Sequence
  Synthetic construct
WFGLAVY

SEQ ID NO: 29334 - protein, 7 aa, Artificial Sequence
  Synthetic construct
WFGLQFF

SEQ ID NO: 29335 - protein, 7 aa, Artificial Sequence
  Synthetic construct
WFGLQFY

SEQ ID NO: 29336 - protein, 7 aa, Artificial Sequence
  Synthetic construct
WFGLQRF

SEQ ID NO: 29337 - protein, 7 aa, Artificial Sequence
  Synthetic construct
WFGLQRY

SEQ ID NO: 29338 - protein, 7 aa, Artificial Sequence
  Synthetic construct
WFGLQCF

SEQ ID NO: 29339 - protein, 7 aa, Artificial Sequence
  Synthetic construct
WFGLQCY

SEQ ID NO: 29340 - protein, 7 aa, Artificial Sequence
  Synthetic construct
WFGLQLF

SEQ ID NO: 29341 - protein, 7 aa, Artificial Sequence
  Synthetic construct
WFGLQLY

SEQ ID NO: 29342 - protein, 7 aa, Artificial Sequence
  Synthetic construct
WFGLQAF

SEQ ID NO: 29343 - protein, 7 aa, Artificial Sequence
  Synthetic construct
WFGLQAY

SEQ ID NO: 29344 - protein, 7 aa, Artificial Sequence
  Synthetic construct
WFGLQQF

SEQ ID NO: 29345 - protein, 7 aa, Artificial Sequence
  Synthetic construct
WFGLQQY

SEQ ID NO: 29346 - protein, 7 aa, Artificial Sequence
  Synthetic construct
WFGLQDF

SEQ ID NO: 29347 - protein, 7 aa, Artificial Sequence
  Synthetic construct
WFGLQDY

SEQ ID NO: 29348 - protein, 7 aa, Artificial Sequence
  Synthetic construct
WFGLQVF

SEQ ID NO: 29349 - protein, 7 aa, Artificial Sequence
  Synthetic construct
WFGLQVY

SEQ ID NO: 29350 - protein, 7 aa, Artificial Sequence
  Synthetic construct
WFGFIFF

SEQ ID NO: 29351 - protein, 7 aa, Artificial Sequence
  Synthetic construct
WFGFIFY

SEQ ID NO: 29352 - protein, 7 aa, Artificial Sequence
  Synthetic construct
WFGFIRF

SEQ ID NO: 29353 - protein, 7 aa, Artificial Sequence
  Synthetic construct
WFGFIRY

SEQ ID NO: 29354 - protein, 7 aa, Artificial Sequence
  Synthetic construct
WFGFICF

SEQ ID NO: 29355 - protein, 7 aa, Artificial Sequence
  Synthetic construct
WFGFICY

SEQ ID NO: 29356 - protein, 7 aa, Artificial Sequence
  Synthetic construct
WFGFILF

SEQ ID NO: 29357 - protein, 7 aa, Artificial Sequence
  Synthetic construct
WFGFILY

SEQ ID NO: 29358 - protein, 7 aa, Artificial Sequence
  Synthetic construct
WFGFIAF

SEQ ID NO: 29359 - protein, 7 aa, Artificial Sequence
  Synthetic construct
WFGFIAY

SEQ ID NO: 29360 - protein, 7 aa, Artificial Sequence
  Synthetic construct
WFGFIQF

SEQ ID NO: 29361 - protein, 7 aa, Artificial Sequence
  Synthetic construct
WFGFIQY

SEQ ID NO: 29362 - protein, 7 aa, Artificial Sequence
  Synthetic construct
WFGFIDF

SEQ ID NO: 29363 - protein, 7 aa, Artificial Sequence
  Synthetic construct
WFGFIDY

SEQ ID NO: 29364 - protein, 7 aa, Artificial Sequence
  Synthetic construct
WFGFIVF

SEQ ID NO: 29365 - protein, 7 aa, Artificial Sequence
  Synthetic construct
WFGFIVY

SEQ ID NO: 29366 - protein, 7 aa, Artificial Sequence
  Synthetic construct
WFGFDFF

SEQ ID NO: 29367 - protein, 7 aa, Artificial Sequence
  Synthetic construct
WFGFDFY

SEQ ID NO: 29368 - protein, 7 aa, Artificial Sequence
  Synthetic construct
WFGFDRF

SEQ ID NO: 29369 - protein, 7 aa, Artificial Sequence
  Synthetic construct
WFGFDRY

SEQ ID NO: 29370 - protein, 7 aa, Artificial Sequence
  Synthetic construct
WFGFDCF

SEQ ID NO: 29371 - protein, 7 aa, Artificial Sequence
  Synthetic construct
WFGFDCY

SEQ ID NO: 29372 - protein, 7 aa, Artificial Sequence
  Synthetic construct
WFGFDLF

SEQ ID NO: 29373 - protein, 7 aa, Artificial Sequence
  Synthetic construct
WFGFDLY

SEQ ID NO: 29374 - protein, 7 aa, Artificial Sequence
  Synthetic construct
WFGFDAF

SEQ ID NO: 29375 - protein, 7 aa, Artificial Sequence
  Synthetic construct
WFGFDAY

SEQ ID NO: 29376 - protein, 7 aa, Artificial Sequence
  Synthetic construct
WFGFDQF

SEQ ID NO: 29377 - protein, 7 aa, Artificial Sequence
  Synthetic construct
WFGFDQY

SEQ ID NO: 29378 - protein, 7 aa, Artificial Sequence
  Synthetic construct
WFGFDDF

SEQ ID NO: 29379 - protein, 7 aa, Artificial Sequence
  Synthetic construct
WFGFDDY

SEQ ID NO: 29380 - protein, 7 aa, Artificial Sequence
  Synthetic construct
WFGFDVF

SEQ ID NO: 29381 - protein, 7 aa, Artificial Sequence
  Synthetic construct
WFGFDVY

SEQ ID NO: 29382 - protein, 7 aa, Artificial Sequence
  Synthetic construct
WFGFYFF

SEQ ID NO: 29383 - protein, 7 aa, Artificial Sequence
  Synthetic construct
WFGFYFY

SEQ ID NO: 29384 - protein, 7 aa, Artificial Sequence
  Synthetic construct
WFGFYRF

SEQ ID NO: 29385 - protein, 7 aa, Artificial Sequence
  Synthetic construct
WFGFYRY

SEQ ID NO: 29386 - protein, 7 aa, Artificial Sequence
  Synthetic construct
WFGFYCF

SEQ ID NO: 29387 - protein, 7 aa, Artificial Sequence
  Synthetic construct
WFGFYCY

SEQ ID NO: 29388 - protein, 7 aa, Artificial Sequence
  Synthetic construct
WFGFYLF

SEQ ID NO: 29389 - protein, 7 aa, Artificial Sequence
  Synthetic construct
WFGFYLY

SEQ ID NO: 29390 - protein, 7 aa, Artificial Sequence
  Synthetic construct
WFGFYAF

SEQ ID NO: 29391 - protein, 7 aa, Artificial Sequence
  Synthetic construct
WFGFYAY

SEQ ID NO: 29392 - protein, 7 aa, Artificial Sequence
  Synthetic construct
WFGFYQF

SEQ ID NO: 29393 - protein, 7 aa, Artificial Sequence
  Synthetic construct
WFGFYQY

SEQ ID NO: 29394 - protein, 7 aa, Artificial Sequence
  Synthetic construct
WFGFYDF

SEQ ID NO: 29395 - protein, 7 aa, Artificial Sequence
  Synthetic construct
WFGFYDY

SEQ ID NO: 29396 - protein, 7 aa, Artificial Sequence
  Synthetic construct
WFGFYVF

SEQ ID NO: 29397 - protein, 7 aa, Artificial Sequence
  Synthetic construct
WFGFYVY

SEQ ID NO: 29398 - protein, 7 aa, Artificial Sequence
  Synthetic construct
WFGFFFF

SEQ ID NO: 29399 - protein, 7 aa, Artificial Sequence
  Synthetic construct
WFGFFFY

SEQ ID NO: 29400 - protein, 7 aa, Artificial Sequence
  Synthetic construct
WFGFFRF

SEQ ID NO: 29401 - protein, 7 aa, Artificial Sequence
  Synthetic construct
WFGFFRY

SEQ ID NO: 29402 - protein, 7 aa, Artificial Sequence
  Synthetic construct
WFGFFCF

SEQ ID NO: 29403 - protein, 7 aa, Artificial Sequence
  Synthetic construct
WFGFFCY

SEQ ID NO: 29404 - protein, 7 aa, Artificial Sequence
  Synthetic construct
WFGFFLF

SEQ ID NO: 29405 - protein, 7 aa, Artificial Sequence
  Synthetic construct
WFGFFLY

SEQ ID NO: 29406 - protein, 7 aa, Artificial Sequence
  Synthetic construct
WFGFFAF

SEQ ID NO: 29407 - protein, 7 aa, Artificial Sequence
  Synthetic construct
WFGFFAY

SEQ ID NO: 29408 - protein, 7 aa, Artificial Sequence
  Synthetic construct
WFGFFQF

SEQ ID NO: 29409 - protein, 7 aa, Artificial Sequence
  Synthetic construct
WFGFFQY

SEQ ID NO: 29410 - protein, 7 aa, Artificial Sequence
  Synthetic construct
WFGFFDF

SEQ ID NO: 29411 - protein, 7 aa, Artificial Sequence
  Synthetic construct
WFGFFDY

SEQ ID NO: 29412 - protein, 7 aa, Artificial Sequence
  Synthetic construct
WFGFFVF

SEQ ID NO: 29413 - protein, 7 aa, Artificial Sequence
  Synthetic construct
WFGFFVY

SEQ ID NO: 29414 - protein, 7 aa, Artificial Sequence
  Synthetic construct
WFGFVFF

SEQ ID NO: 29415 - protein, 7 aa, Artificial Sequence
  Synthetic construct
WFGFVFY

SEQ ID NO: 29416 - protein, 7 aa, Artificial Sequence
  Synthetic construct
WFGFVRF

SEQ ID NO: 29417 - protein, 7 aa, Artificial Sequence
  Synthetic construct
WFGFVRY

SEQ ID NO: 29418 - protein, 7 aa, Artificial Sequence
  Synthetic construct
WFGFVCF

SEQ ID NO: 29419 - protein, 7 aa, Artificial Sequence
  Synthetic construct
WFGFVCY

SEQ ID NO: 29420 - protein, 7 aa, Artificial Sequence
  Synthetic construct
WFGFVLF

SEQ ID NO: 29421 - protein, 7 aa, Artificial Sequence
  Synthetic construct
WFGFVLY

SEQ ID NO: 29422 - protein, 7 aa, Artificial Sequence
  Synthetic construct
WFGFVAF

SEQ ID NO: 29423 - protein, 7 aa, Artificial Sequence
  Synthetic construct
WFGFVAY

SEQ ID NO: 29424 - protein, 7 aa, Artificial Sequence
  Synthetic construct
WFGFVQF

SEQ ID NO: 29425 - protein, 7 aa, Artificial Sequence
  Synthetic construct
WFGFVQY

SEQ ID NO: 29426 - protein, 7 aa, Artificial Sequence
  Synthetic construct
WFGFVDF

SEQ ID NO: 29427 - protein, 7 aa, Artificial Sequence
  Synthetic construct
WFGFVDY

SEQ ID NO: 29428 - protein, 7 aa, Artificial Sequence
  Synthetic construct
WFGFVVF

SEQ ID NO: 29429 - protein, 7 aa, Artificial Sequence
  Synthetic construct
WFGFVVY

SEQ ID NO: 29430 - protein, 7 aa, Artificial Sequence
  Synthetic construct
WFGFTFF

SEQ ID NO: 29431 - protein, 7 aa, Artificial Sequence
  Synthetic construct
WFGFTFY

SEQ ID NO: 29432 - protein, 7 aa, Artificial Sequence
  Synthetic construct
WFGFTRF

SEQ ID NO: 29433 - protein, 7 aa, Artificial Sequence
  Synthetic construct
WFGFTRY

SEQ ID NO: 29434 - protein, 7 aa, Artificial Sequence
  Synthetic construct
WFGFTCF

SEQ ID NO: 29435 - protein, 7 aa, Artificial Sequence
  Synthetic construct
WFGFTCY

SEQ ID NO: 29436 - protein, 7 aa, Artificial Sequence
  Synthetic construct
WFGFTLF

SEQ ID NO: 29437 - protein, 7 aa, Artificial Sequence
  Synthetic construct
WFGFTLY

SEQ ID NO: 29438 - protein, 7 aa, Artificial Sequence
  Synthetic construct
WFGFTAF

SEQ ID NO: 29439 - protein, 7 aa, Artificial Sequence
  Synthetic construct
WFGFTAY

SEQ ID NO: 29440 - protein, 7 aa, Artificial Sequence
  Synthetic construct
WFGFTQF

SEQ ID NO: 29441 - protein, 7 aa, Artificial Sequence
  Synthetic construct
WFGFTQY

SEQ ID NO: 29442 - protein, 7 aa, Artificial Sequence
  Synthetic construct
WFGFTDF

SEQ ID NO: 29443 - protein, 7 aa, Artificial Sequence
  Synthetic construct
WFGFTDY

SEQ ID NO: 29444 - protein, 7 aa, Artificial Sequence
  Synthetic construct
WFGFTVF

SEQ ID NO: 29445 - protein, 7 aa, Artificial Sequence
  Synthetic construct
WFGFTVY

SEQ ID NO: 29446 - protein, 7 aa, Artificial Sequence
  Synthetic construct
WFGFGFF

SEQ ID NO: 29447 - protein, 7 aa, Artificial Sequence
  Synthetic construct
WFGFGFY

SEQ ID NO: 29448 - protein, 7 aa, Artificial Sequence
  Synthetic construct
WFGFGRF

SEQ ID NO: 29449 - protein, 7 aa, Artificial Sequence
  Synthetic construct
WFGFGRY

SEQ ID NO: 29450 - protein, 7 aa, Artificial Sequence
  Synthetic construct
WFGFGCF

SEQ ID NO: 29451 - protein, 7 aa, Artificial Sequence
  Synthetic construct
WFGFGCY

SEQ ID NO: 29452 - protein, 7 aa, Artificial Sequence
  Synthetic construct
WFGFGLF

SEQ ID NO: 29453 - protein, 7 aa, Artificial Sequence
  Synthetic construct
WFGFGLY

SEQ ID NO: 29454 - protein, 7 aa, Artificial Sequence
  Synthetic construct
WFGFGAF

SEQ ID NO: 29455 - protein, 7 aa, Artificial Sequence
  Synthetic construct
WFGFGAY

SEQ ID NO: 29456 - protein, 7 aa, Artificial Sequence
  Synthetic construct
WFGFGQF

SEQ ID NO: 29457 - protein, 7 aa, Artificial Sequence
  Synthetic construct
WFGFGQY

SEQ ID NO: 29458 - protein, 7 aa, Artificial Sequence
  Synthetic construct
WFGFGDF

SEQ ID NO: 29459 - protein, 7 aa, Artificial Sequence
  Synthetic construct
WFGFGDY

SEQ ID NO: 29460 - protein, 7 aa, Artificial Sequence
  Synthetic construct
WFGFGVF

SEQ ID NO: 29461 - protein, 7 aa, Artificial Sequence
  Synthetic construct
WFGFGVY

SEQ ID NO: 29462 - protein, 7 aa, Artificial Sequence
  Synthetic construct
WFGFAFF

SEQ ID NO: 29463 - protein, 7 aa, Artificial Sequence
  Synthetic construct
WFGFAFY

SEQ ID NO: 29464 - protein, 7 aa, Artificial Sequence
  Synthetic construct
WFGFARF

SEQ ID NO: 29465 - protein, 7 aa, Artificial Sequence
  Synthetic construct
WFGFARY

SEQ ID NO: 29466 - protein, 7 aa, Artificial Sequence
  Synthetic construct
WFGFACF

SEQ ID NO: 29467 - protein, 7 aa, Artificial Sequence
  Synthetic construct
WFGFACY

SEQ ID NO: 29468 - protein, 7 aa, Artificial Sequence
  Synthetic construct
WFGFALF

SEQ ID NO: 29469 - protein, 7 aa, Artificial Sequence
  Synthetic construct
WFGFALY

SEQ ID NO: 29470 - protein, 7 aa, Artificial Sequence
  Synthetic construct
WFGFAAF

SEQ ID NO: 29471 - protein, 7 aa, Artificial Sequence
  Synthetic construct
WFGFAAY

SEQ ID NO: 29472 - protein, 7 aa, Artificial Sequence
  Synthetic construct
WFGFAQF

SEQ ID NO: 29473 - protein, 7 aa, Artificial Sequence
  Synthetic construct
WFGFAQY

SEQ ID NO: 29474 - protein, 7 aa, Artificial Sequence
  Synthetic construct
WFGFADF

SEQ ID NO: 29475 - protein, 7 aa, Artificial Sequence
  Synthetic construct
WFGFADY

SEQ ID NO: 29476 - protein, 7 aa, Artificial Sequence
  Synthetic construct
WFGFAVF

SEQ ID NO: 29477 - protein, 7 aa, Artificial Sequence
  Synthetic construct
WFGFAVY

SEQ ID NO: 29478 - protein, 7 aa, Artificial Sequence
  Synthetic construct
WFGFQFF

SEQ ID NO: 29479 - protein, 7 aa, Artificial Sequence
  Synthetic construct
WFGFQFY

SEQ ID NO: 29480 - protein, 7 aa, Artificial Sequence
  Synthetic construct
WFGFQRF

SEQ ID NO: 29481 - protein, 7 aa, Artificial Sequence
  Synthetic construct
WFGFQRY

SEQ ID NO: 29482 - protein, 7 aa, Artificial Sequence
  Synthetic construct
WFGFQCF

SEQ ID NO: 29483 - protein, 7 aa, Artificial Sequence
  Synthetic construct
WFGFQCY

SEQ ID NO: 29484 - protein, 7 aa, Artificial Sequence
  Synthetic construct
WFGFQLF

SEQ ID NO: 29485 - protein, 7 aa, Artificial Sequence
  Synthetic construct
WFGFQLY

SEQ ID NO: 29486 - protein, 7 aa, Artificial Sequence
  Synthetic construct
WFGFQAF

SEQ ID NO: 29487 - protein, 7 aa, Artificial Sequence
  Synthetic construct
WFGFQAY

SEQ ID NO: 29488 - protein, 7 aa, Artificial Sequence
  Synthetic construct
WFGFQQF

SEQ ID NO: 29489 - protein, 7 aa, Artificial Sequence
  Synthetic construct
WFGFQQY

SEQ ID NO: 29490 - protein, 7 aa, Artificial Sequence
  Synthetic construct
WFGFQDF

SEQ ID NO: 29491 - protein, 7 aa, Artificial Sequence
  Synthetic construct
WFGFQDY

SEQ ID NO: 29492 - protein, 7 aa, Artificial Sequence
  Synthetic construct
WFGFQVF

SEQ ID NO: 29493 - protein, 7 aa, Artificial Sequence
  Synthetic construct
WFGFQVY

SEQ ID NO: 29494 - protein, 7 aa, Artificial Sequence
  Synthetic construct
WRIYIFF

SEQ ID NO: 29495 - protein, 7 aa, Artificial Sequence
  Synthetic construct
WRIYIFY

SEQ ID NO: 29496 - protein, 7 aa, Artificial Sequence
  Synthetic construct
WRIYIRF

SEQ ID NO: 29497 - protein, 7 aa, Artificial Sequence
  Synthetic construct
WRIYIRY

SEQ ID NO: 29498 - protein, 7 aa, Artificial Sequence
  Synthetic construct
WRIYICF

SEQ ID NO: 29499 - protein, 7 aa, Artificial Sequence
  Synthetic construct
WRIYICY

SEQ ID NO: 29500 - protein, 7 aa, Artificial Sequence
  Synthetic construct
WRIYILF

SEQ ID NO: 29501 - protein, 7 aa, Artificial Sequence
  Synthetic construct
WRIYILY

SEQ ID NO: 29502 - protein, 7 aa, Artificial Sequence
  Synthetic construct
WRIYIAF

SEQ ID NO: 29503 - protein, 7 aa, Artificial Sequence
  Synthetic construct
WRIYIAY

SEQ ID NO: 29504 - protein, 7 aa, Artificial Sequence
  Synthetic construct
WRIYIQF

SEQ ID NO: 29505 - protein, 7 aa, Artificial Sequence
  Synthetic construct
WRIYIQY

SEQ ID NO: 29506 - protein, 7 aa, Artificial Sequence
  Synthetic construct
WRIYIDF

SEQ ID NO: 29507 - protein, 7 aa, Artificial Sequence
  Synthetic construct
WRIYIDY

SEQ ID NO: 29508 - protein, 7 aa, Artificial Sequence
  Synthetic construct
WRIYIVF

SEQ ID NO: 29509 - protein, 7 aa, Artificial Sequence
  Synthetic construct
WRIYIVY

SEQ ID NO: 29510 - protein, 7 aa, Artificial Sequence
  Synthetic construct
WRIYDFF

SEQ ID NO: 29511 - protein, 7 aa, Artificial Sequence
  Synthetic construct
WRIYDFY

SEQ ID NO: 29512 - protein, 7 aa, Artificial Sequence
  Synthetic construct
WRIYDRF

SEQ ID NO: 29513 - protein, 7 aa, Artificial Sequence
  Synthetic construct
WRIYDRY

SEQ ID NO: 29514 - protein, 7 aa, Artificial Sequence
  Synthetic construct
WRIYDCF

SEQ ID NO: 29515 - protein, 7 aa, Artificial Sequence
  Synthetic construct
WRIYDCY

SEQ ID NO: 29516 - protein, 7 aa, Artificial Sequence
  Synthetic construct
WRIYDLF

SEQ ID NO: 29517 - protein, 7 aa, Artificial Sequence
  Synthetic construct
WRIYDLY

SEQ ID NO: 29518 - protein, 7 aa, Artificial Sequence
  Synthetic construct
WRIYDAF

SEQ ID NO: 29519 - protein, 7 aa, Artificial Sequence
  Synthetic construct
WRIYDAY

SEQ ID NO: 29520 - protein, 7 aa, Artificial Sequence
  Synthetic construct
WRIYDQF

SEQ ID NO: 29521 - protein, 7 aa, Artificial Sequence
  Synthetic construct
WRIYDQY

SEQ ID NO: 29522 - protein, 7 aa, Artificial Sequence
  Synthetic construct
WRIYDDF

SEQ ID NO: 29523 - protein, 7 aa, Artificial Sequence
  Synthetic construct
WRIYDDY

SEQ ID NO: 29524 - protein, 7 aa, Artificial Sequence
  Synthetic construct
WRIYDVF

SEQ ID NO: 29525 - protein, 7 aa, Artificial Sequence
  Synthetic construct
WRIYDVY

SEQ ID NO: 29526 - protein, 7 aa, Artificial Sequence
  Synthetic construct
WRIYYFF

SEQ ID NO: 29527 - protein, 7 aa, Artificial Sequence
  Synthetic construct
WRIYYFY

SEQ ID NO: 29528 - protein, 7 aa, Artificial Sequence
  Synthetic construct
WRIYYRF

SEQ ID NO: 29529 - protein, 7 aa, Artificial Sequence
  Synthetic construct
WRIYYRY

SEQ ID NO: 29530 - protein, 7 aa, Artificial Sequence
  Synthetic construct
WRIYYCF

SEQ ID NO: 29531 - protein, 7 aa, Artificial Sequence
  Synthetic construct
WRIYYCY

SEQ ID NO: 29532 - protein, 7 aa, Artificial Sequence
  Synthetic construct
WRIYYLF

SEQ ID NO: 29533 - protein, 7 aa, Artificial Sequence
  Synthetic construct
WRIYYLY

SEQ ID NO: 29534 - protein, 7 aa, Artificial Sequence
  Synthetic construct
WRIYYAF

SEQ ID NO: 29535 - protein, 7 aa, Artificial Sequence
  Synthetic construct
WRIYYAY

SEQ ID NO: 29536 - protein, 7 aa, Artificial Sequence
  Synthetic construct
WRIYYQF

SEQ ID NO: 29537 - protein, 7 aa, Artificial Sequence
  Synthetic construct
WRIYYQY

SEQ ID NO: 29538 - protein, 7 aa, Artificial Sequence
  Synthetic construct
WRIYYDF

SEQ ID NO: 29539 - protein, 7 aa, Artificial Sequence
  Synthetic construct
WRIYYDY

SEQ ID NO: 29540 - protein, 7 aa, Artificial Sequence
  Synthetic construct
WRIYYVF

SEQ ID NO: 29541 - protein, 7 aa, Artificial Sequence
  Synthetic construct
WRIYYVY

SEQ ID NO: 29542 - protein, 7 aa, Artificial Sequence
  Synthetic construct
WRIYFFF

SEQ ID NO: 29543 - protein, 7 aa, Artificial Sequence
  Synthetic construct
WRIYFFY

SEQ ID NO: 29544 - protein, 7 aa, Artificial Sequence
  Synthetic construct
WRIYFRF

SEQ ID NO: 29545 - protein, 7 aa, Artificial Sequence
  Synthetic construct
WRIYFRY

SEQ ID NO: 29546 - protein, 7 aa, Artificial Sequence
  Synthetic construct
WRIYFCF

SEQ ID NO: 29547 - protein, 7 aa, Artificial Sequence
  Synthetic construct
WRIYFCY

SEQ ID NO: 29548 - protein, 7 aa, Artificial Sequence
  Synthetic construct
WRIYFLF

SEQ ID NO: 29549 - protein, 7 aa, Artificial Sequence
  Synthetic construct
WRIYFLY

SEQ ID NO: 29550 - protein, 7 aa, Artificial Sequence
  Synthetic construct
WRIYFAF

SEQ ID NO: 29551 - protein, 7 aa, Artificial Sequence
  Synthetic construct
WRIYFAY

SEQ ID NO: 29552 - protein, 7 aa, Artificial Sequence
  Synthetic construct
WRIYFQF

SEQ ID NO: 29553 - protein, 7 aa, Artificial Sequence
  Synthetic construct
WRIYFQY

SEQ ID NO: 29554 - protein, 7 aa, Artificial Sequence
  Synthetic construct
WRIYFDF

SEQ ID NO: 29555 - protein, 7 aa, Artificial Sequence
  Synthetic construct
WRIYFDY

SEQ ID NO: 29556 - protein, 7 aa, Artificial Sequence
  Synthetic construct
WRIYFVF

SEQ ID NO: 29557 - protein, 7 aa, Artificial Sequence
  Synthetic construct
WRIYFVY

SEQ ID NO: 29558 - protein, 7 aa, Artificial Sequence
  Synthetic construct
WRIYVFF

SEQ ID NO: 29559 - protein, 7 aa, Artificial Sequence
  Synthetic construct
WRIYVFY

SEQ ID NO: 29560 - protein, 7 aa, Artificial Sequence
  Synthetic construct
WRIYVRF

SEQ ID NO: 29561 - protein, 7 aa, Artificial Sequence
  Synthetic construct
WRIYVRY

SEQ ID NO: 29562 - protein, 7 aa, Artificial Sequence
  Synthetic construct
WRIYVCF

SEQ ID NO: 29563 - protein, 7 aa, Artificial Sequence
  Synthetic construct
WRIYVCY

SEQ ID NO: 29564 - protein, 7 aa, Artificial Sequence
  Synthetic construct
WRIYVLF

SEQ ID NO: 29565 - protein, 7 aa, Artificial Sequence
  Synthetic construct
WRIYVLY

SEQ ID NO: 29566 - protein, 7 aa, Artificial Sequence
  Synthetic construct
WRIYVAF

SEQ ID NO: 29567 - protein, 7 aa, Artificial Sequence
  Synthetic construct
WRIYVAY

SEQ ID NO: 29568 - protein, 7 aa, Artificial Sequence
  Synthetic construct
WRIYVQF

SEQ ID NO: 29569 - protein, 7 aa, Artificial Sequence
  Synthetic construct
WRIYVQY

SEQ ID NO: 29570 - protein, 7 aa, Artificial Sequence
  Synthetic construct
WRIYVDF

SEQ ID NO: 29571 - protein, 7 aa, Artificial Sequence
  Synthetic construct
WRIYVDY

SEQ ID NO: 29572 - protein, 7 aa, Artificial Sequence
  Synthetic construct
WRIYVVF

SEQ ID NO: 29573 - protein, 7 aa, Artificial Sequence
  Synthetic construct
WRIYVVY

SEQ ID NO: 29574 - protein, 7 aa, Artificial Sequence
  Synthetic construct
WRIYTFF

SEQ ID NO: 29575 - protein, 7 aa, Artificial Sequence
  Synthetic construct
WRIYTFY

SEQ ID NO: 29576 - protein, 7 aa, Artificial Sequence
  Synthetic construct
WRIYTRF

SEQ ID NO: 29577 - protein, 7 aa, Artificial Sequence
  Synthetic construct
WRIYTRY

SEQ ID NO: 29578 - protein, 7 aa, Artificial Sequence
  Synthetic construct
WRIYTCF

SEQ ID NO: 29579 - protein, 7 aa, Artificial Sequence
  Synthetic construct
WRIYTCY

SEQ ID NO: 29580 - protein, 7 aa, Artificial Sequence
  Synthetic construct
WRIYTLF

SEQ ID NO: 29581 - protein, 7 aa, Artificial Sequence
  Synthetic construct
WRIYTLY

SEQ ID NO: 29582 - protein, 7 aa, Artificial Sequence
  Synthetic construct
WRIYTAF

SEQ ID NO: 29583 - protein, 7 aa, Artificial Sequence
  Synthetic construct
WRIYTAY

SEQ ID NO: 29584 - protein, 7 aa, Artificial Sequence
  Synthetic construct
WRIYTQF

SEQ ID NO: 29585 - protein, 7 aa, Artificial Sequence
  Synthetic construct
WRIYTQY

SEQ ID NO: 29586 - protein, 7 aa, Artificial Sequence
  Synthetic construct
WRIYTDF

SEQ ID NO: 29587 - protein, 7 aa, Artificial Sequence
  Synthetic construct
WRIYTDY

SEQ ID NO: 29588 - protein, 7 aa, Artificial Sequence
  Synthetic construct
WRIYTVF

SEQ ID NO: 29589 - protein, 7 aa, Artificial Sequence
  Synthetic construct
WRIYTVY

SEQ ID NO: 29590 - protein, 7 aa, Artificial Sequence
  Synthetic construct
WRIYGFF

SEQ ID NO: 29591 - protein, 7 aa, Artificial Sequence
  Synthetic construct
WRIYGFY

SEQ ID NO: 29592 - protein, 7 aa, Artificial Sequence
  Synthetic construct
WRIYGRF

SEQ ID NO: 29593 - protein, 7 aa, Artificial Sequence
  Synthetic construct
WRIYGRY

SEQ ID NO: 29594 - protein, 7 aa, Artificial Sequence
  Synthetic construct
WRIYGCF

SEQ ID NO: 29595 - protein, 7 aa, Artificial Sequence
  Synthetic construct
WRIYGCY

SEQ ID NO: 29596 - protein, 7 aa, Artificial Sequence
  Synthetic construct
WRIYGLF

SEQ ID NO: 29597 - protein, 7 aa, Artificial Sequence
  Synthetic construct
WRIYGLY

SEQ ID NO: 29598 - protein, 7 aa, Artificial Sequence
  Synthetic construct
WRIYGAF

SEQ ID NO: 29599 - protein, 7 aa, Artificial Sequence
  Synthetic construct
WRIYGAY

SEQ ID NO: 29600 - protein, 7 aa, Artificial Sequence
  Synthetic construct
WRIYGQF

SEQ ID NO: 29601 - protein, 7 aa, Artificial Sequence
  Synthetic construct
WRIYGQY

SEQ ID NO: 29602 - protein, 7 aa, Artificial Sequence
  Synthetic construct
WRIYGDF

SEQ ID NO: 29603 - protein, 7 aa, Artificial Sequence
  Synthetic construct
WRIYGDY

SEQ ID NO: 29604 - protein, 7 aa, Artificial Sequence
  Synthetic construct
WRIYGVF

SEQ ID NO: 29605 - protein, 7 aa, Artificial Sequence
  Synthetic construct
WRIYGVY

SEQ ID NO: 29606 - protein, 7 aa, Artificial Sequence
  Synthetic construct
WRIYAFF

SEQ ID NO: 29607 - protein, 7 aa, Artificial Sequence
  Synthetic construct
WRIYAFY

SEQ ID NO: 29608 - protein, 7 aa, Artificial Sequence
  Synthetic construct
WRIYARF

SEQ ID NO: 29609 - protein, 7 aa, Artificial Sequence
  Synthetic construct
WRIYARY

SEQ ID NO: 29610 - protein, 7 aa, Artificial Sequence
  Synthetic construct
WRIYACF

SEQ ID NO: 29611 - protein, 7 aa, Artificial Sequence
  Synthetic construct
WRIYACY

SEQ ID NO: 29612 - protein, 7 aa, Artificial Sequence
  Synthetic construct
WRIYALF

SEQ ID NO: 29613 - protein, 7 aa, Artificial Sequence
  Synthetic construct
WRIYALY

SEQ ID NO: 29614 - protein, 7 aa, Artificial Sequence
  Synthetic construct
WRIYAAF

SEQ ID NO: 29615 - protein, 7 aa, Artificial Sequence
  Synthetic construct
WRIYAAY

SEQ ID NO: 29616 - protein, 7 aa, Artificial Sequence
  Synthetic construct
WRIYAQF

SEQ ID NO: 29617 - protein, 7 aa, Artificial Sequence
  Synthetic construct
WRIYAQY

SEQ ID NO: 29618 - protein, 7 aa, Artificial Sequence
  Synthetic construct
WRIYADF

SEQ ID NO: 29619 - protein, 7 aa, Artificial Sequence
  Synthetic construct
WRIYADY

SEQ ID NO: 29620 - protein, 7 aa, Artificial Sequence
  Synthetic construct
WRIYAVF

SEQ ID NO: 29621 - protein, 7 aa, Artificial Sequence
  Synthetic construct
WRIYAVY

SEQ ID NO: 29622 - protein, 7 aa, Artificial Sequence
  Synthetic construct
WRIYQFF

SEQ ID NO: 29623 - protein, 7 aa, Artificial Sequence
  Synthetic construct
WRIYQFY

SEQ ID NO: 29624 - protein, 7 aa, Artificial Sequence
  Synthetic construct
WRIYQRF

SEQ ID NO: 29625 - protein, 7 aa, Artificial Sequence
  Synthetic construct
WRIYQRY

SEQ ID NO: 29626 - protein, 7 aa, Artificial Sequence
  Synthetic construct
WRIYQCF

SEQ ID NO: 29627 - protein, 7 aa, Artificial Sequence
  Synthetic construct
WRIYQCY

SEQ ID NO: 29628 - protein, 7 aa, Artificial Sequence
  Synthetic construct
WRIYQLF

SEQ ID NO: 29629 - protein, 7 aa, Artificial Sequence
  Synthetic construct
WRIYQLY

SEQ ID NO: 29630 - protein, 7 aa, Artificial Sequence
  Synthetic construct
WRIYQAF

SEQ ID NO: 29631 - protein, 7 aa, Artificial Sequence
  Synthetic construct
WRIYQAY

SEQ ID NO: 29632 - protein, 7 aa, Artificial Sequence
  Synthetic construct
WRIYQQF

SEQ ID NO: 29633 - protein, 7 aa, Artificial Sequence
  Synthetic construct
WRIYQQY

SEQ ID NO: 29634 - protein, 7 aa, Artificial Sequence
  Synthetic construct
WRIYQDF

SEQ ID NO: 29635 - protein, 7 aa, Artificial Sequence
  Synthetic construct
WRIYQDY

SEQ ID NO: 29636 - protein, 7 aa, Artificial Sequence
  Synthetic construct
WRIYQVF

SEQ ID NO: 29637 - protein, 7 aa, Artificial Sequence
  Synthetic construct
WRIYQVY

SEQ ID NO: 29638 - protein, 7 aa, Artificial Sequence
  Synthetic construct
WRIPIFF

SEQ ID NO: 29639 - protein, 7 aa, Artificial Sequence
  Synthetic construct
WRIPIFY

SEQ ID NO: 29640 - protein, 7 aa, Artificial Sequence
  Synthetic construct
WRIPIRF

SEQ ID NO: 29641 - protein, 7 aa, Artificial Sequence
  Synthetic construct
WRIPIRY

SEQ ID NO: 29642 - protein, 7 aa, Artificial Sequence
  Synthetic construct
WRIPICF

SEQ ID NO: 29643 - protein, 7 aa, Artificial Sequence
  Synthetic construct
WRIPICY

SEQ ID NO: 29644 - protein, 7 aa, Artificial Sequence
  Synthetic construct
WRIPILF

SEQ ID NO: 29645 - protein, 7 aa, Artificial Sequence
  Synthetic construct
WRIPILY

SEQ ID NO: 29646 - protein, 7 aa, Artificial Sequence
  Synthetic construct
WRIPIAF

SEQ ID NO: 29647 - protein, 7 aa, Artificial Sequence
  Synthetic construct
WRIPIAY

SEQ ID NO: 29648 - protein, 7 aa, Artificial Sequence
  Synthetic construct
WRIPIQF

SEQ ID NO: 29649 - protein, 7 aa, Artificial Sequence
  Synthetic construct
WRIPIQY

SEQ ID NO: 29650 - protein, 7 aa, Artificial Sequence
  Synthetic construct
WRIPIDF

SEQ ID NO: 29651 - protein, 7 aa, Artificial Sequence
  Synthetic construct
WRIPIDY

SEQ ID NO: 29652 - protein, 7 aa, Artificial Sequence
  Synthetic construct
WRIPIVF

SEQ ID NO: 29653 - protein, 7 aa, Artificial Sequence
  Synthetic construct
WRIPIVY

SEQ ID NO: 29654 - protein, 7 aa, Artificial Sequence
  Synthetic construct
WRIPDFF

SEQ ID NO: 29655 - protein, 7 aa, Artificial Sequence
  Synthetic construct
WRIPDFY

SEQ ID NO: 29656 - protein, 7 aa, Artificial Sequence
  Synthetic construct
WRIPDRF

SEQ ID NO: 29657 - protein, 7 aa, Artificial Sequence
  Synthetic construct
WRIPDRY

SEQ ID NO: 29658 - protein, 7 aa, Artificial Sequence
  Synthetic construct
WRIPDCF

SEQ ID NO: 29659 - protein, 7 aa, Artificial Sequence
  Synthetic construct
WRIPDCY

SEQ ID NO: 29660 - protein, 7 aa, Artificial Sequence
  Synthetic construct
WRIPDLF

SEQ ID NO: 29661 - protein, 7 aa, Artificial Sequence
  Synthetic construct
WRIPDLY

SEQ ID NO: 29662 - protein, 7 aa, Artificial Sequence
  Synthetic construct
WRIPDAF

SEQ ID NO: 29663 - protein, 7 aa, Artificial Sequence
  Synthetic construct
WRIPDAY

SEQ ID NO: 29664 - protein, 7 aa, Artificial Sequence
  Synthetic construct
WRIPDQF

SEQ ID NO: 29665 - protein, 7 aa, Artificial Sequence
  Synthetic construct
WRIPDQY

SEQ ID NO: 29666 - protein, 7 aa, Artificial Sequence
  Synthetic construct
WRIPDDF

SEQ ID NO: 29667 - protein, 7 aa, Artificial Sequence
  Synthetic construct
WRIPDDY

SEQ ID NO: 29668 - protein, 7 aa, Artificial Sequence
  Synthetic construct
WRIPDVF

SEQ ID NO: 29669 - protein, 7 aa, Artificial Sequence
  Synthetic construct
WRIPDVY

SEQ ID NO: 29670 - protein, 7 aa, Artificial Sequence
  Synthetic construct
WRIPYFF

SEQ ID NO: 29671 - protein, 7 aa, Artificial Sequence
  Synthetic construct
WRIPYFY

SEQ ID NO: 29672 - protein, 7 aa, Artificial Sequence
  Synthetic construct
WRIPYRF

SEQ ID NO: 29673 - protein, 7 aa, Artificial Sequence
  Synthetic construct
WRIPYRY

SEQ ID NO: 29674 - protein, 7 aa, Artificial Sequence
  Synthetic construct
WRIPYCF

SEQ ID NO: 29675 - protein, 7 aa, Artificial Sequence
  Synthetic construct
WRIPYCY

SEQ ID NO: 29676 - protein, 7 aa, Artificial Sequence
  Synthetic construct
WRIPYLF

SEQ ID NO: 29677 - protein, 7 aa, Artificial Sequence
  Synthetic construct
WRIPYLY

SEQ ID NO: 29678 - protein, 7 aa, Artificial Sequence
  Synthetic construct
WRIPYAF

SEQ ID NO: 29679 - protein, 7 aa, Artificial Sequence
  Synthetic construct
WRIPYAY

SEQ ID NO: 29680 - protein, 7 aa, Artificial Sequence
  Synthetic construct
WRIPYQF

SEQ ID NO: 29681 - protein, 7 aa, Artificial Sequence
  Synthetic construct
WRIPYQY

SEQ ID NO: 29682 - protein, 7 aa, Artificial Sequence
  Synthetic construct
WRIPYDF

SEQ ID NO: 29683 - protein, 7 aa, Artificial Sequence
  Synthetic construct
WRIPYDY

SEQ ID NO: 29684 - protein, 7 aa, Artificial Sequence
  Synthetic construct
WRIPYVF

SEQ ID NO: 29685 - protein, 7 aa, Artificial Sequence
  Synthetic construct
WRIPYVY

SEQ ID NO: 29686 - protein, 7 aa, Artificial Sequence
  Synthetic construct
WRIPFFF

SEQ ID NO: 29687 - protein, 7 aa, Artificial Sequence
  Synthetic construct
WRIPFFY

SEQ ID NO: 29688 - protein, 7 aa, Artificial Sequence
  Synthetic construct
WRIPFRF

SEQ ID NO: 29689 - protein, 7 aa, Artificial Sequence
  Synthetic construct
WRIPFRY

SEQ ID NO: 29690 - protein, 7 aa, Artificial Sequence
  Synthetic construct
WRIPFCF

SEQ ID NO: 29691 - protein, 7 aa, Artificial Sequence
  Synthetic construct
WRIPFCY

SEQ ID NO: 29692 - protein, 7 aa, Artificial Sequence
  Synthetic construct
WRIPFLF

SEQ ID NO: 29693 - protein, 7 aa, Artificial Sequence
  Synthetic construct
WRIPFLY

SEQ ID NO: 29694 - protein, 7 aa, Artificial Sequence
  Synthetic construct
WRIPFAF

SEQ ID NO: 29695 - protein, 7 aa, Artificial Sequence
  Synthetic construct
WRIPFAY

SEQ ID NO: 29696 - protein, 7 aa, Artificial Sequence
  Synthetic construct
WRIPFQF

SEQ ID NO: 29697 - protein, 7 aa, Artificial Sequence
  Synthetic construct
WRIPFQY

SEQ ID NO: 29698 - protein, 7 aa, Artificial Sequence
  Synthetic construct
WRIPFDF

SEQ ID NO: 29699 - protein, 7 aa, Artificial Sequence
  Synthetic construct
WRIPFDY

SEQ ID NO: 29700 - protein, 7 aa, Artificial Sequence
  Synthetic construct
WRIPFVF

SEQ ID NO: 29701 - protein, 7 aa, Artificial Sequence
  Synthetic construct
WRIPFVY

SEQ ID NO: 29702 - protein, 7 aa, Artificial Sequence
  Synthetic construct
WRIPVFF

SEQ ID NO: 29703 - protein, 7 aa, Artificial Sequence
  Synthetic construct
WRIPVFY

SEQ ID NO: 29704 - protein, 7 aa, Artificial Sequence
  Synthetic construct
WRIPVRF

SEQ ID NO: 29705 - protein, 7 aa, Artificial Sequence
  Synthetic construct
WRIPVRY

SEQ ID NO: 29706 - protein, 7 aa, Artificial Sequence
  Synthetic construct
WRIPVCF

SEQ ID NO: 29707 - protein, 7 aa, Artificial Sequence
  Synthetic construct
WRIPVCY

SEQ ID NO: 29708 - protein, 7 aa, Artificial Sequence
  Synthetic construct
WRIPVLF

SEQ ID NO: 29709 - protein, 7 aa, Artificial Sequence
  Synthetic construct
WRIPVLY

SEQ ID NO: 29710 - protein, 7 aa, Artificial Sequence
  Synthetic construct
WRIPVAF

SEQ ID NO: 29711 - protein, 7 aa, Artificial Sequence
  Synthetic construct
WRIPVAY

SEQ ID NO: 29712 - protein, 7 aa, Artificial Sequence
  Synthetic construct
WRIPVQF

SEQ ID NO: 29713 - protein, 7 aa, Artificial Sequence
  Synthetic construct
WRIPVQY

SEQ ID NO: 29714 - protein, 7 aa, Artificial Sequence
  Synthetic construct
WRIPVDF

SEQ ID NO: 29715 - protein, 7 aa, Artificial Sequence
  Synthetic construct
WRIPVDY

SEQ ID NO: 29716 - protein, 7 aa, Artificial Sequence
  Synthetic construct
WRIPVVF

SEQ ID NO: 29717 - protein, 7 aa, Artificial Sequence
  Synthetic construct
WRIPVVY

SEQ ID NO: 29718 - protein, 7 aa, Artificial Sequence
  Synthetic construct
WRIPTFF

SEQ ID NO: 29719 - protein, 7 aa, Artificial Sequence
  Synthetic construct
WRIPTFY

SEQ ID NO: 29720 - protein, 7 aa, Artificial Sequence
  Synthetic construct
WRIPTRF

SEQ ID NO: 29721 - protein, 7 aa, Artificial Sequence
  Synthetic construct
WRIPTRY

SEQ ID NO: 29722 - protein, 7 aa, Artificial Sequence
  Synthetic construct
WRIPTCF

SEQ ID NO: 29723 - protein, 7 aa, Artificial Sequence
  Synthetic construct
WRIPTCY

SEQ ID NO: 29724 - protein, 7 aa, Artificial Sequence
  Synthetic construct
WRIPTLF

SEQ ID NO: 29725 - protein, 7 aa, Artificial Sequence
  Synthetic construct
WRIPTLY

SEQ ID NO: 29726 - protein, 7 aa, Artificial Sequence
  Synthetic construct
WRIPTAF

SEQ ID NO: 29727 - protein, 7 aa, Artificial Sequence
  Synthetic construct
WRIPTAY

SEQ ID NO: 29728 - protein, 7 aa, Artificial Sequence
  Synthetic construct
WRIPTQF

SEQ ID NO: 29729 - protein, 7 aa, Artificial Sequence
  Synthetic construct
WRIPTQY

SEQ ID NO: 29730 - protein, 7 aa, Artificial Sequence
  Synthetic construct
WRIPTDF

SEQ ID NO: 29731 - protein, 7 aa, Artificial Sequence
  Synthetic construct
WRIPTDY

SEQ ID NO: 29732 - protein, 7 aa, Artificial Sequence
  Synthetic construct
WRIPTVF

SEQ ID NO: 29733 - protein, 7 aa, Artificial Sequence
  Synthetic construct
WRIPTVY

SEQ ID NO: 29734 - protein, 7 aa, Artificial Sequence
  Synthetic construct
WRIPGFF

SEQ ID NO: 29735 - protein, 7 aa, Artificial Sequence
  Synthetic construct
WRIPGFY

SEQ ID NO: 29736 - protein, 7 aa, Artificial Sequence
  Synthetic construct
WRIPGRF

SEQ ID NO: 29737 - protein, 7 aa, Artificial Sequence
  Synthetic construct
WRIPGRY

SEQ ID NO: 29738 - protein, 7 aa, Artificial Sequence
  Synthetic construct
WRIPGCF

SEQ ID NO: 29739 - protein, 7 aa, Artificial Sequence
  Synthetic construct
WRIPGCY

SEQ ID NO: 29740 - protein, 7 aa, Artificial Sequence
  Synthetic construct
WRIPGLF

SEQ ID NO: 29741 - protein, 7 aa, Artificial Sequence
  Synthetic construct
WRIPGLY

SEQ ID NO: 29742 - protein, 7 aa, Artificial Sequence
  Synthetic construct
WRIPGAF

SEQ ID NO: 29743 - protein, 7 aa, Artificial Sequence
  Synthetic construct
WRIPGAY

SEQ ID NO: 29744 - protein, 7 aa, Artificial Sequence
  Synthetic construct
WRIPGQF

SEQ ID NO: 29745 - protein, 7 aa, Artificial Sequence
  Synthetic construct
WRIPGQY

SEQ ID NO: 29746 - protein, 7 aa, Artificial Sequence
  Synthetic construct
WRIPGDF

SEQ ID NO: 29747 - protein, 7 aa, Artificial Sequence
  Synthetic construct
WRIPGDY

SEQ ID NO: 29748 - protein, 7 aa, Artificial Sequence
  Synthetic construct
WRIPGVF

SEQ ID NO: 29749 - protein, 7 aa, Artificial Sequence
  Synthetic construct
WRIPGVY

SEQ ID NO: 29750 - protein, 7 aa, Artificial Sequence
  Synthetic construct
WRIPAFF

SEQ ID NO: 29751 - protein, 7 aa, Artificial Sequence
  Synthetic construct
WRIPAFY

SEQ ID NO: 29752 - protein, 7 aa, Artificial Sequence
  Synthetic construct
WRIPARF

SEQ ID NO: 29753 - protein, 7 aa, Artificial Sequence
  Synthetic construct
WRIPARY

SEQ ID NO: 29754 - protein, 7 aa, Artificial Sequence
  Synthetic construct
WRIPACF

SEQ ID NO: 29755 - protein, 7 aa, Artificial Sequence
  Synthetic construct
WRIPACY

SEQ ID NO: 29756 - protein, 7 aa, Artificial Sequence
  Synthetic construct
WRIPALF

SEQ ID NO: 29757 - protein, 7 aa, Artificial Sequence
  Synthetic construct
WRIPALY

SEQ ID NO: 29758 - protein, 7 aa, Artificial Sequence
  Synthetic construct
WRIPAAF

SEQ ID NO: 29759 - protein, 7 aa, Artificial Sequence
  Synthetic construct
WRIPAAY

SEQ ID NO: 29760 - protein, 7 aa, Artificial Sequence
  Synthetic construct
WRIPAQF

SEQ ID NO: 29761 - protein, 7 aa, Artificial Sequence
  Synthetic construct
WRIPAQY

SEQ ID NO: 29762 - protein, 7 aa, Artificial Sequence
  Synthetic construct
WRIPADF

SEQ ID NO: 29763 - protein, 7 aa, Artificial Sequence
  Synthetic construct
WRIPADY

SEQ ID NO: 29764 - protein, 7 aa, Artificial Sequence
  Synthetic construct
WRIPAVF

SEQ ID NO: 29765 - protein, 7 aa, Artificial Sequence
  Synthetic construct
WRIPAVY

SEQ ID NO: 29766 - protein, 7 aa, Artificial Sequence
  Synthetic construct
WRIPQFF

SEQ ID NO: 29767 - protein, 7 aa, Artificial Sequence
  Synthetic construct
WRIPQFY

SEQ ID NO: 29768 - protein, 7 aa, Artificial Sequence
  Synthetic construct
WRIPQRF

SEQ ID NO: 29769 - protein, 7 aa, Artificial Sequence
  Synthetic construct
WRIPQRY

SEQ ID NO: 29770 - protein, 7 aa, Artificial Sequence
  Synthetic construct
WRIPQCF

SEQ ID NO: 29771 - protein, 7 aa, Artificial Sequence
  Synthetic construct
WRIPQCY

SEQ ID NO: 29772 - protein, 7 aa, Artificial Sequence
  Synthetic construct
WRIPQLF

SEQ ID NO: 29773 - protein, 7 aa, Artificial Sequence
  Synthetic construct
WRIPQLY

SEQ ID NO: 29774 - protein, 7 aa, Artificial Sequence
  Synthetic construct
WRIPQAF

SEQ ID NO: 29775 - protein, 7 aa, Artificial Sequence
  Synthetic construct
WRIPQAY

SEQ ID NO: 29776 - protein, 7 aa, Artificial Sequence
  Synthetic construct
WRIPQQF

SEQ ID NO: 29777 - protein, 7 aa, Artificial Sequence
  Synthetic construct
WRIPQQY

SEQ ID NO: 29778 - protein, 7 aa, Artificial Sequence
  Synthetic construct
WRIPQDF

SEQ ID NO: 29779 - protein, 7 aa, Artificial Sequence
  Synthetic construct
WRIPQDY

SEQ ID NO: 29780 - protein, 7 aa, Artificial Sequence
  Synthetic construct
WRIPQVF

SEQ ID NO: 29781 - protein, 7 aa, Artificial Sequence
  Synthetic construct
WRIPQVY

SEQ ID NO: 29782 - protein, 7 aa, Artificial Sequence
  Synthetic construct
WRIHIFF

SEQ ID NO: 29783 - protein, 7 aa, Artificial Sequence
  Synthetic construct
WRIHIFY

SEQ ID NO: 29784 - protein, 7 aa, Artificial Sequence
  Synthetic construct
WRIHIRF

SEQ ID NO: 29785 - protein, 7 aa, Artificial Sequence
  Synthetic construct
WRIHIRY

SEQ ID NO: 29786 - protein, 7 aa, Artificial Sequence
  Synthetic construct
WRIHICF

SEQ ID NO: 29787 - protein, 7 aa, Artificial Sequence
  Synthetic construct
WRIHICY

SEQ ID NO: 29788 - protein, 7 aa, Artificial Sequence
  Synthetic construct
WRIHILF

SEQ ID NO: 29789 - protein, 7 aa, Artificial Sequence
  Synthetic construct
WRIHILY

SEQ ID NO: 29790 - protein, 7 aa, Artificial Sequence
  Synthetic construct
WRIHIAF

SEQ ID NO: 29791 - protein, 7 aa, Artificial Sequence
  Synthetic construct
WRIHIAY

SEQ ID NO: 29792 - protein, 7 aa, Artificial Sequence
  Synthetic construct
WRIHIQF

SEQ ID NO: 29793 - protein, 7 aa, Artificial Sequence
  Synthetic construct
WRIHIQY

SEQ ID NO: 29794 - protein, 7 aa, Artificial Sequence
  Synthetic construct
WRIHIDF

SEQ ID NO: 29795 - protein, 7 aa, Artificial Sequence
  Synthetic construct
WRIHIDY

SEQ ID NO: 29796 - protein, 7 aa, Artificial Sequence
  Synthetic construct
WRIHIVF

SEQ ID NO: 29797 - protein, 7 aa, Artificial Sequence
  Synthetic construct
WRIHIVY

SEQ ID NO: 29798 - protein, 7 aa, Artificial Sequence
  Synthetic construct
WRIHDFF

SEQ ID NO: 29799 - protein, 7 aa, Artificial Sequence
  Synthetic construct
WRIHDFY

SEQ ID NO: 29800 - protein, 7 aa, Artificial Sequence
  Synthetic construct
WRIHDRF

SEQ ID NO: 29801 - protein, 7 aa, Artificial Sequence
  Synthetic construct
WRIHDRY

SEQ ID NO: 29802 - protein, 7 aa, Artificial Sequence
  Synthetic construct
WRIHDCF

SEQ ID NO: 29803 - protein, 7 aa, Artificial Sequence
  Synthetic construct
WRIHDCY

SEQ ID NO: 29804 - protein, 7 aa, Artificial Sequence
  Synthetic construct
WRIHDLF

SEQ ID NO: 29805 - protein, 7 aa, Artificial Sequence
  Synthetic construct
WRIHDLY

SEQ ID NO: 29806 - protein, 7 aa, Artificial Sequence
  Synthetic construct
WRIHDAF

SEQ ID NO: 29807 - protein, 7 aa, Artificial Sequence
  Synthetic construct
WRIHDAY

SEQ ID NO: 29808 - protein, 7 aa, Artificial Sequence
  Synthetic construct
WRIHDQF

SEQ ID NO: 29809 - protein, 7 aa, Artificial Sequence
  Synthetic construct
WRIHDQY

SEQ ID NO: 29810 - protein, 7 aa, Artificial Sequence
  Synthetic construct
WRIHDDF

SEQ ID NO: 29811 - protein, 7 aa, Artificial Sequence
  Synthetic construct
WRIHDDY

SEQ ID NO: 29812 - protein, 7 aa, Artificial Sequence
  Synthetic construct
WRIHDVF

SEQ ID NO: 29813 - protein, 7 aa, Artificial Sequence
  Synthetic construct
WRIHDVY

SEQ ID NO: 29814 - protein, 7 aa, Artificial Sequence
  Synthetic construct
WRIHYFF

SEQ ID NO: 29815 - protein, 7 aa, Artificial Sequence
  Synthetic construct
WRIHYFY

SEQ ID NO: 29816 - protein, 7 aa, Artificial Sequence
  Synthetic construct
WRIHYRF

SEQ ID NO: 29817 - protein, 7 aa, Artificial Sequence
  Synthetic construct
WRIHYRY

SEQ ID NO: 29818 - protein, 7 aa, Artificial Sequence
  Synthetic construct
WRIHYCF

SEQ ID NO: 29819 - protein, 7 aa, Artificial Sequence
  Synthetic construct
WRIHYCY

SEQ ID NO: 29820 - protein, 7 aa, Artificial Sequence
  Synthetic construct
WRIHYLF

SEQ ID NO: 29821 - protein, 7 aa, Artificial Sequence
  Synthetic construct
WRIHYLY

SEQ ID NO: 29822 - protein, 7 aa, Artificial Sequence
  Synthetic construct
WRIHYAF

SEQ ID NO: 29823 - protein, 7 aa, Artificial Sequence
  Synthetic construct
WRIHYAY

SEQ ID NO: 29824 - protein, 7 aa, Artificial Sequence
  Synthetic construct
WRIHYQF

SEQ ID NO: 29825 - protein, 7 aa, Artificial Sequence
  Synthetic construct
WRIHYQY

SEQ ID NO: 29826 - protein, 7 aa, Artificial Sequence
  Synthetic construct
WRIHYDF

SEQ ID NO: 29827 - protein, 7 aa, Artificial Sequence
  Synthetic construct
WRIHYDY

SEQ ID NO: 29828 - protein, 7 aa, Artificial Sequence
  Synthetic construct
WRIHYVF

SEQ ID NO: 29829 - protein, 7 aa, Artificial Sequence
  Synthetic construct
WRIHYVY

SEQ ID NO: 29830 - protein, 7 aa, Artificial Sequence
  Synthetic construct
WRIHFFF

SEQ ID NO: 29831 - protein, 7 aa, Artificial Sequence
  Synthetic construct
WRIHFFY

SEQ ID NO: 29832 - protein, 7 aa, Artificial Sequence
  Synthetic construct
WRIHFRF

SEQ ID NO: 29833 - protein, 7 aa, Artificial Sequence
  Synthetic construct
WRIHFRY

SEQ ID NO: 29834 - protein, 7 aa, Artificial Sequence
  Synthetic construct
WRIHFCF

SEQ ID NO: 29835 - protein, 7 aa, Artificial Sequence
  Synthetic construct
WRIHFCY

SEQ ID NO: 29836 - protein, 7 aa, Artificial Sequence
  Synthetic construct
WRIHFLF

SEQ ID NO: 29837 - protein, 7 aa, Artificial Sequence
  Synthetic construct
WRIHFLY

SEQ ID NO: 29838 - protein, 7 aa, Artificial Sequence
  Synthetic construct
WRIHFAF

SEQ ID NO: 29839 - protein, 7 aa, Artificial Sequence
  Synthetic construct
WRIHFAY

SEQ ID NO: 29840 - protein, 7 aa, Artificial Sequence
  Synthetic construct
WRIHFQF

SEQ ID NO: 29841 - protein, 7 aa, Artificial Sequence
  Synthetic construct
WRIHFQY

SEQ ID NO: 29842 - protein, 7 aa, Artificial Sequence
  Synthetic construct
WRIHFDF

SEQ ID NO: 29843 - protein, 7 aa, Artificial Sequence
  Synthetic construct
WRIHFDY

SEQ ID NO: 29844 - protein, 7 aa, Artificial Sequence
  Synthetic construct
WRIHFVF

SEQ ID NO: 29845 - protein, 7 aa, Artificial Sequence
  Synthetic construct
WRIHFVY

SEQ ID NO: 29846 - protein, 7 aa, Artificial Sequence
  Synthetic construct
WRIHVFF

SEQ ID NO: 29847 - protein, 7 aa, Artificial Sequence
  Synthetic construct
WRIHVFY

SEQ ID NO: 29848 - protein, 7 aa, Artificial Sequence
  Synthetic construct
WRIHVRF

SEQ ID NO: 29849 - protein, 7 aa, Artificial Sequence
  Synthetic construct
WRIHVRY

SEQ ID NO: 29850 - protein, 7 aa, Artificial Sequence
  Synthetic construct
WRIHVCF

SEQ ID NO: 29851 - protein, 7 aa, Artificial Sequence
  Synthetic construct
WRIHVCY

SEQ ID NO: 29852 - protein, 7 aa, Artificial Sequence
  Synthetic construct
WRIHVLF

SEQ ID NO: 29853 - protein, 7 aa, Artificial Sequence
  Synthetic construct
WRIHVLY

SEQ ID NO: 29854 - protein, 7 aa, Artificial Sequence
  Synthetic construct
WRIHVAF

SEQ ID NO: 29855 - protein, 7 aa, Artificial Sequence
  Synthetic construct
WRIHVAY

SEQ ID NO: 29856 - protein, 7 aa, Artificial Sequence
  Synthetic construct
WRIHVQF

SEQ ID NO: 29857 - protein, 7 aa, Artificial Sequence
  Synthetic construct
WRIHVQY

SEQ ID NO: 29858 - protein, 7 aa, Artificial Sequence
  Synthetic construct
WRIHVDF

SEQ ID NO: 29859 - protein, 7 aa, Artificial Sequence
  Synthetic construct
WRIHVDY

SEQ ID NO: 29860 - protein, 7 aa, Artificial Sequence
  Synthetic construct
WRIHVVF

SEQ ID NO: 29861 - protein, 7 aa, Artificial Sequence
  Synthetic construct
WRIHVVY

SEQ ID NO: 29862 - protein, 7 aa, Artificial Sequence
  Synthetic construct
WRIHTFF

SEQ ID NO: 29863 - protein, 7 aa, Artificial Sequence
  Synthetic construct
WRIHTFY

SEQ ID NO: 29864 - protein, 7 aa, Artificial Sequence
  Synthetic construct
WRIHTRF

SEQ ID NO: 29865 - protein, 7 aa, Artificial Sequence
  Synthetic construct
WRIHTRY

SEQ ID NO: 29866 - protein, 7 aa, Artificial Sequence
  Synthetic construct
WRIHTCF

SEQ ID NO: 29867 - protein, 7 aa, Artificial Sequence
  Synthetic construct
WRIHTCY

SEQ ID NO: 29868 - protein, 7 aa, Artificial Sequence
  Synthetic construct
WRIHTLF

SEQ ID NO: 29869 - protein, 7 aa, Artificial Sequence
  Synthetic construct
WRIHTLY

SEQ ID NO: 29870 - protein, 7 aa, Artificial Sequence
  Synthetic construct
WRIHTAF

SEQ ID NO: 29871 - protein, 7 aa, Artificial Sequence
  Synthetic construct
WRIHTAY

SEQ ID NO: 29872 - protein, 7 aa, Artificial Sequence
  Synthetic construct
WRIHTQF

SEQ ID NO: 29873 - protein, 7 aa, Artificial Sequence
  Synthetic construct
WRIHTQY

SEQ ID NO: 29874 - protein, 7 aa, Artificial Sequence
  Synthetic construct
WRIHTDF

SEQ ID NO: 29875 - protein, 7 aa, Artificial Sequence
  Synthetic construct
WRIHTDY

SEQ ID NO: 29876 - protein, 7 aa, Artificial Sequence
  Synthetic construct
WRIHTVF

SEQ ID NO: 29877 - protein, 7 aa, Artificial Sequence
  Synthetic construct
WRIHTVY

SEQ ID NO: 29878 - protein, 7 aa, Artificial Sequence
  Synthetic construct
WRIHGFF

SEQ ID NO: 29879 - protein, 7 aa, Artificial Sequence
  Synthetic construct
WRIHGFY

SEQ ID NO: 29880 - protein, 7 aa, Artificial Sequence
  Synthetic construct
WRIHGRF

SEQ ID NO: 29881 - protein, 7 aa, Artificial Sequence
  Synthetic construct
WRIHGRY

SEQ ID NO: 29882 - protein, 7 aa, Artificial Sequence
  Synthetic construct
WRIHGCF

SEQ ID NO: 29883 - protein, 7 aa, Artificial Sequence
  Synthetic construct
WRIHGCY

SEQ ID NO: 29884 - protein, 7 aa, Artificial Sequence
  Synthetic construct
WRIHGLF

SEQ ID NO: 29885 - protein, 7 aa, Artificial Sequence
  Synthetic construct
WRIHGLY

SEQ ID NO: 29886 - protein, 7 aa, Artificial Sequence
  Synthetic construct
WRIHGAF

SEQ ID NO: 29887 - protein, 7 aa, Artificial Sequence
  Synthetic construct
WRIHGAY

SEQ ID NO: 29888 - protein, 7 aa, Artificial Sequence
  Synthetic construct
WRIHGQF

SEQ ID NO: 29889 - protein, 7 aa, Artificial Sequence
  Synthetic construct
WRIHGQY

SEQ ID NO: 29890 - protein, 7 aa, Artificial Sequence
  Synthetic construct
WRIHGDF

SEQ ID NO: 29891 - protein, 7 aa, Artificial Sequence
  Synthetic construct
WRIHGDY

SEQ ID NO: 29892 - protein, 7 aa, Artificial Sequence
  Synthetic construct
WRIHGVF

SEQ ID NO: 29893 - protein, 7 aa, Artificial Sequence
  Synthetic construct
WRIHGVY

SEQ ID NO: 29894 - protein, 7 aa, Artificial Sequence
  Synthetic construct
WRIHAFF

SEQ ID NO: 29895 - protein, 7 aa, Artificial Sequence
  Synthetic construct
WRIHAFY

SEQ ID NO: 29896 - protein, 7 aa, Artificial Sequence
  Synthetic construct
WRIHARF

SEQ ID NO: 29897 - protein, 7 aa, Artificial Sequence
  Synthetic construct
WRIHARY

SEQ ID NO: 29898 - protein, 7 aa, Artificial Sequence
  Synthetic construct
WRIHACF

SEQ ID NO: 29899 - protein, 7 aa, Artificial Sequence
  Synthetic construct
WRIHACY

SEQ ID NO: 29900 - protein, 7 aa, Artificial Sequence
  Synthetic construct
WRIHALF

SEQ ID NO: 29901 - protein, 7 aa, Artificial Sequence
  Synthetic construct
WRIHALY

SEQ ID NO: 29902 - protein, 7 aa, Artificial Sequence
  Synthetic construct
WRIHAAF

SEQ ID NO: 29903 - protein, 7 aa, Artificial Sequence
  Synthetic construct
WRIHAAY

SEQ ID NO: 29904 - protein, 7 aa, Artificial Sequence
  Synthetic construct
WRIHAQF

SEQ ID NO: 29905 - protein, 7 aa, Artificial Sequence
  Synthetic construct
WRIHAQY

SEQ ID NO: 29906 - protein, 7 aa, Artificial Sequence
  Synthetic construct
WRIHADF

SEQ ID NO: 29907 - protein, 7 aa, Artificial Sequence
  Synthetic construct
WRIHADY

SEQ ID NO: 29908 - protein, 7 aa, Artificial Sequence
  Synthetic construct
WRIHAVF

SEQ ID NO: 29909 - protein, 7 aa, Artificial Sequence
  Synthetic construct
WRIHAVY

SEQ ID NO: 29910 - protein, 7 aa, Artificial Sequence
  Synthetic construct
WRIHQFF

SEQ ID NO: 29911 - protein, 7 aa, Artificial Sequence
  Synthetic construct
WRIHQFY

SEQ ID NO: 29912 - protein, 7 aa, Artificial Sequence
  Synthetic construct
WRIHQRF

SEQ ID NO: 29913 - protein, 7 aa, Artificial Sequence
  Synthetic construct
WRIHQRY

SEQ ID NO: 29914 - protein, 7 aa, Artificial Sequence
  Synthetic construct
WRIHQCF

SEQ ID NO: 29915 - protein, 7 aa, Artificial Sequence
  Synthetic construct
WRIHQCY

SEQ ID NO: 29916 - protein, 7 aa, Artificial Sequence
  Synthetic construct
WRIHQLF

SEQ ID NO: 29917 - protein, 7 aa, Artificial Sequence
  Synthetic construct
WRIHQLY

SEQ ID NO: 29918 - protein, 7 aa, Artificial Sequence
  Synthetic construct
WRIHQAF

SEQ ID NO: 29919 - protein, 7 aa, Artificial Sequence
  Synthetic construct
WRIHQAY

SEQ ID NO: 29920 - protein, 7 aa, Artificial Sequence
  Synthetic construct
WRIHQQF

SEQ ID NO: 29921 - protein, 7 aa, Artificial Sequence
  Synthetic construct
WRIHQQY

SEQ ID NO: 29922 - protein, 7 aa, Artificial Sequence
  Synthetic construct
WRIHQDF

SEQ ID NO: 29923 - protein, 7 aa, Artificial Sequence
  Synthetic construct
WRIHQDY

SEQ ID NO: 29924 - protein, 7 aa, Artificial Sequence
  Synthetic construct
WRIHQVF

SEQ ID NO: 29925 - protein, 7 aa, Artificial Sequence
  Synthetic construct
WRIHQVY

SEQ ID NO: 29926 - protein, 7 aa, Artificial Sequence
  Synthetic construct
WRILIFF

SEQ ID NO: 29927 - protein, 7 aa, Artificial Sequence
  Synthetic construct
WRILIFY

SEQ ID NO: 29928 - protein, 7 aa, Artificial Sequence
  Synthetic construct
WRILIRF

SEQ ID NO: 29929 - protein, 7 aa, Artificial Sequence
  Synthetic construct
WRILIRY

SEQ ID NO: 29930 - protein, 7 aa, Artificial Sequence
  Synthetic construct
WRILICF

SEQ ID NO: 29931 - protein, 7 aa, Artificial Sequence
  Synthetic construct
WRILICY

SEQ ID NO: 29932 - protein, 7 aa, Artificial Sequence
  Synthetic construct
WRILILF

SEQ ID NO: 29933 - protein, 7 aa, Artificial Sequence
  Synthetic construct
WRILILY

SEQ ID NO: 29934 - protein, 7 aa, Artificial Sequence
  Synthetic construct
WRILIAF

SEQ ID NO: 29935 - protein, 7 aa, Artificial Sequence
  Synthetic construct
WRILIAY

SEQ ID NO: 29936 - protein, 7 aa, Artificial Sequence
  Synthetic construct
WRILIQF

SEQ ID NO: 29937 - protein, 7 aa, Artificial Sequence
  Synthetic construct
WRILIQY

SEQ ID NO: 29938 - protein, 7 aa, Artificial Sequence
  Synthetic construct
WRILIDF

SEQ ID NO: 29939 - protein, 7 aa, Artificial Sequence
  Synthetic construct
WRILIDY

SEQ ID NO: 29940 - protein, 7 aa, Artificial Sequence
  Synthetic construct
WRILIVF

SEQ ID NO: 29941 - protein, 7 aa, Artificial Sequence
  Synthetic construct
WRILIVY

SEQ ID NO: 29942 - protein, 7 aa, Artificial Sequence
  Synthetic construct
WRILDFF

SEQ ID NO: 29943 - protein, 7 aa, Artificial Sequence
  Synthetic construct
WRILDFY

SEQ ID NO: 29944 - protein, 7 aa, Artificial Sequence
  Synthetic construct
WRILDRF

SEQ ID NO: 29945 - protein, 7 aa, Artificial Sequence
  Synthetic construct
WRILDRY

SEQ ID NO: 29946 - protein, 7 aa, Artificial Sequence
  Synthetic construct
WRILDCF

SEQ ID NO: 29947 - protein, 7 aa, Artificial Sequence
  Synthetic construct
WRILDCY

SEQ ID NO: 29948 - protein, 7 aa, Artificial Sequence
  Synthetic construct
WRILDLF

SEQ ID NO: 29949 - protein, 7 aa, Artificial Sequence
  Synthetic construct
WRILDLY

SEQ ID NO: 29950 - protein, 7 aa, Artificial Sequence
  Synthetic construct
WRILDAF

SEQ ID NO: 29951 - protein, 7 aa, Artificial Sequence
  Synthetic construct
WRILDAY

SEQ ID NO: 29952 - protein, 7 aa, Artificial Sequence
  Synthetic construct
WRILDQF

SEQ ID NO: 29953 - protein, 7 aa, Artificial Sequence
  Synthetic construct
WRILDQY

SEQ ID NO: 29954 - protein, 7 aa, Artificial Sequence
  Synthetic construct
WRILDDF

SEQ ID NO: 29955 - protein, 7 aa, Artificial Sequence
  Synthetic construct
WRILDDY

SEQ ID NO: 29956 - protein, 7 aa, Artificial Sequence
  Synthetic construct
WRILDVF

SEQ ID NO: 29957 - protein, 7 aa, Artificial Sequence
  Synthetic construct
WRILDVY

SEQ ID NO: 29958 - protein, 7 aa, Artificial Sequence
  Synthetic construct
WRILYFF

SEQ ID NO: 29959 - protein, 7 aa, Artificial Sequence
  Synthetic construct
WRILYFY

SEQ ID NO: 29960 - protein, 7 aa, Artificial Sequence
  Synthetic construct
WRILYRF

SEQ ID NO: 29961 - protein, 7 aa, Artificial Sequence
  Synthetic construct
WRILYRY

SEQ ID NO: 29962 - protein, 7 aa, Artificial Sequence
  Synthetic construct
WRILYCF

SEQ ID NO: 29963 - protein, 7 aa, Artificial Sequence
  Synthetic construct
WRILYCY

SEQ ID NO: 29964 - protein, 7 aa, Artificial Sequence
  Synthetic construct
WRILYLF

SEQ ID NO: 29965 - protein, 7 aa, Artificial Sequence
  Synthetic construct
WRILYLY

SEQ ID NO: 29966 - protein, 7 aa, Artificial Sequence
  Synthetic construct
WRILYAF

SEQ ID NO: 29967 - protein, 7 aa, Artificial Sequence
  Synthetic construct
WRILYAY

SEQ ID NO: 29968 - protein, 7 aa, Artificial Sequence
  Synthetic construct
WRILYQF

SEQ ID NO: 29969 - protein, 7 aa, Artificial Sequence
  Synthetic construct
WRILYQY

SEQ ID NO: 29970 - protein, 7 aa, Artificial Sequence
  Synthetic construct
WRILYDF

SEQ ID NO: 29971 - protein, 7 aa, Artificial Sequence
  Synthetic construct
WRILYDY

SEQ ID NO: 29972 - protein, 7 aa, Artificial Sequence
  Synthetic construct
WRILYVF

SEQ ID NO: 29973 - protein, 7 aa, Artificial Sequence
  Synthetic construct
WRILYVY

SEQ ID NO: 29974 - protein, 7 aa, Artificial Sequence
  Synthetic construct
WRILFFF

SEQ ID NO: 29975 - protein, 7 aa, Artificial Sequence
  Synthetic construct
WRILFFY

SEQ ID NO: 29976 - protein, 7 aa, Artificial Sequence
  Synthetic construct
WRILFRF

SEQ ID NO: 29977 - protein, 7 aa, Artificial Sequence
  Synthetic construct
WRILFRY

SEQ ID NO: 29978 - protein, 7 aa, Artificial Sequence
  Synthetic construct
WRILFCF

SEQ ID NO: 29979 - protein, 7 aa, Artificial Sequence
  Synthetic construct
WRILFCY

SEQ ID NO: 29980 - protein, 7 aa, Artificial Sequence
  Synthetic construct
WRILFLF

SEQ ID NO: 29981 - protein, 7 aa, Artificial Sequence
  Synthetic construct
WRILFLY

SEQ ID NO: 29982 - protein, 7 aa, Artificial Sequence
  Synthetic construct
WRILFAF

SEQ ID NO: 29983 - protein, 7 aa, Artificial Sequence
  Synthetic construct
WRILFAY

SEQ ID NO: 29984 - protein, 7 aa, Artificial Sequence
  Synthetic construct
WRILFQF

SEQ ID NO: 29985 - protein, 7 aa, Artificial Sequence
  Synthetic construct
WRILFQY

SEQ ID NO: 29986 - protein, 7 aa, Artificial Sequence
  Synthetic construct
WRILFDF

SEQ ID NO: 29987 - protein, 7 aa, Artificial Sequence
  Synthetic construct
WRILFDY

SEQ ID NO: 29988 - protein, 7 aa, Artificial Sequence
  Synthetic construct
WRILFVF

SEQ ID NO: 29989 - protein, 7 aa, Artificial Sequence
  Synthetic construct
WRILFVY

SEQ ID NO: 29990 - protein, 7 aa, Artificial Sequence
  Synthetic construct
WRILVFF

SEQ ID NO: 29991 - protein, 7 aa, Artificial Sequence
  Synthetic construct
WRILVFY

SEQ ID NO: 29992 - protein, 7 aa, Artificial Sequence
  Synthetic construct
WRILVRF

SEQ ID NO: 29993 - protein, 7 aa, Artificial Sequence
  Synthetic construct
WRILVRY

SEQ ID NO: 29994 - protein, 7 aa, Artificial Sequence
  Synthetic construct
WRILVCF

SEQ ID NO: 29995 - protein, 7 aa, Artificial Sequence
  Synthetic construct
WRILVCY

SEQ ID NO: 29996 - protein, 7 aa, Artificial Sequence
  Synthetic construct
WRILVLF

SEQ ID NO: 29997 - protein, 7 aa, Artificial Sequence
  Synthetic construct
WRILVLY

SEQ ID NO: 29998 - protein, 7 aa, Artificial Sequence
  Synthetic construct
WRILVAF

SEQ ID NO: 29999 - protein, 7 aa, Artificial Sequence
  Synthetic construct
WRILVAY

SEQ ID NO: 30000 - protein, 7 aa, Artificial Sequence
  Synthetic construct
WRILVQF

SEQ ID NO: 30001 - protein, 7 aa, Artificial Sequence
  Synthetic construct
WRILVQY

SEQ ID NO: 30002 - protein, 7 aa, Artificial Sequence
  Synthetic construct
WRILVDF

SEQ ID NO: 30003 - protein, 7 aa, Artificial Sequence
  Synthetic construct
WRILVDY

SEQ ID NO: 30004 - protein, 7 aa, Artificial Sequence
  Synthetic construct
WRILVVF

SEQ ID NO: 30005 - protein, 7 aa, Artificial Sequence
  Synthetic construct
WRILVVY

SEQ ID NO: 30006 - protein, 7 aa, Artificial Sequence
  Synthetic construct
WRILTFF

SEQ ID NO: 30007 - protein, 7 aa, Artificial Sequence
  Synthetic construct
WRILTFY

SEQ ID NO: 30008 - protein, 7 aa, Artificial Sequence
  Synthetic construct
WRILTRF

SEQ ID NO: 30009 - protein, 7 aa, Artificial Sequence
  Synthetic construct
WRILTRY

SEQ ID NO: 30010 - protein, 7 aa, Artificial Sequence
  Synthetic construct
WRILTCF

SEQ ID NO: 30011 - protein, 7 aa, Artificial Sequence
  Synthetic construct
WRILTCY

SEQ ID NO: 30012 - protein, 7 aa, Artificial Sequence
  Synthetic construct
WRILTLF

SEQ ID NO: 30013 - protein, 7 aa, Artificial Sequence
  Synthetic construct
WRILTLY

SEQ ID NO: 30014 - protein, 7 aa, Artificial Sequence
  Synthetic construct
WRILTAF

SEQ ID NO: 30015 - protein, 7 aa, Artificial Sequence
  Synthetic construct
WRILTAY

SEQ ID NO: 30016 - protein, 7 aa, Artificial Sequence
  Synthetic construct
WRILTQF

SEQ ID NO: 30017 - protein, 7 aa, Artificial Sequence
  Synthetic construct
WRILTQY

SEQ ID NO: 30018 - protein, 7 aa, Artificial Sequence
  Synthetic construct
WRILTDF

SEQ ID NO: 30019 - protein, 7 aa, Artificial Sequence
  Synthetic construct
WRILTDY

SEQ ID NO: 30020 - protein, 7 aa, Artificial Sequence
  Synthetic construct
WRILTVF

SEQ ID NO: 30021 - protein, 7 aa, Artificial Sequence
  Synthetic construct
WRILTVY

SEQ ID NO: 30022 - protein, 7 aa, Artificial Sequence
  Synthetic construct
WRILGFF

SEQ ID NO: 30023 - protein, 7 aa, Artificial Sequence
  Synthetic construct
WRILGFY

SEQ ID NO: 30024 - protein, 7 aa, Artificial Sequence
  Synthetic construct
WRILGRF

SEQ ID NO: 30025 - protein, 7 aa, Artificial Sequence
  Synthetic construct
WRILGRY

SEQ ID NO: 30026 - protein, 7 aa, Artificial Sequence
  Synthetic construct
WRILGCF

SEQ ID NO: 30027 - protein, 7 aa, Artificial Sequence
  Synthetic construct
WRILGCY

SEQ ID NO: 30028 - protein, 7 aa, Artificial Sequence
  Synthetic construct
WRILGLF

SEQ ID NO: 30029 - protein, 7 aa, Artificial Sequence
  Synthetic construct
WRILGLY

SEQ ID NO: 30030 - protein, 7 aa, Artificial Sequence
  Synthetic construct
WRILGAF

SEQ ID NO: 30031 - protein, 7 aa, Artificial Sequence
  Synthetic construct
WRILGAY

SEQ ID NO: 30032 - protein, 7 aa, Artificial Sequence
  Synthetic construct
WRILGQF

SEQ ID NO: 30033 - protein, 7 aa, Artificial Sequence
  Synthetic construct
WRILGQY

SEQ ID NO: 30034 - protein, 7 aa, Artificial Sequence
  Synthetic construct
WRILGDF

SEQ ID NO: 30035 - protein, 7 aa, Artificial Sequence
  Synthetic construct
WRILGDY

SEQ ID NO: 30036 - protein, 7 aa, Artificial Sequence
  Synthetic construct
WRILGVF

SEQ ID NO: 30037 - protein, 7 aa, Artificial Sequence
  Synthetic construct
WRILGVY

SEQ ID NO: 30038 - protein, 7 aa, Artificial Sequence
  Synthetic construct
WRILAFF

SEQ ID NO: 30039 - protein, 7 aa, Artificial Sequence
  Synthetic construct
WRILAFY

SEQ ID NO: 30040 - protein, 7 aa, Artificial Sequence
  Synthetic construct
WRILARF

SEQ ID NO: 30041 - protein, 7 aa, Artificial Sequence
  Synthetic construct
WRILARY

SEQ ID NO: 30042 - protein, 7 aa, Artificial Sequence
  Synthetic construct
WRILACF

SEQ ID NO: 30043 - protein, 7 aa, Artificial Sequence
  Synthetic construct
WRILACY

SEQ ID NO: 30044 - protein, 7 aa, Artificial Sequence
  Synthetic construct
WRILALF

SEQ ID NO: 30045 - protein, 7 aa, Artificial Sequence
  Synthetic construct
WRILALY

SEQ ID NO: 30046 - protein, 7 aa, Artificial Sequence
  Synthetic construct
WRILAAF

SEQ ID NO: 30047 - protein, 7 aa, Artificial Sequence
  Synthetic construct
WRILAAY

SEQ ID NO: 30048 - protein, 7 aa, Artificial Sequence
  Synthetic construct
WRILAQF

SEQ ID NO: 30049 - protein, 7 aa, Artificial Sequence
  Synthetic construct
WRILAQY

SEQ ID NO: 30050 - protein, 7 aa, Artificial Sequence
  Synthetic construct
WRILADF

SEQ ID NO: 30051 - protein, 7 aa, Artificial Sequence
  Synthetic construct
WRILADY

SEQ ID NO: 30052 - protein, 7 aa, Artificial Sequence
  Synthetic construct
WRILAVF

SEQ ID NO: 30053 - protein, 7 aa, Artificial Sequence
  Synthetic construct
WRILAVY

SEQ ID NO: 30054 - protein, 7 aa, Artificial Sequence
  Synthetic construct
WRILQFF

SEQ ID NO: 30055 - protein, 7 aa, Artificial Sequence
  Synthetic construct
WRILQFY

SEQ ID NO: 30056 - protein, 7 aa, Artificial Sequence
  Synthetic construct
WRILQRF

SEQ ID NO: 30057 - protein, 7 aa, Artificial Sequence
  Synthetic construct
WRILQRY

SEQ ID NO: 30058 - protein, 7 aa, Artificial Sequence
  Synthetic construct
WRILQCF

SEQ ID NO: 30059 - protein, 7 aa, Artificial Sequence
  Synthetic construct
WRILQCY

SEQ ID NO: 30060 - protein, 7 aa, Artificial Sequence
  Synthetic construct
WRILQLF

SEQ ID NO: 30061 - protein, 7 aa, Artificial Sequence
  Synthetic construct
WRILQLY

SEQ ID NO: 30062 - protein, 7 aa, Artificial Sequence
  Synthetic construct
WRILQAF

SEQ ID NO: 30063 - protein, 7 aa, Artificial Sequence
  Synthetic construct
WRILQAY

SEQ ID NO: 30064 - protein, 7 aa, Artificial Sequence
  Synthetic construct
WRILQQF

SEQ ID NO: 30065 - protein, 7 aa, Artificial Sequence
  Synthetic construct
WRILQQY

SEQ ID NO: 30066 - protein, 7 aa, Artificial Sequence
  Synthetic construct
WRILQDF

SEQ ID NO: 30067 - protein, 7 aa, Artificial Sequence
  Synthetic construct
WRILQDY

SEQ ID NO: 30068 - protein, 7 aa, Artificial Sequence
  Synthetic construct
WRILQVF

SEQ ID NO: 30069 - protein, 7 aa, Artificial Sequence
  Synthetic construct
WRILQVY

SEQ ID NO: 30070 - protein, 7 aa, Artificial Sequence
  Synthetic construct
WRIFIFF

SEQ ID NO: 30071 - protein, 7 aa, Artificial Sequence
  Synthetic construct
WRIFIFY

SEQ ID NO: 30072 - protein, 7 aa, Artificial Sequence
  Synthetic construct
WRIFIRF

SEQ ID NO: 30073 - protein, 7 aa, Artificial Sequence
  Synthetic construct
WRIFIRY

SEQ ID NO: 30074 - protein, 7 aa, Artificial Sequence
  Synthetic construct
WRIFICF

SEQ ID NO: 30075 - protein, 7 aa, Artificial Sequence
  Synthetic construct
WRIFICY

SEQ ID NO: 30076 - protein, 7 aa, Artificial Sequence
  Synthetic construct
WRIFILF

SEQ ID NO: 30077 - protein, 7 aa, Artificial Sequence
  Synthetic construct
WRIFILY

SEQ ID NO: 30078 - protein, 7 aa, Artificial Sequence
  Synthetic construct
WRIFIAF

SEQ ID NO: 30079 - protein, 7 aa, Artificial Sequence
  Synthetic construct
WRIFIAY

SEQ ID NO: 30080 - protein, 7 aa, Artificial Sequence
  Synthetic construct
WRIFIQF

SEQ ID NO: 30081 - protein, 7 aa, Artificial Sequence
  Synthetic construct
WRIFIQY

SEQ ID NO: 30082 - protein, 7 aa, Artificial Sequence
  Synthetic construct
WRIFIDF

SEQ ID NO: 30083 - protein, 7 aa, Artificial Sequence
  Synthetic construct
WRIFIDY

SEQ ID NO: 30084 - protein, 7 aa, Artificial Sequence
  Synthetic construct
WRIFIVF

SEQ ID NO: 30085 - protein, 7 aa, Artificial Sequence
  Synthetic construct
WRIFIVY

SEQ ID NO: 30086 - protein, 7 aa, Artificial Sequence
  Synthetic construct
WRIFDFF

SEQ ID NO: 30087 - protein, 7 aa, Artificial Sequence
  Synthetic construct
WRIFDFY

SEQ ID NO: 30088 - protein, 7 aa, Artificial Sequence
  Synthetic construct
WRIFDRF

SEQ ID NO: 30089 - protein, 7 aa, Artificial Sequence
  Synthetic construct
WRIFDRY

SEQ ID NO: 30090 - protein, 7 aa, Artificial Sequence
  Synthetic construct
WRIFDCF

SEQ ID NO: 30091 - protein, 7 aa, Artificial Sequence
  Synthetic construct
WRIFDCY

SEQ ID NO: 30092 - protein, 7 aa, Artificial Sequence
  Synthetic construct
WRIFDLF

SEQ ID NO: 30093 - protein, 7 aa, Artificial Sequence
  Synthetic construct
WRIFDLY

SEQ ID NO: 30094 - protein, 7 aa, Artificial Sequence
  Synthetic construct
WRIFDAF

SEQ ID NO: 30095 - protein, 7 aa, Artificial Sequence
  Synthetic construct
WRIFDAY

SEQ ID NO: 30096 - protein, 7 aa, Artificial Sequence
  Synthetic construct
WRIFDQF

SEQ ID NO: 30097 - protein, 7 aa, Artificial Sequence
  Synthetic construct
WRIFDQY

SEQ ID NO: 30098 - protein, 7 aa, Artificial Sequence
  Synthetic construct
WRIFDDF

SEQ ID NO: 30099 - protein, 7 aa, Artificial Sequence
  Synthetic construct
WRIFDDY

SEQ ID NO: 30100 - protein, 7 aa, Artificial Sequence
  Synthetic construct
WRIFDVF

SEQ ID NO: 30101 - protein, 7 aa, Artificial Sequence
  Synthetic construct
WRIFDVY

SEQ ID NO: 30102 - protein, 7 aa, Artificial Sequence
  Synthetic construct
WRIFYFF

SEQ ID NO: 30103 - protein, 7 aa, Artificial Sequence
  Synthetic construct
WRIFYFY

SEQ ID NO: 30104 - protein, 7 aa, Artificial Sequence
  Synthetic construct
WRIFYRF

SEQ ID NO: 30105 - protein, 7 aa, Artificial Sequence
  Synthetic construct
WRIFYRY

SEQ ID NO: 30106 - protein, 7 aa, Artificial Sequence
  Synthetic construct
WRIFYCF

SEQ ID NO: 30107 - protein, 7 aa, Artificial Sequence
  Synthetic construct
WRIFYCY

SEQ ID NO: 30108 - protein, 7 aa, Artificial Sequence
  Synthetic construct
WRIFYLF

SEQ ID NO: 30109 - protein, 7 aa, Artificial Sequence
  Synthetic construct
WRIFYLY

SEQ ID NO: 30110 - protein, 7 aa, Artificial Sequence
  Synthetic construct
WRIFYAF

SEQ ID NO: 30111 - protein, 7 aa, Artificial Sequence
  Synthetic construct
WRIFYAY

SEQ ID NO: 30112 - protein, 7 aa, Artificial Sequence
  Synthetic construct
WRIFYQF

SEQ ID NO: 30113 - protein, 7 aa, Artificial Sequence
  Synthetic construct
WRIFYQY

SEQ ID NO: 30114 - protein, 7 aa, Artificial Sequence
  Synthetic construct
WRIFYDF

SEQ ID NO: 30115 - protein, 7 aa, Artificial Sequence
  Synthetic construct
WRIFYDY

SEQ ID NO: 30116 - protein, 7 aa, Artificial Sequence
  Synthetic construct
WRIFYVF

SEQ ID NO: 30117 - protein, 7 aa, Artificial Sequence
  Synthetic construct
WRIFYVY

SEQ ID NO: 30118 - protein, 7 aa, Artificial Sequence
  Synthetic construct
WRIFFFF

SEQ ID NO: 30119 - protein, 7 aa, Artificial Sequence
  Synthetic construct
WRIFFFY

SEQ ID NO: 30120 - protein, 7 aa, Artificial Sequence
  Synthetic construct
WRIFFRF

SEQ ID NO: 30121 - protein, 7 aa, Artificial Sequence
  Synthetic construct
WRIFFRY

SEQ ID NO: 30122 - protein, 7 aa, Artificial Sequence
  Synthetic construct
WRIFFCF

SEQ ID NO: 30123 - protein, 7 aa, Artificial Sequence
  Synthetic construct
WRIFFCY

SEQ ID NO: 30124 - protein, 7 aa, Artificial Sequence
  Synthetic construct
WRIFFLF

SEQ ID NO: 30125 - protein, 7 aa, Artificial Sequence
  Synthetic construct
WRIFFLY

SEQ ID NO: 30126 - protein, 7 aa, Artificial Sequence
  Synthetic construct
WRIFFAF

SEQ ID NO: 30127 - protein, 7 aa, Artificial Sequence
  Synthetic construct
WRIFFAY

SEQ ID NO: 30128 - protein, 7 aa, Artificial Sequence
  Synthetic construct
WRIFFQF

SEQ ID NO: 30129 - protein, 7 aa, Artificial Sequence
  Synthetic construct
WRIFFQY

SEQ ID NO: 30130 - protein, 7 aa, Artificial Sequence
  Synthetic construct
WRIFFDF

SEQ ID NO: 30131 - protein, 7 aa, Artificial Sequence
  Synthetic construct
WRIFFDY

SEQ ID NO: 30132 - protein, 7 aa, Artificial Sequence
  Synthetic construct
WRIFFVF

SEQ ID NO: 30133 - protein, 7 aa, Artificial Sequence
  Synthetic construct
WRIFFVY

SEQ ID NO: 30134 - protein, 7 aa, Artificial Sequence
  Synthetic construct
WRIFVFF

SEQ ID NO: 30135 - protein, 7 aa, Artificial Sequence
  Synthetic construct
WRIFVFY

SEQ ID NO: 30136 - protein, 7 aa, Artificial Sequence
  Synthetic construct
WRIFVRF

SEQ ID NO: 30137 - protein, 7 aa, Artificial Sequence
  Synthetic construct
WRIFVRY

SEQ ID NO: 30138 - protein, 7 aa, Artificial Sequence
  Synthetic construct
WRIFVCF

SEQ ID NO: 30139 - protein, 7 aa, Artificial Sequence
  Synthetic construct
WRIFVCY

SEQ ID NO: 30140 - protein, 7 aa, Artificial Sequence
  Synthetic construct
WRIFVLF

SEQ ID NO: 30141 - protein, 7 aa, Artificial Sequence
  Synthetic construct
WRIFVLY

SEQ ID NO: 30142 - protein, 7 aa, Artificial Sequence
  Synthetic construct
WRIFVAF

SEQ ID NO: 30143 - protein, 7 aa, Artificial Sequence
  Synthetic construct
WRIFVAY

SEQ ID NO: 30144 - protein, 7 aa, Artificial Sequence
  Synthetic construct
WRIFVQF

SEQ ID NO: 30145 - protein, 7 aa, Artificial Sequence
  Synthetic construct
WRIFVQY

SEQ ID NO: 30146 - protein, 7 aa, Artificial Sequence
  Synthetic construct
WRIFVDF

SEQ ID NO: 30147 - protein, 7 aa, Artificial Sequence
  Synthetic construct
WRIFVDY

SEQ ID NO: 30148 - protein, 7 aa, Artificial Sequence
  Synthetic construct
WRIFVVF

SEQ ID NO: 30149 - protein, 7 aa, Artificial Sequence
  Synthetic construct
WRIFVVY

SEQ ID NO: 30150 - protein, 7 aa, Artificial Sequence
  Synthetic construct
WRIFTFF

SEQ ID NO: 30151 - protein, 7 aa, Artificial Sequence
  Synthetic construct
WRIFTFY

SEQ ID NO: 30152 - protein, 7 aa, Artificial Sequence
  Synthetic construct
WRIFTRF

SEQ ID NO: 30153 - protein, 7 aa, Artificial Sequence
  Synthetic construct
WRIFTRY

SEQ ID NO: 30154 - protein, 7 aa, Artificial Sequence
  Synthetic construct
WRIFTCF

SEQ ID NO: 30155 - protein, 7 aa, Artificial Sequence
  Synthetic construct
WRIFTCY

SEQ ID NO: 30156 - protein, 7 aa, Artificial Sequence
  Synthetic construct
WRIFTLF

SEQ ID NO: 30157 - protein, 7 aa, Artificial Sequence
  Synthetic construct
WRIFTLY

SEQ ID NO: 30158 - protein, 7 aa, Artificial Sequence
  Synthetic construct
WRIFTAF

SEQ ID NO: 30159 - protein, 7 aa, Artificial Sequence
  Synthetic construct
WRIFTAY

SEQ ID NO: 30160 - protein, 7 aa, Artificial Sequence
  Synthetic construct
WRIFTQF

SEQ ID NO: 30161 - protein, 7 aa, Artificial Sequence
  Synthetic construct
WRIFTQY

SEQ ID NO: 30162 - protein, 7 aa, Artificial Sequence
  Synthetic construct
WRIFTDF

SEQ ID NO: 30163 - protein, 7 aa, Artificial Sequence
  Synthetic construct
WRIFTDY

SEQ ID NO: 30164 - protein, 7 aa, Artificial Sequence
  Synthetic construct
WRIFTVF

SEQ ID NO: 30165 - protein, 7 aa, Artificial Sequence
  Synthetic construct
WRIFTVY

SEQ ID NO: 30166 - protein, 7 aa, Artificial Sequence
  Synthetic construct
WRIFGFF

SEQ ID NO: 30167 - protein, 7 aa, Artificial Sequence
  Synthetic construct
WRIFGFY

SEQ ID NO: 30168 - protein, 7 aa, Artificial Sequence
  Synthetic construct
WRIFGRF

SEQ ID NO: 30169 - protein, 7 aa, Artificial Sequence
  Synthetic construct
WRIFGRY

SEQ ID NO: 30170 - protein, 7 aa, Artificial Sequence
  Synthetic construct
WRIFGCF

SEQ ID NO: 30171 - protein, 7 aa, Artificial Sequence
  Synthetic construct
WRIFGCY

SEQ ID NO: 30172 - protein, 7 aa, Artificial Sequence
  Synthetic construct
WRIFGLF

SEQ ID NO: 30173 - protein, 7 aa, Artificial Sequence
  Synthetic construct
WRIFGLY

SEQ ID NO: 30174 - protein, 7 aa, Artificial Sequence
  Synthetic construct
WRIFGAF

SEQ ID NO: 30175 - protein, 7 aa, Artificial Sequence
  Synthetic construct
WRIFGAY

SEQ ID NO: 30176 - protein, 7 aa, Artificial Sequence
  Synthetic construct
WRIFGQF

SEQ ID NO: 30177 - protein, 7 aa, Artificial Sequence
  Synthetic construct
WRIFGQY

SEQ ID NO: 30178 - protein, 7 aa, Artificial Sequence
  Synthetic construct
WRIFGDF

SEQ ID NO: 30179 - protein, 7 aa, Artificial Sequence
  Synthetic construct
WRIFGDY

SEQ ID NO: 30180 - protein, 7 aa, Artificial Sequence
  Synthetic construct
WRIFGVF

SEQ ID NO: 30181 - protein, 7 aa, Artificial Sequence
  Synthetic construct
WRIFGVY

SEQ ID NO: 30182 - protein, 7 aa, Artificial Sequence
  Synthetic construct
WRIFAFF

SEQ ID NO: 30183 - protein, 7 aa, Artificial Sequence
  Synthetic construct
WRIFAFY

SEQ ID NO: 30184 - protein, 7 aa, Artificial Sequence
  Synthetic construct
WRIFARF

SEQ ID NO: 30185 - protein, 7 aa, Artificial Sequence
  Synthetic construct
WRIFARY

SEQ ID NO: 30186 - protein, 7 aa, Artificial Sequence
  Synthetic construct
WRIFACF

SEQ ID NO: 30187 - protein, 7 aa, Artificial Sequence
  Synthetic construct
WRIFACY

SEQ ID NO: 30188 - protein, 7 aa, Artificial Sequence
  Synthetic construct
WRIFALF

SEQ ID NO: 30189 - protein, 7 aa, Artificial Sequence
  Synthetic construct
WRIFALY

SEQ ID NO: 30190 - protein, 7 aa, Artificial Sequence
  Synthetic construct
WRIFAAF

SEQ ID NO: 30191 - protein, 7 aa, Artificial Sequence
  Synthetic construct
WRIFAAY

SEQ ID NO: 30192 - protein, 7 aa, Artificial Sequence
  Synthetic construct
WRIFAQF

SEQ ID NO: 30193 - protein, 7 aa, Artificial Sequence
  Synthetic construct
WRIFAQY

SEQ ID NO: 30194 - protein, 7 aa, Artificial Sequence
  Synthetic construct
WRIFADF

SEQ ID NO: 30195 - protein, 7 aa, Artificial Sequence
  Synthetic construct
WRIFADY

SEQ ID NO: 30196 - protein, 7 aa, Artificial Sequence
  Synthetic construct
WRIFAVF

SEQ ID NO: 30197 - protein, 7 aa, Artificial Sequence
  Synthetic construct
WRIFAVY

SEQ ID NO: 30198 - protein, 7 aa, Artificial Sequence
  Synthetic construct
WRIFQFF

SEQ ID NO: 30199 - protein, 7 aa, Artificial Sequence
  Synthetic construct
WRIFQFY

SEQ ID NO: 30200 - protein, 7 aa, Artificial Sequence
  Synthetic construct
WRIFQRF

SEQ ID NO: 30201 - protein, 7 aa, Artificial Sequence
  Synthetic construct
WRIFQRY

SEQ ID NO: 30202 - protein, 7 aa, Artificial Sequence
  Synthetic construct
WRIFQCF

SEQ ID NO: 30203 - protein, 7 aa, Artificial Sequence
  Synthetic construct
WRIFQCY

SEQ ID NO: 30204 - protein, 7 aa, Artificial Sequence
  Synthetic construct
WRIFQLF

SEQ ID NO: 30205 - protein, 7 aa, Artificial Sequence
  Synthetic construct
WRIFQLY

SEQ ID NO: 30206 - protein, 7 aa, Artificial Sequence
  Synthetic construct
WRIFQAF

SEQ ID NO: 30207 - protein, 7 aa, Artificial Sequence
  Synthetic construct
WRIFQAY

SEQ ID NO: 30208 - protein, 7 aa, Artificial Sequence
  Synthetic construct
WRIFQQF

SEQ ID NO: 30209 - protein, 7 aa, Artificial Sequence
  Synthetic construct
WRIFQQY

SEQ ID NO: 30210 - protein, 7 aa, Artificial Sequence
  Synthetic construct
WRIFQDF

SEQ ID NO: 30211 - protein, 7 aa, Artificial Sequence
  Synthetic construct
WRIFQDY

SEQ ID NO: 30212 - protein, 7 aa, Artificial Sequence
  Synthetic construct
WRIFQVF

SEQ ID NO: 30213 - protein, 7 aa, Artificial Sequence
  Synthetic construct
WRIFQVY

SEQ ID NO: 30214 - protein, 7 aa, Artificial Sequence
  Synthetic construct
WRGYIFF

SEQ ID NO: 30215 - protein, 7 aa, Artificial Sequence
  Synthetic construct
WRGYIFY

SEQ ID NO: 30216 - protein, 7 aa, Artificial Sequence
  Synthetic construct
WRGYIRF

SEQ ID NO: 30217 - protein, 7 aa, Artificial Sequence
  Synthetic construct
WRGYIRY

SEQ ID NO: 30218 - protein, 7 aa, Artificial Sequence
  Synthetic construct
WRGYICF

SEQ ID NO: 30219 - protein, 7 aa, Artificial Sequence
  Synthetic construct
WRGYICY

SEQ ID NO: 30220 - protein, 7 aa, Artificial Sequence
  Synthetic construct
WRGYILF

SEQ ID NO: 30221 - protein, 7 aa, Artificial Sequence
  Synthetic construct
WRGYILY

SEQ ID NO: 30222 - protein, 7 aa, Artificial Sequence
  Synthetic construct
WRGYIAF

SEQ ID NO: 30223 - protein, 7 aa, Artificial Sequence
  Synthetic construct
WRGYIAY

SEQ ID NO: 30224 - protein, 7 aa, Artificial Sequence
  Synthetic construct
WRGYIQF

SEQ ID NO: 30225 - protein, 7 aa, Artificial Sequence
  Synthetic construct
WRGYIQY

SEQ ID NO: 30226 - protein, 7 aa, Artificial Sequence
  Synthetic construct
WRGYIDF

SEQ ID NO: 30227 - protein, 7 aa, Artificial Sequence
  Synthetic construct
WRGYIDY

SEQ ID NO: 30228 - protein, 7 aa, Artificial Sequence
  Synthetic construct
WRGYIVF

SEQ ID NO: 30229 - protein, 7 aa, Artificial Sequence
  Synthetic construct
WRGYIVY

SEQ ID NO: 30230 - protein, 7 aa, Artificial Sequence
  Synthetic construct
WRGYDFF

SEQ ID NO: 30231 - protein, 7 aa, Artificial Sequence
  Synthetic construct
WRGYDFY

SEQ ID NO: 30232 - protein, 7 aa, Artificial Sequence
  Synthetic construct
WRGYDRF

SEQ ID NO: 30233 - protein, 7 aa, Artificial Sequence
  Synthetic construct
WRGYDRY

SEQ ID NO: 30234 - protein, 7 aa, Artificial Sequence
  Synthetic construct
WRGYDCF

SEQ ID NO: 30235 - protein, 7 aa, Artificial Sequence
  Synthetic construct
WRGYDCY

SEQ ID NO: 30236 - protein, 7 aa, Artificial Sequence
  Synthetic construct
WRGYDLF

SEQ ID NO: 30237 - protein, 7 aa, Artificial Sequence
  Synthetic construct
WRGYDLY

SEQ ID NO: 30238 - protein, 7 aa, Artificial Sequence
  Synthetic construct
WRGYDAF

SEQ ID NO: 30239 - protein, 7 aa, Artificial Sequence
  Synthetic construct
WRGYDAY

SEQ ID NO: 30240 - protein, 7 aa, Artificial Sequence
  Synthetic construct
WRGYDQF

SEQ ID NO: 30241 - protein, 7 aa, Artificial Sequence
  Synthetic construct
WRGYDQY

SEQ ID NO: 30242 - protein, 7 aa, Artificial Sequence
  Synthetic construct
WRGYDDF

SEQ ID NO: 30243 - protein, 7 aa, Artificial Sequence
  Synthetic construct
WRGYDDY

SEQ ID NO: 30244 - protein, 7 aa, Artificial Sequence
  Synthetic construct
WRGYDVF

SEQ ID NO: 30245 - protein, 7 aa, Artificial Sequence
  Synthetic construct
WRGYDVY

SEQ ID NO: 30246 - protein, 7 aa, Artificial Sequence
  Synthetic construct
WRGYYFF

SEQ ID NO: 30247 - protein, 7 aa, Artificial Sequence
  Synthetic construct
WRGYYFY

SEQ ID NO: 30248 - protein, 7 aa, Artificial Sequence
  Synthetic construct
WRGYYRF

SEQ ID NO: 30249 - protein, 7 aa, Artificial Sequence
  Synthetic construct
WRGYYRY

SEQ ID NO: 30250 - protein, 7 aa, Artificial Sequence
  Synthetic construct
WRGYYCF

SEQ ID NO: 30251 - protein, 7 aa, Artificial Sequence
  Synthetic construct
WRGYYCY

SEQ ID NO: 30252 - protein, 7 aa, Artificial Sequence
  Synthetic construct
WRGYYLF

SEQ ID NO: 30253 - protein, 7 aa, Artificial Sequence
  Synthetic construct
WRGYYLY

SEQ ID NO: 30254 - protein, 7 aa, Artificial Sequence
  Synthetic construct
WRGYYAF

SEQ ID NO: 30255 - protein, 7 aa, Artificial Sequence
  Synthetic construct
WRGYYAY

SEQ ID NO: 30256 - protein, 7 aa, Artificial Sequence
  Synthetic construct
WRGYYQF

SEQ ID NO: 30257 - protein, 7 aa, Artificial Sequence
  Synthetic construct
WRGYYQY

SEQ ID NO: 30258 - protein, 7 aa, Artificial Sequence
  Synthetic construct
WRGYYDF

SEQ ID NO: 30259 - protein, 7 aa, Artificial Sequence
  Synthetic construct
WRGYYDY

SEQ ID NO: 30260 - protein, 7 aa, Artificial Sequence
  Synthetic construct
WRGYYVF

SEQ ID NO: 30261 - protein, 7 aa, Artificial Sequence
  Synthetic construct
WRGYYVY

SEQ ID NO: 30262 - protein, 7 aa, Artificial Sequence
  Synthetic construct
WRGYFFF

SEQ ID NO: 30263 - protein, 7 aa, Artificial Sequence
  Synthetic construct
WRGYFFY

SEQ ID NO: 30264 - protein, 7 aa, Artificial Sequence
  Synthetic construct
WRGYFRF

SEQ ID NO: 30265 - protein, 7 aa, Artificial Sequence
  Synthetic construct
WRGYFRY

SEQ ID NO: 30266 - protein, 7 aa, Artificial Sequence
  Synthetic construct
WRGYFCF

SEQ ID NO: 30267 - protein, 7 aa, Artificial Sequence
  Synthetic construct
WRGYFCY

SEQ ID NO: 30268 - protein, 7 aa, Artificial Sequence
  Synthetic construct
WRGYFLF

SEQ ID NO: 30269 - protein, 7 aa, Artificial Sequence
  Synthetic construct
WRGYFLY

SEQ ID NO: 30270 - protein, 7 aa, Artificial Sequence
  Synthetic construct
WRGYFAF

SEQ ID NO: 30271 - protein, 7 aa, Artificial Sequence
  Synthetic construct
WRGYFAY

SEQ ID NO: 30272 - protein, 7 aa, Artificial Sequence
  Synthetic construct
WRGYFQF

SEQ ID NO: 30273 - protein, 7 aa, Artificial Sequence
  Synthetic construct
WRGYFQY

SEQ ID NO: 30274 - protein, 7 aa, Artificial Sequence
  Synthetic construct
WRGYFDF

SEQ ID NO: 30275 - protein, 7 aa, Artificial Sequence
  Synthetic construct
WRGYFDY

SEQ ID NO: 30276 - protein, 7 aa, Artificial Sequence
  Synthetic construct
WRGYFVF

SEQ ID NO: 30277 - protein, 7 aa, Artificial Sequence
  Synthetic construct
WRGYFVY

SEQ ID NO: 30278 - protein, 7 aa, Artificial Sequence
  Synthetic construct
WRGYVFF

SEQ ID NO: 30279 - protein, 7 aa, Artificial Sequence
  Synthetic construct
WRGYVFY

SEQ ID NO: 30280 - protein, 7 aa, Artificial Sequence
  Synthetic construct
WRGYVRF

SEQ ID NO: 30281 - protein, 7 aa, Artificial Sequence
  Synthetic construct
WRGYVRY

SEQ ID NO: 30282 - protein, 7 aa, Artificial Sequence
  Synthetic construct
WRGYVCF

SEQ ID NO: 30283 - protein, 7 aa, Artificial Sequence
  Synthetic construct
WRGYVCY

SEQ ID NO: 30284 - protein, 7 aa, Artificial Sequence
  Synthetic construct
WRGYVLF

SEQ ID NO: 30285 - protein, 7 aa, Artificial Sequence
  Synthetic construct
WRGYVLY

SEQ ID NO: 30286 - protein, 7 aa, Artificial Sequence
  Synthetic construct
WRGYVAF

SEQ ID NO: 30287 - protein, 7 aa, Artificial Sequence
  Synthetic construct
WRGYVAY

SEQ ID NO: 30288 - protein, 7 aa, Artificial Sequence
  Synthetic construct
WRGYVQF

SEQ ID NO: 30289 - protein, 7 aa, Artificial Sequence
  Synthetic construct
WRGYVQY

SEQ ID NO: 30290 - protein, 7 aa, Artificial Sequence
  Synthetic construct
WRGYVDF

SEQ ID NO: 30291 - protein, 7 aa, Artificial Sequence
  Synthetic construct
WRGYVDY

SEQ ID NO: 30292 - protein, 7 aa, Artificial Sequence
  Synthetic construct
WRGYVVF

SEQ ID NO: 30293 - protein, 7 aa, Artificial Sequence
  Synthetic construct
WRGYVVY

SEQ ID NO: 30294 - protein, 7 aa, Artificial Sequence
  Synthetic construct
WRGYTFF

SEQ ID NO: 30295 - protein, 7 aa, Artificial Sequence
  Synthetic construct
WRGYTFY

SEQ ID NO: 30296 - protein, 7 aa, Artificial Sequence
  Synthetic construct
WRGYTRF

SEQ ID NO: 30297 - protein, 7 aa, Artificial Sequence
  Synthetic construct
WRGYTRY

SEQ ID NO: 30298 - protein, 7 aa, Artificial Sequence
  Synthetic construct
WRGYTCF

SEQ ID NO: 30299 - protein, 7 aa, Artificial Sequence
  Synthetic construct
WRGYTCY

SEQ ID NO: 30300 - protein, 7 aa, Artificial Sequence
  Synthetic construct
WRGYTLF

SEQ ID NO: 30301 - protein, 7 aa, Artificial Sequence
  Synthetic construct
WRGYTLY

SEQ ID NO: 30302 - protein, 7 aa, Artificial Sequence
  Synthetic construct
WRGYTAF

SEQ ID NO: 30303 - protein, 7 aa, Artificial Sequence
  Synthetic construct
WRGYTAY

SEQ ID NO: 30304 - protein, 7 aa, Artificial Sequence
  Synthetic construct
WRGYTQF

SEQ ID NO: 30305 - protein, 7 aa, Artificial Sequence
  Synthetic construct
WRGYTQY

SEQ ID NO: 30306 - protein, 7 aa, Artificial Sequence
  Synthetic construct
WRGYTDF

SEQ ID NO: 30307 - protein, 7 aa, Artificial Sequence
  Synthetic construct
WRGYTDY

SEQ ID NO: 30308 - protein, 7 aa, Artificial Sequence
  Synthetic construct
WRGYTVF

SEQ ID NO: 30309 - protein, 7 aa, Artificial Sequence
  Synthetic construct
WRGYTVY

SEQ ID NO: 30310 - protein, 7 aa, Artificial Sequence
  Synthetic construct
WRGYGFF

SEQ ID NO: 30311 - protein, 7 aa, Artificial Sequence
  Synthetic construct
WRGYGFY

SEQ ID NO: 30312 - protein, 7 aa, Artificial Sequence
  Synthetic construct
WRGYGRF

SEQ ID NO: 30313 - protein, 7 aa, Artificial Sequence
  Synthetic construct
WRGYGRY

SEQ ID NO: 30314 - protein, 7 aa, Artificial Sequence
  Synthetic construct
WRGYGCF

SEQ ID NO: 30315 - protein, 7 aa, Artificial Sequence
  Synthetic construct
WRGYGCY

SEQ ID NO: 30316 - protein, 7 aa, Artificial Sequence
  Synthetic construct
WRGYGLF

SEQ ID NO: 30317 - protein, 7 aa, Artificial Sequence
  Synthetic construct
WRGYGLY

SEQ ID NO: 30318 - protein, 7 aa, Artificial Sequence
  Synthetic construct
WRGYGAF

SEQ ID NO: 30319 - protein, 7 aa, Artificial Sequence
  Synthetic construct
WRGYGAY

SEQ ID NO: 30320 - protein, 7 aa, Artificial Sequence
  Synthetic construct
WRGYGQF

SEQ ID NO: 30321 - protein, 7 aa, Artificial Sequence
  Synthetic construct
WRGYGQY

SEQ ID NO: 30322 - protein, 7 aa, Artificial Sequence
  Synthetic construct
WRGYGDF

SEQ ID NO: 30323 - protein, 7 aa, Artificial Sequence
  Synthetic construct
WRGYGDY

SEQ ID NO: 30324 - protein, 7 aa, Artificial Sequence
  Synthetic construct
WRGYGVF

SEQ ID NO: 30325 - protein, 7 aa, Artificial Sequence
  Synthetic construct
WRGYGVY

SEQ ID NO: 30326 - protein, 7 aa, Artificial Sequence
  Synthetic construct
WRGYAFF

SEQ ID NO: 30327 - protein, 7 aa, Artificial Sequence
  Synthetic construct
WRGYAFY

SEQ ID NO: 30328 - protein, 7 aa, Artificial Sequence
  Synthetic construct
WRGYARF

SEQ ID NO: 30329 - protein, 7 aa, Artificial Sequence
  Synthetic construct
WRGYARY

SEQ ID NO: 30330 - protein, 7 aa, Artificial Sequence
  Synthetic construct
WRGYACF

SEQ ID NO: 30331 - protein, 7 aa, Artificial Sequence
  Synthetic construct
WRGYACY

SEQ ID NO: 30332 - protein, 7 aa, Artificial Sequence
  Synthetic construct
WRGYALF

SEQ ID NO: 30333 - protein, 7 aa, Artificial Sequence
  Synthetic construct
WRGYALY

SEQ ID NO: 30334 - protein, 7 aa, Artificial Sequence
  Synthetic construct
WRGYAAF

SEQ ID NO: 30335 - protein, 7 aa, Artificial Sequence
  Synthetic construct
WRGYAAY

SEQ ID NO: 30336 - protein, 7 aa, Artificial Sequence
  Synthetic construct
WRGYAQF

SEQ ID NO: 30337 - protein, 7 aa, Artificial Sequence
  Synthetic construct
WRGYAQY

SEQ ID NO: 30338 - protein, 7 aa, Artificial Sequence
  Synthetic construct
WRGYADF

SEQ ID NO: 30339 - protein, 7 aa, Artificial Sequence
  Synthetic construct
WRGYADY

SEQ ID NO: 30340 - protein, 7 aa, Artificial Sequence
  Synthetic construct
WRGYAVF

SEQ ID NO: 30341 - protein, 7 aa, Artificial Sequence
  Synthetic construct
WRGYAVY

SEQ ID NO: 30342 - protein, 7 aa, Artificial Sequence
  Synthetic construct
WRGYQFF

SEQ ID NO: 30343 - protein, 7 aa, Artificial Sequence
  Synthetic construct
WRGYQFY

SEQ ID NO: 30344 - protein, 7 aa, Artificial Sequence
  Synthetic construct
WRGYQRF

SEQ ID NO: 30345 - protein, 7 aa, Artificial Sequence
  Synthetic construct
WRGYQRY

SEQ ID NO: 30346 - protein, 7 aa, Artificial Sequence
  Synthetic construct
WRGYQCF

SEQ ID NO: 30347 - protein, 7 aa, Artificial Sequence
  Synthetic construct
WRGYQCY

SEQ ID NO: 30348 - protein, 7 aa, Artificial Sequence
  Synthetic construct
WRGYQLF

SEQ ID NO: 30349 - protein, 7 aa, Artificial Sequence
  Synthetic construct
WRGYQLY

SEQ ID NO: 30350 - protein, 7 aa, Artificial Sequence
  Synthetic construct
WRGYQAF

SEQ ID NO: 30351 - protein, 7 aa, Artificial Sequence
  Synthetic construct
WRGYQAY

SEQ ID NO: 30352 - protein, 7 aa, Artificial Sequence
  Synthetic construct
WRGYQQF

SEQ ID NO: 30353 - protein, 7 aa, Artificial Sequence
  Synthetic construct
WRGYQQY

SEQ ID NO: 30354 - protein, 7 aa, Artificial Sequence
  Synthetic construct
WRGYQDF

SEQ ID NO: 30355 - protein, 7 aa, Artificial Sequence
  Synthetic construct
WRGYQDY

SEQ ID NO: 30356 - protein, 7 aa, Artificial Sequence
  Synthetic construct
WRGYQVF

SEQ ID NO: 30357 - protein, 7 aa, Artificial Sequence
  Synthetic construct
WRGYQVY

SEQ ID NO: 30358 - protein, 7 aa, Artificial Sequence
  Synthetic construct
WRGPIFF

SEQ ID NO: 30359 - protein, 7 aa, Artificial Sequence
  Synthetic construct
WRGPIFY

SEQ ID NO: 30360 - protein, 7 aa, Artificial Sequence
  Synthetic construct
WRGPIRF

SEQ ID NO: 30361 - protein, 7 aa, Artificial Sequence
  Synthetic construct
WRGPIRY

SEQ ID NO: 30362 - protein, 7 aa, Artificial Sequence
  Synthetic construct
WRGPICF

SEQ ID NO: 30363 - protein, 7 aa, Artificial Sequence
  Synthetic construct
WRGPICY

SEQ ID NO: 30364 - protein, 7 aa, Artificial Sequence
  Synthetic construct
WRGPILF

SEQ ID NO: 30365 - protein, 7 aa, Artificial Sequence
  Synthetic construct
WRGPILY

SEQ ID NO: 30366 - protein, 7 aa, Artificial Sequence
  Synthetic construct
WRGPIAF

SEQ ID NO: 30367 - protein, 7 aa, Artificial Sequence
  Synthetic construct
WRGPIAY

SEQ ID NO: 30368 - protein, 7 aa, Artificial Sequence
  Synthetic construct
WRGPIQF

SEQ ID NO: 30369 - protein, 7 aa, Artificial Sequence
  Synthetic construct
WRGPIQY

SEQ ID NO: 30370 - protein, 7 aa, Artificial Sequence
  Synthetic construct
WRGPIDF

SEQ ID NO: 30371 - protein, 7 aa, Artificial Sequence
  Synthetic construct
WRGPIDY

SEQ ID NO: 30372 - protein, 7 aa, Artificial Sequence
  Synthetic construct
WRGPIVF

SEQ ID NO: 30373 - protein, 7 aa, Artificial Sequence
  Synthetic construct
WRGPIVY

SEQ ID NO: 30374 - protein, 7 aa, Artificial Sequence
  Synthetic construct
WRGPDFF

SEQ ID NO: 30375 - protein, 7 aa, Artificial Sequence
  Synthetic construct
WRGPDFY

SEQ ID NO: 30376 - protein, 7 aa, Artificial Sequence
  Synthetic construct
WRGPDRF

SEQ ID NO: 30377 - protein, 7 aa, Artificial Sequence
  Synthetic construct
WRGPDRY

SEQ ID NO: 30378 - protein, 7 aa, Artificial Sequence
  Synthetic construct
WRGPDCF

SEQ ID NO: 30379 - protein, 7 aa, Artificial Sequence
  Synthetic construct
WRGPDCY

SEQ ID NO: 30380 - protein, 7 aa, Artificial Sequence
  Synthetic construct
WRGPDLF

SEQ ID NO: 30381 - protein, 7 aa, Artificial Sequence
  Synthetic construct
WRGPDLY

SEQ ID NO: 30382 - protein, 7 aa, Artificial Sequence
  Synthetic construct
WRGPDAF

SEQ ID NO: 30383 - protein, 7 aa, Artificial Sequence
  Synthetic construct
WRGPDAY

SEQ ID NO: 30384 - protein, 7 aa, Artificial Sequence
  Synthetic construct
WRGPDQF

SEQ ID NO: 30385 - protein, 7 aa, Artificial Sequence
  Synthetic construct
WRGPDQY

SEQ ID NO: 30386 - protein, 7 aa, Artificial Sequence
  Synthetic construct
WRGPDDF

SEQ ID NO: 30387 - protein, 7 aa, Artificial Sequence
  Synthetic construct
WRGPDDY

SEQ ID NO: 30388 - protein, 7 aa, Artificial Sequence
  Synthetic construct
WRGPDVF

SEQ ID NO: 30389 - protein, 7 aa, Artificial Sequence
  Synthetic construct
WRGPDVY

SEQ ID NO: 30390 - protein, 7 aa, Artificial Sequence
  Synthetic construct
WRGPYFF

SEQ ID NO: 30391 - protein, 7 aa, Artificial Sequence
  Synthetic construct
WRGPYFY

SEQ ID NO: 30392 - protein, 7 aa, Artificial Sequence
  Synthetic construct
WRGPYRF

SEQ ID NO: 30393 - protein, 7 aa, Artificial Sequence
  Synthetic construct
WRGPYRY

SEQ ID NO: 30394 - protein, 7 aa, Artificial Sequence
  Synthetic construct
WRGPYCF

SEQ ID NO: 30395 - protein, 7 aa, Artificial Sequence
  Synthetic construct
WRGPYCY

SEQ ID NO: 30396 - protein, 7 aa, Artificial Sequence
  Synthetic construct
WRGPYLF

SEQ ID NO: 30397 - protein, 7 aa, Artificial Sequence
  Synthetic construct
WRGPYLY

SEQ ID NO: 30398 - protein, 7 aa, Artificial Sequence
  Synthetic construct
WRGPYAF

SEQ ID NO: 30399 - protein, 7 aa, Artificial Sequence
  Synthetic construct
WRGPYAY

SEQ ID NO: 30400 - protein, 7 aa, Artificial Sequence
  Synthetic construct
WRGPYQF

SEQ ID NO: 30401 - protein, 7 aa, Artificial Sequence
  Synthetic construct
WRGPYQY

SEQ ID NO: 30402 - protein, 7 aa, Artificial Sequence
  Synthetic construct
WRGPYDF

SEQ ID NO: 30403 - protein, 7 aa, Artificial Sequence
  Synthetic construct
WRGPYDY

SEQ ID NO: 30404 - protein, 7 aa, Artificial Sequence
  Synthetic construct
WRGPYVF

SEQ ID NO: 30405 - protein, 7 aa, Artificial Sequence
  Synthetic construct
WRGPYVY

SEQ ID NO: 30406 - protein, 7 aa, Artificial Sequence
  Synthetic construct
WRGPFFF

SEQ ID NO: 30407 - protein, 7 aa, Artificial Sequence
  Synthetic construct
WRGPFFY

SEQ ID NO: 30408 - protein, 7 aa, Artificial Sequence
  Synthetic construct
WRGPFRF

SEQ ID NO: 30409 - protein, 7 aa, Artificial Sequence
  Synthetic construct
WRGPFRY

SEQ ID NO: 30410 - protein, 7 aa, Artificial Sequence
  Synthetic construct
WRGPFCF

SEQ ID NO: 30411 - protein, 7 aa, Artificial Sequence
  Synthetic construct
WRGPFCY

SEQ ID NO: 30412 - protein, 7 aa, Artificial Sequence
  Synthetic construct
WRGPFLF

SEQ ID NO: 30413 - protein, 7 aa, Artificial Sequence
  Synthetic construct
WRGPFLY

SEQ ID NO: 30414 - protein, 7 aa, Artificial Sequence
  Synthetic construct
WRGPFAF

SEQ ID NO: 30415 - protein, 7 aa, Artificial Sequence
  Synthetic construct
WRGPFAY

SEQ ID NO: 30416 - protein, 7 aa, Artificial Sequence
  Synthetic construct
WRGPFQF

SEQ ID NO: 30417 - protein, 7 aa, Artificial Sequence
  Synthetic construct
WRGPFQY

SEQ ID NO: 30418 - protein, 7 aa, Artificial Sequence
  Synthetic construct
WRGPFDF

SEQ ID NO: 30419 - protein, 7 aa, Artificial Sequence
  Synthetic construct
WRGPFDY

SEQ ID NO: 30420 - protein, 7 aa, Artificial Sequence
  Synthetic construct
WRGPFVF

SEQ ID NO: 30421 - protein, 7 aa, Artificial Sequence
  Synthetic construct
WRGPFVY

SEQ ID NO: 30422 - protein, 7 aa, Artificial Sequence
  Synthetic construct
WRGPVFF

SEQ ID NO: 30423 - protein, 7 aa, Artificial Sequence
  Synthetic construct
WRGPVFY

SEQ ID NO: 30424 - protein, 7 aa, Artificial Sequence
  Synthetic construct
WRGPVRF

SEQ ID NO: 30425 - protein, 7 aa, Artificial Sequence
  Synthetic construct
WRGPVRY

SEQ ID NO: 30426 - protein, 7 aa, Artificial Sequence
  Synthetic construct
WRGPVCF

SEQ ID NO: 30427 - protein, 7 aa, Artificial Sequence
  Synthetic construct
WRGPVCY

SEQ ID NO: 30428 - protein, 7 aa, Artificial Sequence
  Synthetic construct
WRGPVLF

SEQ ID NO: 30429 - protein, 7 aa, Artificial Sequence
  Synthetic construct
WRGPVLY

SEQ ID NO: 30430 - protein, 7 aa, Artificial Sequence
  Synthetic construct
WRGPVAF

SEQ ID NO: 30431 - protein, 7 aa, Artificial Sequence
  Synthetic construct
WRGPVAY

SEQ ID NO: 30432 - protein, 7 aa, Artificial Sequence
  Synthetic construct
WRGPVQF

SEQ ID NO: 30433 - protein, 7 aa, Artificial Sequence
  Synthetic construct
WRGPVQY

SEQ ID NO: 30434 - protein, 7 aa, Artificial Sequence
  Synthetic construct
WRGPVDF

SEQ ID NO: 30435 - protein, 7 aa, Artificial Sequence
  Synthetic construct
WRGPVDY

SEQ ID NO: 30436 - protein, 7 aa, Artificial Sequence
  Synthetic construct
WRGPVVF

SEQ ID NO: 30437 - protein, 7 aa, Artificial Sequence
  Synthetic construct
WRGPVVY

SEQ ID NO: 30438 - protein, 7 aa, Artificial Sequence
  Synthetic construct
WRGPTFF

SEQ ID NO: 30439 - protein, 7 aa, Artificial Sequence
  Synthetic construct
WRGPTFY

SEQ ID NO: 30440 - protein, 7 aa, Artificial Sequence
  Synthetic construct
WRGPTRF

SEQ ID NO: 30441 - protein, 7 aa, Artificial Sequence
  Synthetic construct
WRGPTRY

SEQ ID NO: 30442 - protein, 7 aa, Artificial Sequence
  Synthetic construct
WRGPTCF

SEQ ID NO: 30443 - protein, 7 aa, Artificial Sequence
  Synthetic construct
WRGPTCY

SEQ ID NO: 30444 - protein, 7 aa, Artificial Sequence
  Synthetic construct
WRGPTLF

SEQ ID NO: 30445 - protein, 7 aa, Artificial Sequence
  Synthetic construct
WRGPTLY

SEQ ID NO: 30446 - protein, 7 aa, Artificial Sequence
  Synthetic construct
WRGPTAF

SEQ ID NO: 30447 - protein, 7 aa, Artificial Sequence
  Synthetic construct
WRGPTAY

SEQ ID NO: 30448 - protein, 7 aa, Artificial Sequence
  Synthetic construct
WRGPTQF

SEQ ID NO: 30449 - protein, 7 aa, Artificial Sequence
  Synthetic construct
WRGPTQY

SEQ ID NO: 30450 - protein, 7 aa, Artificial Sequence
  Synthetic construct
WRGPTDF

SEQ ID NO: 30451 - protein, 7 aa, Artificial Sequence
  Synthetic construct
WRGPTDY

SEQ ID NO: 30452 - protein, 7 aa, Artificial Sequence
  Synthetic construct
WRGPTVF

SEQ ID NO: 30453 - protein, 7 aa, Artificial Sequence
  Synthetic construct
WRGPTVY

SEQ ID NO: 30454 - protein, 7 aa, Artificial Sequence
  Synthetic construct
WRGPGFF

SEQ ID NO: 30455 - protein, 7 aa, Artificial Sequence
  Synthetic construct
WRGPGFY

SEQ ID NO: 30456 - protein, 7 aa, Artificial Sequence
  Synthetic construct
WRGPGRF

SEQ ID NO: 30457 - protein, 7 aa, Artificial Sequence
  Synthetic construct
WRGPGRY

SEQ ID NO: 30458 - protein, 7 aa, Artificial Sequence
  Synthetic construct
WRGPGCF

SEQ ID NO: 30459 - protein, 7 aa, Artificial Sequence
  Synthetic construct
WRGPGCY

SEQ ID NO: 30460 - protein, 7 aa, Artificial Sequence
  Synthetic construct
WRGPGLF

SEQ ID NO: 30461 - protein, 7 aa, Artificial Sequence
  Synthetic construct
WRGPGLY

SEQ ID NO: 30462 - protein, 7 aa, Artificial Sequence
  Synthetic construct
WRGPGAF

SEQ ID NO: 30463 - protein, 7 aa, Artificial Sequence
  Synthetic construct
WRGPGAY

SEQ ID NO: 30464 - protein, 7 aa, Artificial Sequence
  Synthetic construct
WRGPGQF

SEQ ID NO: 30465 - protein, 7 aa, Artificial Sequence
  Synthetic construct
WRGPGQY

SEQ ID NO: 30466 - protein, 7 aa, Artificial Sequence
  Synthetic construct
WRGPGDF

SEQ ID NO: 30467 - protein, 7 aa, Artificial Sequence
  Synthetic construct
WRGPGDY

SEQ ID NO: 30468 - protein, 7 aa, Artificial Sequence
  Synthetic construct
WRGPGVF

SEQ ID NO: 30469 - protein, 7 aa, Artificial Sequence
  Synthetic construct
WRGPGVY

SEQ ID NO: 30470 - protein, 7 aa, Artificial Sequence
  Synthetic construct
WRGPAFF

SEQ ID NO: 30471 - protein, 7 aa, Artificial Sequence
  Synthetic construct
WRGPAFY

SEQ ID NO: 30472 - protein, 7 aa, Artificial Sequence
  Synthetic construct
WRGPARF

SEQ ID NO: 30473 - protein, 7 aa, Artificial Sequence
  Synthetic construct
WRGPARY

SEQ ID NO: 30474 - protein, 7 aa, Artificial Sequence
  Synthetic construct
WRGPACF

SEQ ID NO: 30475 - protein, 7 aa, Artificial Sequence
  Synthetic construct
WRGPACY

SEQ ID NO: 30476 - protein, 7 aa, Artificial Sequence
  Synthetic construct
WRGPALF

SEQ ID NO: 30477 - protein, 7 aa, Artificial Sequence
  Synthetic construct
WRGPALY

SEQ ID NO: 30478 - protein, 7 aa, Artificial Sequence
  Synthetic construct
WRGPAAF

SEQ ID NO: 30479 - protein, 7 aa, Artificial Sequence
  Synthetic construct
WRGPAAY

SEQ ID NO: 30480 - protein, 7 aa, Artificial Sequence
  Synthetic construct
WRGPAQF

SEQ ID NO: 30481 - protein, 7 aa, Artificial Sequence
  Synthetic construct
WRGPAQY

SEQ ID NO: 30482 - protein, 7 aa, Artificial Sequence
  Synthetic construct
WRGPADF

SEQ ID NO: 30483 - protein, 7 aa, Artificial Sequence
  Synthetic construct
WRGPADY

SEQ ID NO: 30484 - protein, 7 aa, Artificial Sequence
  Synthetic construct
WRGPAVF

SEQ ID NO: 30485 - protein, 7 aa, Artificial Sequence
  Synthetic construct
WRGPAVY

SEQ ID NO: 30486 - protein, 7 aa, Artificial Sequence
  Synthetic construct
WRGPQFF

SEQ ID NO: 30487 - protein, 7 aa, Artificial Sequence
  Synthetic construct
WRGPQFY

SEQ ID NO: 30488 - protein, 7 aa, Artificial Sequence
  Synthetic construct
WRGPQRF

SEQ ID NO: 30489 - protein, 7 aa, Artificial Sequence
  Synthetic construct
WRGPQRY

SEQ ID NO: 30490 - protein, 7 aa, Artificial Sequence
  Synthetic construct
WRGPQCF

SEQ ID NO: 30491 - protein, 7 aa, Artificial Sequence
  Synthetic construct
WRGPQCY

SEQ ID NO: 30492 - protein, 7 aa, Artificial Sequence
  Synthetic construct
WRGPQLF

SEQ ID NO: 30493 - protein, 7 aa, Artificial Sequence
  Synthetic construct
WRGPQLY

SEQ ID NO: 30494 - protein, 7 aa, Artificial Sequence
  Synthetic construct
WRGPQAF

SEQ ID NO: 30495 - protein, 7 aa, Artificial Sequence
  Synthetic construct
WRGPQAY

SEQ ID NO: 30496 - protein, 7 aa, Artificial Sequence
  Synthetic construct
WRGPQQF

SEQ ID NO: 30497 - protein, 7 aa, Artificial Sequence
  Synthetic construct
WRGPQQY

SEQ ID NO: 30498 - protein, 7 aa, Artificial Sequence
  Synthetic construct
WRGPQDF

SEQ ID NO: 30499 - protein, 7 aa, Artificial Sequence
  Synthetic construct
WRGPQDY

SEQ ID NO: 30500 - protein, 7 aa, Artificial Sequence
  Synthetic construct
WRGPQVF

SEQ ID NO: 30501 - protein, 7 aa, Artificial Sequence
  Synthetic construct
WRGPQVY

SEQ ID NO: 30502 - protein, 7 aa, Artificial Sequence
  Synthetic construct
WRGHIFF

SEQ ID NO: 30503 - protein, 7 aa, Artificial Sequence
  Synthetic construct
WRGHIFY

SEQ ID NO: 30504 - protein, 7 aa, Artificial Sequence
  Synthetic construct
WRGHIRF

SEQ ID NO: 30505 - protein, 7 aa, Artificial Sequence
  Synthetic construct
WRGHIRY

SEQ ID NO: 30506 - protein, 7 aa, Artificial Sequence
  Synthetic construct
WRGHICF

SEQ ID NO: 30507 - protein, 7 aa, Artificial Sequence
  Synthetic construct
WRGHICY

SEQ ID NO: 30508 - protein, 7 aa, Artificial Sequence
  Synthetic construct
WRGHILF

SEQ ID NO: 30509 - protein, 7 aa, Artificial Sequence
  Synthetic construct
WRGHILY

SEQ ID NO: 30510 - protein, 7 aa, Artificial Sequence
  Synthetic construct
WRGHIAF

SEQ ID NO: 30511 - protein, 7 aa, Artificial Sequence
  Synthetic construct
WRGHIAY

SEQ ID NO: 30512 - protein, 7 aa, Artificial Sequence
  Synthetic construct
WRGHIQF

SEQ ID NO: 30513 - protein, 7 aa, Artificial Sequence
  Synthetic construct
WRGHIQY

SEQ ID NO: 30514 - protein, 7 aa, Artificial Sequence
  Synthetic construct
WRGHIDF

SEQ ID NO: 30515 - protein, 7 aa, Artificial Sequence
  Synthetic construct
WRGHIDY

SEQ ID NO: 30516 - protein, 7 aa, Artificial Sequence
  Synthetic construct
WRGHIVF

SEQ ID NO: 30517 - protein, 7 aa, Artificial Sequence
  Synthetic construct
WRGHIVY

SEQ ID NO: 30518 - protein, 7 aa, Artificial Sequence
  Synthetic construct
WRGHDFF

SEQ ID NO: 30519 - protein, 7 aa, Artificial Sequence
  Synthetic construct
WRGHDFY

SEQ ID NO: 30520 - protein, 7 aa, Artificial Sequence
  Synthetic construct
WRGHDRF

SEQ ID NO: 30521 - protein, 7 aa, Artificial Sequence
  Synthetic construct
WRGHDRY

SEQ ID NO: 30522 - protein, 7 aa, Artificial Sequence
  Synthetic construct
WRGHDCF

SEQ ID NO: 30523 - protein, 7 aa, Artificial Sequence
  Synthetic construct
WRGHDCY

SEQ ID NO: 30524 - protein, 7 aa, Artificial Sequence
  Synthetic construct
WRGHDLF

SEQ ID NO: 30525 - protein, 7 aa, Artificial Sequence
  Synthetic construct
WRGHDLY

SEQ ID NO: 30526 - protein, 7 aa, Artificial Sequence
  Synthetic construct
WRGHDAF

SEQ ID NO: 30527 - protein, 7 aa, Artificial Sequence
  Synthetic construct
WRGHDAY

SEQ ID NO: 30528 - protein, 7 aa, Artificial Sequence
  Synthetic construct
WRGHDQF

SEQ ID NO: 30529 - protein, 7 aa, Artificial Sequence
  Synthetic construct
WRGHDQY

SEQ ID NO: 30530 - protein, 7 aa, Artificial Sequence
  Synthetic construct
WRGHDDF

SEQ ID NO: 30531 - protein, 7 aa, Artificial Sequence
  Synthetic construct
WRGHDDY

SEQ ID NO: 30532 - protein, 7 aa, Artificial Sequence
  Synthetic construct
WRGHDVF

SEQ ID NO: 30533 - protein, 7 aa, Artificial Sequence
  Synthetic construct
WRGHDVY

SEQ ID NO: 30534 - protein, 7 aa, Artificial Sequence
  Synthetic construct
WRGHYFF

SEQ ID NO: 30535 - protein, 7 aa, Artificial Sequence
  Synthetic construct
WRGHYFY

SEQ ID NO: 30536 - protein, 7 aa, Artificial Sequence
  Synthetic construct
WRGHYRF

SEQ ID NO: 30537 - protein, 7 aa, Artificial Sequence
  Synthetic construct
WRGHYRY

SEQ ID NO: 30538 - protein, 7 aa, Artificial Sequence
  Synthetic construct
WRGHYCF

SEQ ID NO: 30539 - protein, 7 aa, Artificial Sequence
  Synthetic construct
WRGHYCY

SEQ ID NO: 30540 - protein, 7 aa, Artificial Sequence
  Synthetic construct
WRGHYLF

SEQ ID NO: 30541 - protein, 7 aa, Artificial Sequence
  Synthetic construct
WRGHYLY

SEQ ID NO: 30542 - protein, 7 aa, Artificial Sequence
  Synthetic construct
WRGHYAF

SEQ ID NO: 30543 - protein, 7 aa, Artificial Sequence
  Synthetic construct
WRGHYAY

SEQ ID NO: 30544 - protein, 7 aa, Artificial Sequence
  Synthetic construct
WRGHYQF

SEQ ID NO: 30545 - protein, 7 aa, Artificial Sequence
  Synthetic construct
WRGHYQY

SEQ ID NO: 30546 - protein, 7 aa, Artificial Sequence
  Synthetic construct
WRGHYDF

SEQ ID NO: 30547 - protein, 7 aa, Artificial Sequence
  Synthetic construct
WRGHYDY

SEQ ID NO: 30548 - protein, 7 aa, Artificial Sequence
  Synthetic construct
WRGHYVF

SEQ ID NO: 30549 - protein, 7 aa, Artificial Sequence
  Synthetic construct
WRGHYVY

SEQ ID NO: 30550 - protein, 7 aa, Artificial Sequence
  Synthetic construct
WRGHFFF

SEQ ID NO: 30551 - protein, 7 aa, Artificial Sequence
  Synthetic construct
WRGHFFY

SEQ ID NO: 30552 - protein, 7 aa, Artificial Sequence
  Synthetic construct
WRGHFRF

SEQ ID NO: 30553 - protein, 7 aa, Artificial Sequence
  Synthetic construct
WRGHFRY

SEQ ID NO: 30554 - protein, 7 aa, Artificial Sequence
  Synthetic construct
WRGHFCF

SEQ ID NO: 30555 - protein, 7 aa, Artificial Sequence
  Synthetic construct
WRGHFCY

SEQ ID NO: 30556 - protein, 7 aa, Artificial Sequence
  Synthetic construct
WRGHFLF

SEQ ID NO: 30557 - protein, 7 aa, Artificial Sequence
  Synthetic construct
WRGHFLY

SEQ ID NO: 30558 - protein, 7 aa, Artificial Sequence
  Synthetic construct
WRGHFAF

SEQ ID NO: 30559 - protein, 7 aa, Artificial Sequence
  Synthetic construct
WRGHFAY

SEQ ID NO: 30560 - protein, 7 aa, Artificial Sequence
  Synthetic construct
WRGHFQF

SEQ ID NO: 30561 - protein, 7 aa, Artificial Sequence
  Synthetic construct
WRGHFQY

SEQ ID NO: 30562 - protein, 7 aa, Artificial Sequence
  Synthetic construct
WRGHFDF

SEQ ID NO: 30563 - protein, 7 aa, Artificial Sequence
  Synthetic construct
WRGHFDY

SEQ ID NO: 30564 - protein, 7 aa, Artificial Sequence
  Synthetic construct
WRGHFVF

SEQ ID NO: 30565 - protein, 7 aa, Artificial Sequence
  Synthetic construct
WRGHFVY

SEQ ID NO: 30566 - protein, 7 aa, Artificial Sequence
  Synthetic construct
WRGHVFF

SEQ ID NO: 30567 - protein, 7 aa, Artificial Sequence
  Synthetic construct
WRGHVFY

SEQ ID NO: 30568 - protein, 7 aa, Artificial Sequence
  Synthetic construct
WRGHVRF

SEQ ID NO: 30569 - protein, 7 aa, Artificial Sequence
  Synthetic construct
WRGHVRY

SEQ ID NO: 30570 - protein, 7 aa, Artificial Sequence
  Synthetic construct
WRGHVCF

SEQ ID NO: 30571 - protein, 7 aa, Artificial Sequence
  Synthetic construct
WRGHVCY

SEQ ID NO: 30572 - protein, 7 aa, Artificial Sequence
  Synthetic construct
WRGHVLF

SEQ ID NO: 30573 - protein, 7 aa, Artificial Sequence
  Synthetic construct
WRGHVLY

SEQ ID NO: 30574 - protein, 7 aa, Artificial Sequence
  Synthetic construct
WRGHVAF

SEQ ID NO: 30575 - protein, 7 aa, Artificial Sequence
  Synthetic construct
WRGHVAY

SEQ ID NO: 30576 - protein, 7 aa, Artificial Sequence
  Synthetic construct
WRGHVQF

SEQ ID NO: 30577 - protein, 7 aa, Artificial Sequence
  Synthetic construct
WRGHVQY

SEQ ID NO: 30578 - protein, 7 aa, Artificial Sequence
  Synthetic construct
WRGHVDF

SEQ ID NO: 30579 - protein, 7 aa, Artificial Sequence
  Synthetic construct
WRGHVDY

SEQ ID NO: 30580 - protein, 7 aa, Artificial Sequence
  Synthetic construct
WRGHVVF

SEQ ID NO: 30581 - protein, 7 aa, Artificial Sequence
  Synthetic construct
WRGHVVY

SEQ ID NO: 30582 - protein, 7 aa, Artificial Sequence
  Synthetic construct
WRGHTFF

SEQ ID NO: 30583 - protein, 7 aa, Artificial Sequence
  Synthetic construct
WRGHTFY

SEQ ID NO: 30584 - protein, 7 aa, Artificial Sequence
  Synthetic construct
WRGHTRF

SEQ ID NO: 30585 - protein, 7 aa, Artificial Sequence
  Synthetic construct
WRGHTRY

SEQ ID NO: 30586 - protein, 7 aa, Artificial Sequence
  Synthetic construct
WRGHTCF

SEQ ID NO: 30587 - protein, 7 aa, Artificial Sequence
  Synthetic construct
WRGHTCY

SEQ ID NO: 30588 - protein, 7 aa, Artificial Sequence
  Synthetic construct
WRGHTLF

SEQ ID NO: 30589 - protein, 7 aa, Artificial Sequence
  Synthetic construct
WRGHTLY

SEQ ID NO: 30590 - protein, 7 aa, Artificial Sequence
  Synthetic construct
WRGHTAF

SEQ ID NO: 30591 - protein, 7 aa, Artificial Sequence
  Synthetic construct
WRGHTAY

SEQ ID NO: 30592 - protein, 7 aa, Artificial Sequence
  Synthetic construct
WRGHTQF

SEQ ID NO: 30593 - protein, 7 aa, Artificial Sequence
  Synthetic construct
WRGHTQY

SEQ ID NO: 30594 - protein, 7 aa, Artificial Sequence
  Synthetic construct
WRGHTDF

SEQ ID NO: 30595 - protein, 7 aa, Artificial Sequence
  Synthetic construct
WRGHTDY

SEQ ID NO: 30596 - protein, 7 aa, Artificial Sequence
  Synthetic construct
WRGHTVF

SEQ ID NO: 30597 - protein, 7 aa, Artificial Sequence
  Synthetic construct
WRGHTVY

SEQ ID NO: 30598 - protein, 7 aa, Artificial Sequence
  Synthetic construct
WRGHGFF

SEQ ID NO: 30599 - protein, 7 aa, Artificial Sequence
  Synthetic construct
WRGHGFY

SEQ ID NO: 30600 - protein, 7 aa, Artificial Sequence
  Synthetic construct
WRGHGRF

SEQ ID NO: 30601 - protein, 7 aa, Artificial Sequence
  Synthetic construct
WRGHGRY

SEQ ID NO: 30602 - protein, 7 aa, Artificial Sequence
  Synthetic construct
WRGHGCF

SEQ ID NO: 30603 - protein, 7 aa, Artificial Sequence
  Synthetic construct
WRGHGCY

SEQ ID NO: 30604 - protein, 7 aa, Artificial Sequence
  Synthetic construct
WRGHGLF

SEQ ID NO: 30605 - protein, 7 aa, Artificial Sequence
  Synthetic construct
WRGHGLY

SEQ ID NO: 30606 - protein, 7 aa, Artificial Sequence
  Synthetic construct
WRGHGAF

SEQ ID NO: 30607 - protein, 7 aa, Artificial Sequence
  Synthetic construct
WRGHGAY

SEQ ID NO: 30608 - protein, 7 aa, Artificial Sequence
  Synthetic construct
WRGHGQF

SEQ ID NO: 30609 - protein, 7 aa, Artificial Sequence
  Synthetic construct
WRGHGQY

SEQ ID NO: 30610 - protein, 7 aa, Artificial Sequence
  Synthetic construct
WRGHGDF

SEQ ID NO: 30611 - protein, 7 aa, Artificial Sequence
  Synthetic construct
WRGHGDY

SEQ ID NO: 30612 - protein, 7 aa, Artificial Sequence
  Synthetic construct
WRGHGVF

SEQ ID NO: 30613 - protein, 7 aa, Artificial Sequence
  Synthetic construct
WRGHGVY

SEQ ID NO: 30614 - protein, 7 aa, Artificial Sequence
  Synthetic construct
WRGHAFF

SEQ ID NO: 30615 - protein, 7 aa, Artificial Sequence
  Synthetic construct
WRGHAFY

SEQ ID NO: 30616 - protein, 7 aa, Artificial Sequence
  Synthetic construct
WRGHARF

SEQ ID NO: 30617 - protein, 7 aa, Artificial Sequence
  Synthetic construct
WRGHARY

SEQ ID NO: 30618 - protein, 7 aa, Artificial Sequence
  Synthetic construct
WRGHACF

SEQ ID NO: 30619 - protein, 7 aa, Artificial Sequence
  Synthetic construct
WRGHACY

SEQ ID NO: 30620 - protein, 7 aa, Artificial Sequence
  Synthetic construct
WRGHALF

SEQ ID NO: 30621 - protein, 7 aa, Artificial Sequence
  Synthetic construct
WRGHALY

SEQ ID NO: 30622 - protein, 7 aa, Artificial Sequence
  Synthetic construct
WRGHAAF

SEQ ID NO: 30623 - protein, 7 aa, Artificial Sequence
  Synthetic construct
WRGHAAY

SEQ ID NO: 30624 - protein, 7 aa, Artificial Sequence
  Synthetic construct
WRGHAQF

SEQ ID NO: 30625 - protein, 7 aa, Artificial Sequence
  Synthetic construct
WRGHAQY

SEQ ID NO: 30626 - protein, 7 aa, Artificial Sequence
  Synthetic construct
WRGHADF

SEQ ID NO: 30627 - protein, 7 aa, Artificial Sequence
  Synthetic construct
WRGHADY

SEQ ID NO: 30628 - protein, 7 aa, Artificial Sequence
  Synthetic construct
WRGHAVF

SEQ ID NO: 30629 - protein, 7 aa, Artificial Sequence
  Synthetic construct
WRGHAVY

SEQ ID NO: 30630 - protein, 7 aa, Artificial Sequence
  Synthetic construct
WRGHQFF

SEQ ID NO: 30631 - protein, 7 aa, Artificial Sequence
  Synthetic construct
WRGHQFY

SEQ ID NO: 30632 - protein, 7 aa, Artificial Sequence
  Synthetic construct
WRGHQRF

SEQ ID NO: 30633 - protein, 7 aa, Artificial Sequence
  Synthetic construct
WRGHQRY

SEQ ID NO: 30634 - protein, 7 aa, Artificial Sequence
  Synthetic construct
WRGHQCF

SEQ ID NO: 30635 - protein, 7 aa, Artificial Sequence
  Synthetic construct
WRGHQCY

SEQ ID NO: 30636 - protein, 7 aa, Artificial Sequence
  Synthetic construct
WRGHQLF

SEQ ID NO: 30637 - protein, 7 aa, Artificial Sequence
  Synthetic construct
WRGHQLY

SEQ ID NO: 30638 - protein, 7 aa, Artificial Sequence
  Synthetic construct
WRGHQAF

SEQ ID NO: 30639 - protein, 7 aa, Artificial Sequence
  Synthetic construct
WRGHQAY

SEQ ID NO: 30640 - protein, 7 aa, Artificial Sequence
  Synthetic construct
WRGHQQF

SEQ ID NO: 30641 - protein, 7 aa, Artificial Sequence
  Synthetic construct
WRGHQQY

SEQ ID NO: 30642 - protein, 7 aa, Artificial Sequence
  Synthetic construct
WRGHQDF

SEQ ID NO: 30643 - protein, 7 aa, Artificial Sequence
  Synthetic construct
WRGHQDY

SEQ ID NO: 30644 - protein, 7 aa, Artificial Sequence
  Synthetic construct
WRGHQVF

SEQ ID NO: 30645 - protein, 7 aa, Artificial Sequence
  Synthetic construct
WRGHQVY

SEQ ID NO: 30646 - protein, 7 aa, Artificial Sequence
  Synthetic construct
WRGLIFF

SEQ ID NO: 30647 - protein, 7 aa, Artificial Sequence
  Synthetic construct
WRGLIFY

SEQ ID NO: 30648 - protein, 7 aa, Artificial Sequence
  Synthetic construct
WRGLIRF

SEQ ID NO: 30649 - protein, 7 aa, Artificial Sequence
  Synthetic construct
WRGLIRY

SEQ ID NO: 30650 - protein, 7 aa, Artificial Sequence
  Synthetic construct
WRGLICF

SEQ ID NO: 30651 - protein, 7 aa, Artificial Sequence
  Synthetic construct
WRGLICY

SEQ ID NO: 30652 - protein, 7 aa, Artificial Sequence
  Synthetic construct
WRGLILF

SEQ ID NO: 30653 - protein, 7 aa, Artificial Sequence
  Synthetic construct
WRGLILY

SEQ ID NO: 30654 - protein, 7 aa, Artificial Sequence
  Synthetic construct
WRGLIAF

SEQ ID NO: 30655 - protein, 7 aa, Artificial Sequence
  Synthetic construct
WRGLIAY

SEQ ID NO: 30656 - protein, 7 aa, Artificial Sequence
  Synthetic construct
WRGLIQF

SEQ ID NO: 30657 - protein, 7 aa, Artificial Sequence
  Synthetic construct
WRGLIQY

SEQ ID NO: 30658 - protein, 7 aa, Artificial Sequence
  Synthetic construct
WRGLIDF

SEQ ID NO: 30659 - protein, 7 aa, Artificial Sequence
  Synthetic construct
WRGLIDY

SEQ ID NO: 30660 - protein, 7 aa, Artificial Sequence
  Synthetic construct
WRGLIVF

SEQ ID NO: 30661 - protein, 7 aa, Artificial Sequence
  Synthetic construct
WRGLIVY

SEQ ID NO: 30662 - protein, 7 aa, Artificial Sequence
  Synthetic construct
WRGLDFF

SEQ ID NO: 30663 - protein, 7 aa, Artificial Sequence
  Synthetic construct
WRGLDFY

SEQ ID NO: 30664 - protein, 7 aa, Artificial Sequence
  Synthetic construct
WRGLDRF

SEQ ID NO: 30665 - protein, 7 aa, Artificial Sequence
  Synthetic construct
WRGLDRY

SEQ ID NO: 30666 - protein, 7 aa, Artificial Sequence
  Synthetic construct
WRGLDCF

SEQ ID NO: 30667 - protein, 7 aa, Artificial Sequence
  Synthetic construct
WRGLDCY

SEQ ID NO: 30668 - protein, 7 aa, Artificial Sequence
  Synthetic construct
WRGLDLF

SEQ ID NO: 30669 - protein, 7 aa, Artificial Sequence
  Synthetic construct
WRGLDLY

SEQ ID NO: 30670 - protein, 7 aa, Artificial Sequence
  Synthetic construct
WRGLDAF

SEQ ID NO: 30671 - protein, 7 aa, Artificial Sequence
  Synthetic construct
WRGLDAY

SEQ ID NO: 30672 - protein, 7 aa, Artificial Sequence
  Synthetic construct
WRGLDQF

SEQ ID NO: 30673 - protein, 7 aa, Artificial Sequence
  Synthetic construct
WRGLDQY

SEQ ID NO: 30674 - protein, 7 aa, Artificial Sequence
  Synthetic construct
WRGLDDF

SEQ ID NO: 30675 - protein, 7 aa, Artificial Sequence
  Synthetic construct
WRGLDDY

SEQ ID NO: 30676 - protein, 7 aa, Artificial Sequence
  Synthetic construct
WRGLDVF

SEQ ID NO: 30677 - protein, 7 aa, Artificial Sequence
  Synthetic construct
WRGLDVY

SEQ ID NO: 30678 - protein, 7 aa, Artificial Sequence
  Synthetic construct
WRGLYFF

SEQ ID NO: 30679 - protein, 7 aa, Artificial Sequence
  Synthetic construct
WRGLYFY

SEQ ID NO: 30680 - protein, 7 aa, Artificial Sequence
  Synthetic construct
WRGLYRF

SEQ ID NO: 30681 - protein, 7 aa, Artificial Sequence
  Synthetic construct
WRGLYRY

SEQ ID NO: 30682 - protein, 7 aa, Artificial Sequence
  Synthetic construct
WRGLYCF

SEQ ID NO: 30683 - protein, 7 aa, Artificial Sequence
  Synthetic construct
WRGLYCY

SEQ ID NO: 30684 - protein, 7 aa, Artificial Sequence
  Synthetic construct
WRGLYLF

SEQ ID NO: 30685 - protein, 7 aa, Artificial Sequence
  Synthetic construct
WRGLYLY

SEQ ID NO: 30686 - protein, 7 aa, Artificial Sequence
  Synthetic construct
WRGLYAF

SEQ ID NO: 30687 - protein, 7 aa, Artificial Sequence
  Synthetic construct
WRGLYAY

SEQ ID NO: 30688 - protein, 7 aa, Artificial Sequence
  Synthetic construct
WRGLYQF

SEQ ID NO: 30689 - protein, 7 aa, Artificial Sequence
  Synthetic construct
WRGLYQY

SEQ ID NO: 30690 - protein, 7 aa, Artificial Sequence
  Synthetic construct
WRGLYDF

SEQ ID NO: 30691 - protein, 7 aa, Artificial Sequence
  Synthetic construct
WRGLYDY

SEQ ID NO: 30692 - protein, 7 aa, Artificial Sequence
  Synthetic construct
WRGLYVF

SEQ ID NO: 30693 - protein, 7 aa, Artificial Sequence
  Synthetic construct
WRGLYVY

SEQ ID NO: 30694 - protein, 7 aa, Artificial Sequence
  Synthetic construct
WRGLFFF

SEQ ID NO: 30695 - protein, 7 aa, Artificial Sequence
  Synthetic construct
WRGLFFY

SEQ ID NO: 30696 - protein, 7 aa, Artificial Sequence
  Synthetic construct
WRGLFRF

SEQ ID NO: 30697 - protein, 7 aa, Artificial Sequence
  Synthetic construct
WRGLFRY

SEQ ID NO: 30698 - protein, 7 aa, Artificial Sequence
  Synthetic construct
WRGLFCF

SEQ ID NO: 30699 - protein, 7 aa, Artificial Sequence
  Synthetic construct
WRGLFCY

SEQ ID NO: 30700 - protein, 7 aa, Artificial Sequence
  Synthetic construct
WRGLFLF

SEQ ID NO: 30701 - protein, 7 aa, Artificial Sequence
  Synthetic construct
WRGLFLY

SEQ ID NO: 30702 - protein, 7 aa, Artificial Sequence
  Synthetic construct
WRGLFAF

SEQ ID NO: 30703 - protein, 7 aa, Artificial Sequence
  Synthetic construct
WRGLFAY

SEQ ID NO: 30704 - protein, 7 aa, Artificial Sequence
  Synthetic construct
WRGLFQF

SEQ ID NO: 30705 - protein, 7 aa, Artificial Sequence
  Synthetic construct
WRGLFQY

SEQ ID NO: 30706 - protein, 7 aa, Artificial Sequence
  Synthetic construct
WRGLFDF

SEQ ID NO: 30707 - protein, 7 aa, Artificial Sequence
  Synthetic construct
WRGLFDY

SEQ ID NO: 30708 - protein, 7 aa, Artificial Sequence
  Synthetic construct
WRGLFVF

SEQ ID NO: 30709 - protein, 7 aa, Artificial Sequence
  Synthetic construct
WRGLFVY

SEQ ID NO: 30710 - protein, 7 aa, Artificial Sequence
  Synthetic construct
WRGLVFF

SEQ ID NO: 30711 - protein, 7 aa, Artificial Sequence
  Synthetic construct
WRGLVFY

SEQ ID NO: 30712 - protein, 7 aa, Artificial Sequence
  Synthetic construct
WRGLVRF

SEQ ID NO: 30713 - protein, 7 aa, Artificial Sequence
  Synthetic construct
WRGLVRY

SEQ ID NO: 30714 - protein, 7 aa, Artificial Sequence
  Synthetic construct
WRGLVCF

SEQ ID NO: 30715 - protein, 7 aa, Artificial Sequence
  Synthetic construct
WRGLVCY

SEQ ID NO: 30716 - protein, 7 aa, Artificial Sequence
  Synthetic construct
WRGLVLF

SEQ ID NO: 30717 - protein, 7 aa, Artificial Sequence
  Synthetic construct
WRGLVLY

SEQ ID NO: 30718 - protein, 7 aa, Artificial Sequence
  Synthetic construct
WRGLVAF

SEQ ID NO: 30719 - protein, 7 aa, Artificial Sequence
  Synthetic construct
WRGLVAY

SEQ ID NO: 30720 - protein, 7 aa, Artificial Sequence
  Synthetic construct
WRGLVQF

SEQ ID NO: 30721 - protein, 7 aa, Artificial Sequence
  Synthetic construct
WRGLVQY

SEQ ID NO: 30722 - protein, 7 aa, Artificial Sequence
  Synthetic construct
WRGLVDF

SEQ ID NO: 30723 - protein, 7 aa, Artificial Sequence
  Synthetic construct
WRGLVDY

SEQ ID NO: 30724 - protein, 7 aa, Artificial Sequence
  Synthetic construct
WRGLVVF

SEQ ID NO: 30725 - protein, 7 aa, Artificial Sequence
  Synthetic construct
WRGLVVY

SEQ ID NO: 30726 - protein, 7 aa, Artificial Sequence
  Synthetic construct
WRGLTFF

SEQ ID NO: 30727 - protein, 7 aa, Artificial Sequence
  Synthetic construct
WRGLTFY

SEQ ID NO: 30728 - protein, 7 aa, Artificial Sequence
  Synthetic construct
WRGLTRF

SEQ ID NO: 30729 - protein, 7 aa, Artificial Sequence
  Synthetic construct
WRGLTRY

SEQ ID NO: 30730 - protein, 7 aa, Artificial Sequence
  Synthetic construct
WRGLTCF

SEQ ID NO: 30731 - protein, 7 aa, Artificial Sequence
  Synthetic construct
WRGLTCY

SEQ ID NO: 30732 - protein, 7 aa, Artificial Sequence
  Synthetic construct
WRGLTLF

SEQ ID NO: 30733 - protein, 7 aa, Artificial Sequence
  Synthetic construct
WRGLTLY

SEQ ID NO: 30734 - protein, 7 aa, Artificial Sequence
  Synthetic construct
WRGLTAF

SEQ ID NO: 30735 - protein, 7 aa, Artificial Sequence
  Synthetic construct
WRGLTAY

SEQ ID NO: 30736 - protein, 7 aa, Artificial Sequence
  Synthetic construct
WRGLTQF

SEQ ID NO: 30737 - protein, 7 aa, Artificial Sequence
  Synthetic construct
WRGLTQY

SEQ ID NO: 30738 - protein, 7 aa, Artificial Sequence
  Synthetic construct
WRGLTDF

SEQ ID NO: 30739 - protein, 7 aa, Artificial Sequence
  Synthetic construct
WRGLTDY

SEQ ID NO: 30740 - protein, 7 aa, Artificial Sequence
  Synthetic construct
WRGLTVF

SEQ ID NO: 30741 - protein, 7 aa, Artificial Sequence
  Synthetic construct
WRGLTVY

SEQ ID NO: 30742 - protein, 7 aa, Artificial Sequence
  Synthetic construct
WRGLGFF

SEQ ID NO: 30743 - protein, 7 aa, Artificial Sequence
  Synthetic construct
WRGLGFY

SEQ ID NO: 30744 - protein, 7 aa, Artificial Sequence
  Synthetic construct
WRGLGRF

SEQ ID NO: 30745 - protein, 7 aa, Artificial Sequence
  Synthetic construct
WRGLGRY

SEQ ID NO: 30746 - protein, 7 aa, Artificial Sequence
  Synthetic construct
WRGLGCF

SEQ ID NO: 30747 - protein, 7 aa, Artificial Sequence
  Synthetic construct
WRGLGCY

SEQ ID NO: 30748 - protein, 7 aa, Artificial Sequence
  Synthetic construct
WRGLGLF

SEQ ID NO: 30749 - protein, 7 aa, Artificial Sequence
  Synthetic construct
WRGLGLY

SEQ ID NO: 30750 - protein, 7 aa, Artificial Sequence
  Synthetic construct
WRGLGAF

SEQ ID NO: 30751 - protein, 7 aa, Artificial Sequence
  Synthetic construct
WRGLGAY

SEQ ID NO: 30752 - protein, 7 aa, Artificial Sequence
  Synthetic construct
WRGLGQF

SEQ ID NO: 30753 - protein, 7 aa, Artificial Sequence
  Synthetic construct
WRGLGQY

SEQ ID NO: 30754 - protein, 7 aa, Artificial Sequence
  Synthetic construct
WRGLGDF

SEQ ID NO: 30755 - protein, 7 aa, Artificial Sequence
  Synthetic construct
WRGLGDY

SEQ ID NO: 30756 - protein, 7 aa, Artificial Sequence
  Synthetic construct
WRGLGVF

SEQ ID NO: 30757 - protein, 7 aa, Artificial Sequence
  Synthetic construct
WRGLGVY

SEQ ID NO: 30758 - protein, 7 aa, Artificial Sequence
  Synthetic construct
WRGLAFF

SEQ ID NO: 30759 - protein, 7 aa, Artificial Sequence
  Synthetic construct
WRGLAFY

SEQ ID NO: 30760 - protein, 7 aa, Artificial Sequence
  Synthetic construct
WRGLARF

SEQ ID NO: 30761 - protein, 7 aa, Artificial Sequence
  Synthetic construct
WRGLARY

SEQ ID NO: 30762 - protein, 7 aa, Artificial Sequence
  Synthetic construct
WRGLACF

SEQ ID NO: 30763 - protein, 7 aa, Artificial Sequence
  Synthetic construct
WRGLACY

SEQ ID NO: 30764 - protein, 7 aa, Artificial Sequence
  Synthetic construct
WRGLALF

SEQ ID NO: 30765 - protein, 7 aa, Artificial Sequence
  Synthetic construct
WRGLALY

SEQ ID NO: 30766 - protein, 7 aa, Artificial Sequence
  Synthetic construct
WRGLAAF

SEQ ID NO: 30767 - protein, 7 aa, Artificial Sequence
  Synthetic construct
WRGLAAY

SEQ ID NO: 30768 - protein, 7 aa, Artificial Sequence
  Synthetic construct
WRGLAQF

SEQ ID NO: 30769 - protein, 7 aa, Artificial Sequence
  Synthetic construct
WRGLAQY

SEQ ID NO: 30770 - protein, 7 aa, Artificial Sequence
  Synthetic construct
WRGLADF

SEQ ID NO: 30771 - protein, 7 aa, Artificial Sequence
  Synthetic construct
WRGLADY

SEQ ID NO: 30772 - protein, 7 aa, Artificial Sequence
  Synthetic construct
WRGLAVF

SEQ ID NO: 30773 - protein, 7 aa, Artificial Sequence
  Synthetic construct
WRGLAVY

SEQ ID NO: 30774 - protein, 7 aa, Artificial Sequence
  Synthetic construct
WRGLQFF

SEQ ID NO: 30775 - protein, 7 aa, Artificial Sequence
  Synthetic construct
WRGLQFY

SEQ ID NO: 30776 - protein, 7 aa, Artificial Sequence
  Synthetic construct
WRGLQRF

SEQ ID NO: 30777 - protein, 7 aa, Artificial Sequence
  Synthetic construct
WRGLQRY

SEQ ID NO: 30778 - protein, 7 aa, Artificial Sequence
  Synthetic construct
WRGLQCF

SEQ ID NO: 30779 - protein, 7 aa, Artificial Sequence
  Synthetic construct
WRGLQCY

SEQ ID NO: 30780 - protein, 7 aa, Artificial Sequence
  Synthetic construct
WRGLQLF

SEQ ID NO: 30781 - protein, 7 aa, Artificial Sequence
  Synthetic construct
WRGLQLY

SEQ ID NO: 30782 - protein, 7 aa, Artificial Sequence
  Synthetic construct
WRGLQAF

SEQ ID NO: 30783 - protein, 7 aa, Artificial Sequence
  Synthetic construct
WRGLQAY

SEQ ID NO: 30784 - protein, 7 aa, Artificial Sequence
  Synthetic construct
WRGLQQF

SEQ ID NO: 30785 - protein, 7 aa, Artificial Sequence
  Synthetic construct
WRGLQQY

SEQ ID NO: 30786 - protein, 7 aa, Artificial Sequence
  Synthetic construct
WRGLQDF

SEQ ID NO: 30787 - protein, 7 aa, Artificial Sequence
  Synthetic construct
WRGLQDY

SEQ ID NO: 30788 - protein, 7 aa, Artificial Sequence
  Synthetic construct
WRGLQVF

SEQ ID NO: 30789 - protein, 7 aa, Artificial Sequence
  Synthetic construct
WRGLQVY

SEQ ID NO: 30790 - protein, 7 aa, Artificial Sequence
  Synthetic construct
WRGFIFF

SEQ ID NO: 30791 - protein, 7 aa, Artificial Sequence
  Synthetic construct
WRGFIFY

SEQ ID NO: 30792 - protein, 7 aa, Artificial Sequence
  Synthetic construct
WRGFIRF

SEQ ID NO: 30793 - protein, 7 aa, Artificial Sequence
  Synthetic construct
WRGFIRY

SEQ ID NO: 30794 - protein, 7 aa, Artificial Sequence
  Synthetic construct
WRGFICF

SEQ ID NO: 30795 - protein, 7 aa, Artificial Sequence
  Synthetic construct
WRGFICY

SEQ ID NO: 30796 - protein, 7 aa, Artificial Sequence
  Synthetic construct
WRGFILF

SEQ ID NO: 30797 - protein, 7 aa, Artificial Sequence
  Synthetic construct
WRGFILY

SEQ ID NO: 30798 - protein, 7 aa, Artificial Sequence
  Synthetic construct
WRGFIAF

SEQ ID NO: 30799 - protein, 7 aa, Artificial Sequence
  Synthetic construct
WRGFIAY

SEQ ID NO: 30800 - protein, 7 aa, Artificial Sequence
  Synthetic construct
WRGFIQF

SEQ ID NO: 30801 - protein, 7 aa, Artificial Sequence
  Synthetic construct
WRGFIQY

SEQ ID NO: 30802 - protein, 7 aa, Artificial Sequence
  Synthetic construct
WRGFIDF

SEQ ID NO: 30803 - protein, 7 aa, Artificial Sequence
  Synthetic construct
WRGFIDY

SEQ ID NO: 30804 - protein, 7 aa, Artificial Sequence
  Synthetic construct
WRGFIVF

SEQ ID NO: 30805 - protein, 7 aa, Artificial Sequence
  Synthetic construct
WRGFIVY

SEQ ID NO: 30806 - protein, 7 aa, Artificial Sequence
  Synthetic construct
WRGFDFF

SEQ ID NO: 30807 - protein, 7 aa, Artificial Sequence
  Synthetic construct
WRGFDFY

SEQ ID NO: 30808 - protein, 7 aa, Artificial Sequence
  Synthetic construct
WRGFDRF

SEQ ID NO: 30809 - protein, 7 aa, Artificial Sequence
  Synthetic construct
WRGFDRY

SEQ ID NO: 30810 - protein, 7 aa, Artificial Sequence
  Synthetic construct
WRGFDCF

SEQ ID NO: 30811 - protein, 7 aa, Artificial Sequence
  Synthetic construct
WRGFDCY

SEQ ID NO: 30812 - protein, 7 aa, Artificial Sequence
  Synthetic construct
WRGFDLF

SEQ ID NO: 30813 - protein, 7 aa, Artificial Sequence
  Synthetic construct
WRGFDLY

SEQ ID NO: 30814 - protein, 7 aa, Artificial Sequence
  Synthetic construct
WRGFDAF

SEQ ID NO: 30815 - protein, 7 aa, Artificial Sequence
  Synthetic construct
WRGFDAY

SEQ ID NO: 30816 - protein, 7 aa, Artificial Sequence
  Synthetic construct
WRGFDQF

SEQ ID NO: 30817 - protein, 7 aa, Artificial Sequence
  Synthetic construct
WRGFDQY

SEQ ID NO: 30818 - protein, 7 aa, Artificial Sequence
  Synthetic construct
WRGFDDF

SEQ ID NO: 30819 - protein, 7 aa, Artificial Sequence
  Synthetic construct
WRGFDDY

SEQ ID NO: 30820 - protein, 7 aa, Artificial Sequence
  Synthetic construct
WRGFDVF

SEQ ID NO: 30821 - protein, 7 aa, Artificial Sequence
  Synthetic construct
WRGFDVY

SEQ ID NO: 30822 - protein, 7 aa, Artificial Sequence
  Synthetic construct
WRGFYFF

SEQ ID NO: 30823 - protein, 7 aa, Artificial Sequence
  Synthetic construct
WRGFYFY

SEQ ID NO: 30824 - protein, 7 aa, Artificial Sequence
  Synthetic construct
WRGFYRF

SEQ ID NO: 30825 - protein, 7 aa, Artificial Sequence
  Synthetic construct
WRGFYRY

SEQ ID NO: 30826 - protein, 7 aa, Artificial Sequence
  Synthetic construct
WRGFYCF

SEQ ID NO: 30827 - protein, 7 aa, Artificial Sequence
  Synthetic construct
WRGFYCY

SEQ ID NO: 30828 - protein, 7 aa, Artificial Sequence
  Synthetic construct
WRGFYLF

SEQ ID NO: 30829 - protein, 7 aa, Artificial Sequence
  Synthetic construct
WRGFYLY

SEQ ID NO: 30830 - protein, 7 aa, Artificial Sequence
  Synthetic construct
WRGFYAF

SEQ ID NO: 30831 - protein, 7 aa, Artificial Sequence
  Synthetic construct
WRGFYAY

SEQ ID NO: 30832 - protein, 7 aa, Artificial Sequence
  Synthetic construct
WRGFYQF

SEQ ID NO: 30833 - protein, 7 aa, Artificial Sequence
  Synthetic construct
WRGFYQY

SEQ ID NO: 30834 - protein, 7 aa, Artificial Sequence
  Synthetic construct
WRGFYDF

SEQ ID NO: 30835 - protein, 7 aa, Artificial Sequence
  Synthetic construct
WRGFYDY

SEQ ID NO: 30836 - protein, 7 aa, Artificial Sequence
  Synthetic construct
WRGFYVF

SEQ ID NO: 30837 - protein, 7 aa, Artificial Sequence
  Synthetic construct
WRGFYVY

SEQ ID NO: 30838 - protein, 7 aa, Artificial Sequence
  Synthetic construct
WRGFFFF

SEQ ID NO: 30839 - protein, 7 aa, Artificial Sequence
  Synthetic construct
WRGFFFY

SEQ ID NO: 30840 - protein, 7 aa, Artificial Sequence
  Synthetic construct
WRGFFRF

SEQ ID NO: 30841 - protein, 7 aa, Artificial Sequence
  Synthetic construct
WRGFFRY

SEQ ID NO: 30842 - protein, 7 aa, Artificial Sequence
  Synthetic construct
WRGFFCF

SEQ ID NO: 30843 - protein, 7 aa, Artificial Sequence
  Synthetic construct
WRGFFCY

SEQ ID NO: 30844 - protein, 7 aa, Artificial Sequence
  Synthetic construct
WRGFFLF

SEQ ID NO: 30845 - protein, 7 aa, Artificial Sequence
  Synthetic construct
WRGFFLY

SEQ ID NO: 30846 - protein, 7 aa, Artificial Sequence
  Synthetic construct
WRGFFAF

SEQ ID NO: 30847 - protein, 7 aa, Artificial Sequence
  Synthetic construct
WRGFFAY

SEQ ID NO: 30848 - protein, 7 aa, Artificial Sequence
  Synthetic construct
WRGFFQF

SEQ ID NO: 30849 - protein, 7 aa, Artificial Sequence
  Synthetic construct
WRGFFQY

SEQ ID NO: 30850 - protein, 7 aa, Artificial Sequence
  Synthetic construct
WRGFFDF

SEQ ID NO: 30851 - protein, 7 aa, Artificial Sequence
  Synthetic construct
WRGFFDY

SEQ ID NO: 30852 - protein, 7 aa, Artificial Sequence
  Synthetic construct
WRGFFVF

SEQ ID NO: 30853 - protein, 7 aa, Artificial Sequence
  Synthetic construct
WRGFFVY

SEQ ID NO: 30854 - protein, 7 aa, Artificial Sequence
  Synthetic construct
WRGFVFF

SEQ ID NO: 30855 - protein, 7 aa, Artificial Sequence
  Synthetic construct
WRGFVFY

SEQ ID NO: 30856 - protein, 7 aa, Artificial Sequence
  Synthetic construct
WRGFVRF

SEQ ID NO: 30857 - protein, 7 aa, Artificial Sequence
  Synthetic construct
WRGFVRY

SEQ ID NO: 30858 - protein, 7 aa, Artificial Sequence
  Synthetic construct
WRGFVCF

SEQ ID NO: 30859 - protein, 7 aa, Artificial Sequence
  Synthetic construct
WRGFVCY

SEQ ID NO: 30860 - protein, 7 aa, Artificial Sequence
  Synthetic construct
WRGFVLF

SEQ ID NO: 30861 - protein, 7 aa, Artificial Sequence
  Synthetic construct
WRGFVLY

SEQ ID NO: 30862 - protein, 7 aa, Artificial Sequence
  Synthetic construct
WRGFVAF

SEQ ID NO: 30863 - protein, 7 aa, Artificial Sequence
  Synthetic construct
WRGFVAY

SEQ ID NO: 30864 - protein, 7 aa, Artificial Sequence
  Synthetic construct
WRGFVQF

SEQ ID NO: 30865 - protein, 7 aa, Artificial Sequence
  Synthetic construct
WRGFVQY

SEQ ID NO: 30866 - protein, 7 aa, Artificial Sequence
  Synthetic construct
WRGFVDF

SEQ ID NO: 30867 - protein, 7 aa, Artificial Sequence
  Synthetic construct
WRGFVDY

SEQ ID NO: 30868 - protein, 7 aa, Artificial Sequence
  Synthetic construct
WRGFVVF

SEQ ID NO: 30869 - protein, 7 aa, Artificial Sequence
  Synthetic construct
WRGFVVY

SEQ ID NO: 30870 - protein, 7 aa, Artificial Sequence
  Synthetic construct
WRGFTFF

SEQ ID NO: 30871 - protein, 7 aa, Artificial Sequence
  Synthetic construct
WRGFTFY

SEQ ID NO: 30872 - protein, 7 aa, Artificial Sequence
  Synthetic construct
WRGFTRF

SEQ ID NO: 30873 - protein, 7 aa, Artificial Sequence
  Synthetic construct
WRGFTRY

SEQ ID NO: 30874 - protein, 7 aa, Artificial Sequence
  Synthetic construct
WRGFTCF

SEQ ID NO: 30875 - protein, 7 aa, Artificial Sequence
  Synthetic construct
WRGFTCY

SEQ ID NO: 30876 - protein, 7 aa, Artificial Sequence
  Synthetic construct
WRGFTLF

SEQ ID NO: 30877 - protein, 7 aa, Artificial Sequence
  Synthetic construct
WRGFTLY

SEQ ID NO: 30878 - protein, 7 aa, Artificial Sequence
  Synthetic construct
WRGFTAF

SEQ ID NO: 30879 - protein, 7 aa, Artificial Sequence
  Synthetic construct
WRGFTAY

SEQ ID NO: 30880 - protein, 7 aa, Artificial Sequence
  Synthetic construct
WRGFTQF

SEQ ID NO: 30881 - protein, 7 aa, Artificial Sequence
  Synthetic construct
WRGFTQY

SEQ ID NO: 30882 - protein, 7 aa, Artificial Sequence
  Synthetic construct
WRGFTDF

SEQ ID NO: 30883 - protein, 7 aa, Artificial Sequence
  Synthetic construct
WRGFTDY

SEQ ID NO: 30884 - protein, 7 aa, Artificial Sequence
  Synthetic construct
WRGFTVF

SEQ ID NO: 30885 - protein, 7 aa, Artificial Sequence
  Synthetic construct
WRGFTVY

SEQ ID NO: 30886 - protein, 7 aa, Artificial Sequence
  Synthetic construct
WRGFGFF

SEQ ID NO: 30887 - protein, 7 aa, Artificial Sequence
  Synthetic construct
WRGFGFY

SEQ ID NO: 30888 - protein, 7 aa, Artificial Sequence
  Synthetic construct
WRGFGRF

SEQ ID NO: 30889 - protein, 7 aa, Artificial Sequence
  Synthetic construct
WRGFGRY

SEQ ID NO: 30890 - protein, 7 aa, Artificial Sequence
  Synthetic construct
WRGFGCF

SEQ ID NO: 30891 - protein, 7 aa, Artificial Sequence
  Synthetic construct
WRGFGCY

SEQ ID NO: 30892 - protein, 7 aa, Artificial Sequence
  Synthetic construct
WRGFGLF

SEQ ID NO: 30893 - protein, 7 aa, Artificial Sequence
  Synthetic construct
WRGFGLY

SEQ ID NO: 30894 - protein, 7 aa, Artificial Sequence
  Synthetic construct
WRGFGAF

SEQ ID NO: 30895 - protein, 7 aa, Artificial Sequence
  Synthetic construct
WRGFGAY

SEQ ID NO: 30896 - protein, 7 aa, Artificial Sequence
  Synthetic construct
WRGFGQF

SEQ ID NO: 30897 - protein, 7 aa, Artificial Sequence
  Synthetic construct
WRGFGQY

SEQ ID NO: 30898 - protein, 7 aa, Artificial Sequence
  Synthetic construct
WRGFGDF

SEQ ID NO: 30899 - protein, 7 aa, Artificial Sequence
  Synthetic construct
WRGFGDY

SEQ ID NO: 30900 - protein, 7 aa, Artificial Sequence
  Synthetic construct
WRGFGVF

SEQ ID NO: 30901 - protein, 7 aa, Artificial Sequence
  Synthetic construct
WRGFGVY

SEQ ID NO: 30902 - protein, 7 aa, Artificial Sequence
  Synthetic construct
WRGFAFF

SEQ ID NO: 30903 - protein, 7 aa, Artificial Sequence
  Synthetic construct
WRGFAFY

SEQ ID NO: 30904 - protein, 7 aa, Artificial Sequence
  Synthetic construct
WRGFARF

SEQ ID NO: 30905 - protein, 7 aa, Artificial Sequence
  Synthetic construct
WRGFARY

SEQ ID NO: 30906 - protein, 7 aa, Artificial Sequence
  Synthetic construct
WRGFACF

SEQ ID NO: 30907 - protein, 7 aa, Artificial Sequence
  Synthetic construct
WRGFACY

SEQ ID NO: 30908 - protein, 7 aa, Artificial Sequence
  Synthetic construct
WRGFALF

SEQ ID NO: 30909 - protein, 7 aa, Artificial Sequence
  Synthetic construct
WRGFALY

SEQ ID NO: 30910 - protein, 7 aa, Artificial Sequence
  Synthetic construct
WRGFAAF

SEQ ID NO: 30911 - protein, 7 aa, Artificial Sequence
  Synthetic construct
WRGFAAY

SEQ ID NO: 30912 - protein, 7 aa, Artificial Sequence
  Synthetic construct
WRGFAQF

SEQ ID NO: 30913 - protein, 7 aa, Artificial Sequence
  Synthetic construct
WRGFAQY

SEQ ID NO: 30914 - protein, 7 aa, Artificial Sequence
  Synthetic construct
WRGFADF

SEQ ID NO: 30915 - protein, 7 aa, Artificial Sequence
  Synthetic construct
WRGFADY

SEQ ID NO: 30916 - protein, 7 aa, Artificial Sequence
  Synthetic construct
WRGFAVF

SEQ ID NO: 30917 - protein, 7 aa, Artificial Sequence
  Synthetic construct
WRGFAVY

SEQ ID NO: 30918 - protein, 7 aa, Artificial Sequence
  Synthetic construct
WRGFQFF

SEQ ID NO: 30919 - protein, 7 aa, Artificial Sequence
  Synthetic construct
WRGFQFY

SEQ ID NO: 30920 - protein, 7 aa, Artificial Sequence
  Synthetic construct
WRGFQRF

SEQ ID NO: 30921 - protein, 7 aa, Artificial Sequence
  Synthetic construct
WRGFQRY

SEQ ID NO: 30922 - protein, 7 aa, Artificial Sequence
  Synthetic construct
WRGFQCF

SEQ ID NO: 30923 - protein, 7 aa, Artificial Sequence
  Synthetic construct
WRGFQCY

SEQ ID NO: 30924 - protein, 7 aa, Artificial Sequence
  Synthetic construct
WRGFQLF

SEQ ID NO: 30925 - protein, 7 aa, Artificial Sequence
  Synthetic construct
WRGFQLY

SEQ ID NO: 30926 - protein, 7 aa, Artificial Sequence
  Synthetic construct
WRGFQAF

SEQ ID NO: 30927 - protein, 7 aa, Artificial Sequence
  Synthetic construct
WRGFQAY

SEQ ID NO: 30928 - protein, 7 aa, Artificial Sequence
  Synthetic construct
WRGFQQF

SEQ ID NO: 30929 - protein, 7 aa, Artificial Sequence
  Synthetic construct
WRGFQQY

SEQ ID NO: 30930 - protein, 7 aa, Artificial Sequence
  Synthetic construct
WRGFQDF

SEQ ID NO: 30931 - protein, 7 aa, Artificial Sequence
  Synthetic construct
WRGFQDY

SEQ ID NO: 30932 - protein, 7 aa, Artificial Sequence
  Synthetic construct
WRGFQVF

SEQ ID NO: 30933 - protein, 7 aa, Artificial Sequence
  Synthetic construct
WRGFQVY

SEQ ID NO: 30934 - protein, 7 aa, Artificial Sequence
  Synthetic construct
WMIYIFF

SEQ ID NO: 30935 - protein, 7 aa, Artificial Sequence
  Synthetic construct
WMIYIFY

SEQ ID NO: 30936 - protein, 7 aa, Artificial Sequence
  Synthetic construct
WMIYIRF

SEQ ID NO: 30937 - protein, 7 aa, Artificial Sequence
  Synthetic construct
WMIYIRY

SEQ ID NO: 30938 - protein, 7 aa, Artificial Sequence
  Synthetic construct
WMIYICF

SEQ ID NO: 30939 - protein, 7 aa, Artificial Sequence
  Synthetic construct
WMIYICY

SEQ ID NO: 30940 - protein, 7 aa, Artificial Sequence
  Synthetic construct
WMIYILF

SEQ ID NO: 30941 - protein, 7 aa, Artificial Sequence
  Synthetic construct
WMIYILY

SEQ ID NO: 30942 - protein, 7 aa, Artificial Sequence
  Synthetic construct
WMIYIAF

SEQ ID NO: 30943 - protein, 7 aa, Artificial Sequence
  Synthetic construct
WMIYIAY

SEQ ID NO: 30944 - protein, 7 aa, Artificial Sequence
  Synthetic construct
WMIYIQF

SEQ ID NO: 30945 - protein, 7 aa, Artificial Sequence
  Synthetic construct
WMIYIQY

SEQ ID NO: 30946 - protein, 7 aa, Artificial Sequence
  Synthetic construct
WMIYIDF

SEQ ID NO: 30947 - protein, 7 aa, Artificial Sequence
  Synthetic construct
WMIYIDY

SEQ ID NO: 30948 - protein, 7 aa, Artificial Sequence
  Synthetic construct
WMIYIVF

SEQ ID NO: 30949 - protein, 7 aa, Artificial Sequence
  Synthetic construct
WMIYIVY

SEQ ID NO: 30950 - protein, 7 aa, Artificial Sequence
  Synthetic construct
WMIYDFF

SEQ ID NO: 30951 - protein, 7 aa, Artificial Sequence
  Synthetic construct
WMIYDFY

SEQ ID NO: 30952 - protein, 7 aa, Artificial Sequence
  Synthetic construct
WMIYDRF

SEQ ID NO: 30953 - protein, 7 aa, Artificial Sequence
  Synthetic construct
WMIYDRY

SEQ ID NO: 30954 - protein, 7 aa, Artificial Sequence
  Synthetic construct
WMIYDCF

SEQ ID NO: 30955 - protein, 7 aa, Artificial Sequence
  Synthetic construct
WMIYDCY

SEQ ID NO: 30956 - protein, 7 aa, Artificial Sequence
  Synthetic construct
WMIYDLF

SEQ ID NO: 30957 - protein, 7 aa, Artificial Sequence
  Synthetic construct
WMIYDLY

SEQ ID NO: 30958 - protein, 7 aa, Artificial Sequence
  Synthetic construct
WMIYDAF

SEQ ID NO: 30959 - protein, 7 aa, Artificial Sequence
  Synthetic construct
WMIYDAY

SEQ ID NO: 30960 - protein, 7 aa, Artificial Sequence
  Synthetic construct
WMIYDQF

SEQ ID NO: 30961 - protein, 7 aa, Artificial Sequence
  Synthetic construct
WMIYDQY

SEQ ID NO: 30962 - protein, 7 aa, Artificial Sequence
  Synthetic construct
WMIYDDF

SEQ ID NO: 30963 - protein, 7 aa, Artificial Sequence
  Synthetic construct
WMIYDDY

SEQ ID NO: 30964 - protein, 7 aa, Artificial Sequence
  Synthetic construct
WMIYDVF

SEQ ID NO: 30965 - protein, 7 aa, Artificial Sequence
  Synthetic construct
WMIYDVY

SEQ ID NO: 30966 - protein, 7 aa, Artificial Sequence
  Synthetic construct
WMIYYFF

SEQ ID NO: 30967 - protein, 7 aa, Artificial Sequence
  Synthetic construct
WMIYYFY

SEQ ID NO: 30968 - protein, 7 aa, Artificial Sequence
  Synthetic construct
WMIYYRF

SEQ ID NO: 30969 - protein, 7 aa, Artificial Sequence
  Synthetic construct
WMIYYRY

SEQ ID NO: 30970 - protein, 7 aa, Artificial Sequence
  Synthetic construct
WMIYYCF

SEQ ID NO: 30971 - protein, 7 aa, Artificial Sequence
  Synthetic construct
WMIYYCY

SEQ ID NO: 30972 - protein, 7 aa, Artificial Sequence
  Synthetic construct
WMIYYLF

SEQ ID NO: 30973 - protein, 7 aa, Artificial Sequence
  Synthetic construct
WMIYYLY

SEQ ID NO: 30974 - protein, 7 aa, Artificial Sequence
  Synthetic construct
WMIYYAF

SEQ ID NO: 30975 - protein, 7 aa, Artificial Sequence
  Synthetic construct
WMIYYAY

SEQ ID NO: 30976 - protein, 7 aa, Artificial Sequence
  Synthetic construct
WMIYYQF

SEQ ID NO: 30977 - protein, 7 aa, Artificial Sequence
  Synthetic construct
WMIYYQY

SEQ ID NO: 30978 - protein, 7 aa, Artificial Sequence
  Synthetic construct
WMIYYDF

SEQ ID NO: 30979 - protein, 7 aa, Artificial Sequence
  Synthetic construct
WMIYYDY

SEQ ID NO: 30980 - protein, 7 aa, Artificial Sequence
  Synthetic construct
WMIYYVF

SEQ ID NO: 30981 - protein, 7 aa, Artificial Sequence
  Synthetic construct
WMIYYVY

SEQ ID NO: 30982 - protein, 7 aa, Artificial Sequence
  Synthetic construct
WMIYFFF

SEQ ID NO: 30983 - protein, 7 aa, Artificial Sequence
  Synthetic construct
WMIYFFY

SEQ ID NO: 30984 - protein, 7 aa, Artificial Sequence
  Synthetic construct
WMIYFRF

SEQ ID NO: 30985 - protein, 7 aa, Artificial Sequence
  Synthetic construct
WMIYFRY

SEQ ID NO: 30986 - protein, 7 aa, Artificial Sequence
  Synthetic construct
WMIYFCF

SEQ ID NO: 30987 - protein, 7 aa, Artificial Sequence
  Synthetic construct
WMIYFCY

SEQ ID NO: 30988 - protein, 7 aa, Artificial Sequence
  Synthetic construct
WMIYFLF

SEQ ID NO: 30989 - protein, 7 aa, Artificial Sequence
  Synthetic construct
WMIYFLY

SEQ ID NO: 30990 - protein, 7 aa, Artificial Sequence
  Synthetic construct
WMIYFAF

SEQ ID NO: 30991 - protein, 7 aa, Artificial Sequence
  Synthetic construct
WMIYFAY

SEQ ID NO: 30992 - protein, 7 aa, Artificial Sequence
  Synthetic construct
WMIYFQF

SEQ ID NO: 30993 - protein, 7 aa, Artificial Sequence
  Synthetic construct
WMIYFQY

SEQ ID NO: 30994 - protein, 7 aa, Artificial Sequence
  Synthetic construct
WMIYFDF

SEQ ID NO: 30995 - protein, 7 aa, Artificial Sequence
  Synthetic construct
WMIYFDY

SEQ ID NO: 30996 - protein, 7 aa, Artificial Sequence
  Synthetic construct
WMIYFVF

SEQ ID NO: 30997 - protein, 7 aa, Artificial Sequence
  Synthetic construct
WMIYFVY

SEQ ID NO: 30998 - protein, 7 aa, Artificial Sequence
  Synthetic construct
WMIYVFF

SEQ ID NO: 30999 - protein, 7 aa, Artificial Sequence
  Synthetic construct
WMIYVFY

SEQ ID NO: 31000 - protein, 7 aa, Artificial Sequence
  Synthetic construct
WMIYVRF

SEQ ID NO: 31001 - protein, 7 aa, Artificial Sequence
  Synthetic construct
WMIYVRY

SEQ ID NO: 31002 - protein, 7 aa, Artificial Sequence
  Synthetic construct
WMIYVCF

SEQ ID NO: 31003 - protein, 7 aa, Artificial Sequence
  Synthetic construct
WMIYVCY

SEQ ID NO: 31004 - protein, 7 aa, Artificial Sequence
  Synthetic construct
WMIYVLF

SEQ ID NO: 31005 - protein, 7 aa, Artificial Sequence
  Synthetic construct
WMIYVLY

SEQ ID NO: 31006 - protein, 7 aa, Artificial Sequence
  Synthetic construct
WMIYVAF

SEQ ID NO: 31007 - protein, 7 aa, Artificial Sequence
  Synthetic construct
WMIYVAY

SEQ ID NO: 31008 - protein, 7 aa, Artificial Sequence
  Synthetic construct
WMIYVQF

SEQ ID NO: 31009 - protein, 7 aa, Artificial Sequence
  Synthetic construct
WMIYVQY

SEQ ID NO: 31010 - protein, 7 aa, Artificial Sequence
  Synthetic construct
WMIYVDF

SEQ ID NO: 31011 - protein, 7 aa, Artificial Sequence
  Synthetic construct
WMIYVDY

SEQ ID NO: 31012 - protein, 7 aa, Artificial Sequence
  Synthetic construct
WMIYVVF

SEQ ID NO: 31013 - protein, 7 aa, Artificial Sequence
  Synthetic construct
WMIYVVY

SEQ ID NO: 31014 - protein, 7 aa, Artificial Sequence
  Synthetic construct
WMIYTFF

SEQ ID NO: 31015 - protein, 7 aa, Artificial Sequence
  Synthetic construct
WMIYTFY

SEQ ID NO: 31016 - protein, 7 aa, Artificial Sequence
  Synthetic construct
WMIYTRF

SEQ ID NO: 31017 - protein, 7 aa, Artificial Sequence
  Synthetic construct
WMIYTRY

SEQ ID NO: 31018 - protein, 7 aa, Artificial Sequence
  Synthetic construct
WMIYTCF

SEQ ID NO: 31019 - protein, 7 aa, Artificial Sequence
  Synthetic construct
WMIYTCY

SEQ ID NO: 31020 - protein, 7 aa, Artificial Sequence
  Synthetic construct
WMIYTLF

SEQ ID NO: 31021 - protein, 7 aa, Artificial Sequence
  Synthetic construct
WMIYTLY

SEQ ID NO: 31022 - protein, 7 aa, Artificial Sequence
  Synthetic construct
WMIYTAF

SEQ ID NO: 31023 - protein, 7 aa, Artificial Sequence
  Synthetic construct
WMIYTAY

SEQ ID NO: 31024 - protein, 7 aa, Artificial Sequence
  Synthetic construct
WMIYTQF

SEQ ID NO: 31025 - protein, 7 aa, Artificial Sequence
  Synthetic construct
WMIYTQY

SEQ ID NO: 31026 - protein, 7 aa, Artificial Sequence
  Synthetic construct
WMIYTDF

SEQ ID NO: 31027 - protein, 7 aa, Artificial Sequence
  Synthetic construct
WMIYTDY

SEQ ID NO: 31028 - protein, 7 aa, Artificial Sequence
  Synthetic construct
WMIYTVF

SEQ ID NO: 31029 - protein, 7 aa, Artificial Sequence
  Synthetic construct
WMIYTVY

SEQ ID NO: 31030 - protein, 7 aa, Artificial Sequence
  Synthetic construct
WMIYGFF

SEQ ID NO: 31031 - protein, 7 aa, Artificial Sequence
  Synthetic construct
WMIYGFY

SEQ ID NO: 31032 - protein, 7 aa, Artificial Sequence
  Synthetic construct
WMIYGRF

SEQ ID NO: 31033 - protein, 7 aa, Artificial Sequence
  Synthetic construct
WMIYGRY

SEQ ID NO: 31034 - protein, 7 aa, Artificial Sequence
  Synthetic construct
WMIYGCF

SEQ ID NO: 31035 - protein, 7 aa, Artificial Sequence
  Synthetic construct
WMIYGCY

SEQ ID NO: 31036 - protein, 7 aa, Artificial Sequence
  Synthetic construct
WMIYGLF

SEQ ID NO: 31037 - protein, 7 aa, Artificial Sequence
  Synthetic construct
WMIYGLY

SEQ ID NO: 31038 - protein, 7 aa, Artificial Sequence
  Synthetic construct
WMIYGAF

SEQ ID NO: 31039 - protein, 7 aa, Artificial Sequence
  Synthetic construct
WMIYGAY

SEQ ID NO: 31040 - protein, 7 aa, Artificial Sequence
  Synthetic construct
WMIYGQF

SEQ ID NO: 31041 - protein, 7 aa, Artificial Sequence
  Synthetic construct
WMIYGQY

SEQ ID NO: 31042 - protein, 7 aa, Artificial Sequence
  Synthetic construct
WMIYGDF

SEQ ID NO: 31043 - protein, 7 aa, Artificial Sequence
  Synthetic construct
WMIYGDY

SEQ ID NO: 31044 - protein, 7 aa, Artificial Sequence
  Synthetic construct
WMIYGVF

SEQ ID NO: 31045 - protein, 7 aa, Artificial Sequence
  Synthetic construct
WMIYGVY

SEQ ID NO: 31046 - protein, 7 aa, Artificial Sequence
  Synthetic construct
WMIYAFF

SEQ ID NO: 31047 - protein, 7 aa, Artificial Sequence
  Synthetic construct
WMIYAFY

SEQ ID NO: 31048 - protein, 7 aa, Artificial Sequence
  Synthetic construct
WMIYARF

SEQ ID NO: 31049 - protein, 7 aa, Artificial Sequence
  Synthetic construct
WMIYARY

SEQ ID NO: 31050 - protein, 7 aa, Artificial Sequence
  Synthetic construct
WMIYACF

SEQ ID NO: 31051 - protein, 7 aa, Artificial Sequence
  Synthetic construct
WMIYACY

SEQ ID NO: 31052 - protein, 7 aa, Artificial Sequence
  Synthetic construct
WMIYALF

SEQ ID NO: 31053 - protein, 7 aa, Artificial Sequence
  Synthetic construct
WMIYALY

SEQ ID NO: 31054 - protein, 7 aa, Artificial Sequence
  Synthetic construct
WMIYAAF

SEQ ID NO: 31055 - protein, 7 aa, Artificial Sequence
  Synthetic construct
WMIYAAY

SEQ ID NO: 31056 - protein, 7 aa, Artificial Sequence
  Synthetic construct
WMIYAQF

SEQ ID NO: 31057 - protein, 7 aa, Artificial Sequence
  Synthetic construct
WMIYAQY

SEQ ID NO: 31058 - protein, 7 aa, Artificial Sequence
  Synthetic construct
WMIYADF

SEQ ID NO: 31059 - protein, 7 aa, Artificial Sequence
  Synthetic construct
WMIYADY

SEQ ID NO: 31060 - protein, 7 aa, Artificial Sequence
  Synthetic construct
WMIYAVF

SEQ ID NO: 31061 - protein, 7 aa, Artificial Sequence
  Synthetic construct
WMIYAVY

SEQ ID NO: 31062 - protein, 7 aa, Artificial Sequence
  Synthetic construct
WMIYQFF

SEQ ID NO: 31063 - protein, 7 aa, Artificial Sequence
  Synthetic construct
WMIYQFY

SEQ ID NO: 31064 - protein, 7 aa, Artificial Sequence
  Synthetic construct
WMIYQRF

SEQ ID NO: 31065 - protein, 7 aa, Artificial Sequence
  Synthetic construct
WMIYQRY

SEQ ID NO: 31066 - protein, 7 aa, Artificial Sequence
  Synthetic construct
WMIYQCF

SEQ ID NO: 31067 - protein, 7 aa, Artificial Sequence
  Synthetic construct
WMIYQCY

SEQ ID NO: 31068 - protein, 7 aa, Artificial Sequence
  Synthetic construct
WMIYQLF

SEQ ID NO: 31069 - protein, 7 aa, Artificial Sequence
  Synthetic construct
WMIYQLY

SEQ ID NO: 31070 - protein, 7 aa, Artificial Sequence
  Synthetic construct
WMIYQAF

SEQ ID NO: 31071 - protein, 7 aa, Artificial Sequence
  Synthetic construct
WMIYQAY

SEQ ID NO: 31072 - protein, 7 aa, Artificial Sequence
  Synthetic construct
WMIYQQF

SEQ ID NO: 31073 - protein, 7 aa, Artificial Sequence
  Synthetic construct
WMIYQQY

SEQ ID NO: 31074 - protein, 7 aa, Artificial Sequence
  Synthetic construct
WMIYQDF

SEQ ID NO: 31075 - protein, 7 aa, Artificial Sequence
  Synthetic construct
WMIYQDY

SEQ ID NO: 31076 - protein, 7 aa, Artificial Sequence
  Synthetic construct
WMIYQVF

SEQ ID NO: 31077 - protein, 7 aa, Artificial Sequence
  Synthetic construct
WMIYQVY

SEQ ID NO: 31078 - protein, 7 aa, Artificial Sequence
  Synthetic construct
WMIPIFF

SEQ ID NO: 31079 - protein, 7 aa, Artificial Sequence
  Synthetic construct
WMIPIFY

SEQ ID NO: 31080 - protein, 7 aa, Artificial Sequence
  Synthetic construct
WMIPIRF

SEQ ID NO: 31081 - protein, 7 aa, Artificial Sequence
  Synthetic construct
WMIPIRY

SEQ ID NO: 31082 - protein, 7 aa, Artificial Sequence
  Synthetic construct
WMIPICF

SEQ ID NO: 31083 - protein, 7 aa, Artificial Sequence
  Synthetic construct
WMIPICY

SEQ ID NO: 31084 - protein, 7 aa, Artificial Sequence
  Synthetic construct
WMIPILF

SEQ ID NO: 31085 - protein, 7 aa, Artificial Sequence
  Synthetic construct
WMIPILY

SEQ ID NO: 31086 - protein, 7 aa, Artificial Sequence
  Synthetic construct
WMIPIAF

SEQ ID NO: 31087 - protein, 7 aa, Artificial Sequence
  Synthetic construct
WMIPIAY

SEQ ID NO: 31088 - protein, 7 aa, Artificial Sequence
  Synthetic construct
WMIPIQF

SEQ ID NO: 31089 - protein, 7 aa, Artificial Sequence
  Synthetic construct
WMIPIQY

SEQ ID NO: 31090 - protein, 7 aa, Artificial Sequence
  Synthetic construct
WMIPIDF

SEQ ID NO: 31091 - protein, 7 aa, Artificial Sequence
  Synthetic construct
WMIPIDY

SEQ ID NO: 31092 - protein, 7 aa, Artificial Sequence
  Synthetic construct
WMIPIVF

SEQ ID NO: 31093 - protein, 7 aa, Artificial Sequence
  Synthetic construct
WMIPIVY

SEQ ID NO: 31094 - protein, 7 aa, Artificial Sequence
  Synthetic construct
WMIPDFF

SEQ ID NO: 31095 - protein, 7 aa, Artificial Sequence
  Synthetic construct
WMIPDFY

SEQ ID NO: 31096 - protein, 7 aa, Artificial Sequence
  Synthetic construct
WMIPDRF

SEQ ID NO: 31097 - protein, 7 aa, Artificial Sequence
  Synthetic construct
WMIPDRY

SEQ ID NO: 31098 - protein, 7 aa, Artificial Sequence
  Synthetic construct
WMIPDCF

SEQ ID NO: 31099 - protein, 7 aa, Artificial Sequence
  Synthetic construct
WMIPDCY

SEQ ID NO: 31100 - protein, 7 aa, Artificial Sequence
  Synthetic construct
WMIPDLF

SEQ ID NO: 31101 - protein, 7 aa, Artificial Sequence
  Synthetic construct
WMIPDLY

SEQ ID NO: 31102 - protein, 7 aa, Artificial Sequence
  Synthetic construct
WMIPDAF

SEQ ID NO: 31103 - protein, 7 aa, Artificial Sequence
  Synthetic construct
WMIPDAY

SEQ ID NO: 31104 - protein, 7 aa, Artificial Sequence
  Synthetic construct
WMIPDQF

SEQ ID NO: 31105 - protein, 7 aa, Artificial Sequence
  Synthetic construct
WMIPDQY

SEQ ID NO: 31106 - protein, 7 aa, Artificial Sequence
  Synthetic construct
WMIPDDF

SEQ ID NO: 31107 - protein, 7 aa, Artificial Sequence
  Synthetic construct
WMIPDDY

SEQ ID NO: 31108 - protein, 7 aa, Artificial Sequence
  Synthetic construct
WMIPDVF

SEQ ID NO: 31109 - protein, 7 aa, Artificial Sequence
  Synthetic construct
WMIPDVY

SEQ ID NO: 31110 - protein, 7 aa, Artificial Sequence
  Synthetic construct
WMIPYFF

SEQ ID NO: 31111 - protein, 7 aa, Artificial Sequence
  Synthetic construct
WMIPYFY

SEQ ID NO: 31112 - protein, 7 aa, Artificial Sequence
  Synthetic construct
WMIPYRF

SEQ ID NO: 31113 - protein, 7 aa, Artificial Sequence
  Synthetic construct
WMIPYRY

SEQ ID NO: 31114 - protein, 7 aa, Artificial Sequence
  Synthetic construct
WMIPYCF

SEQ ID NO: 31115 - protein, 7 aa, Artificial Sequence
  Synthetic construct
WMIPYCY

SEQ ID NO: 31116 - protein, 7 aa, Artificial Sequence
  Synthetic construct
WMIPYLF

SEQ ID NO: 31117 - protein, 7 aa, Artificial Sequence
  Synthetic construct
WMIPYLY

SEQ ID NO: 31118 - protein, 7 aa, Artificial Sequence
  Synthetic construct
WMIPYAF

SEQ ID NO: 31119 - protein, 7 aa, Artificial Sequence
  Synthetic construct
WMIPYAY

SEQ ID NO: 31120 - protein, 7 aa, Artificial Sequence
  Synthetic construct
WMIPYQF

SEQ ID NO: 31121 - protein, 7 aa, Artificial Sequence
  Synthetic construct
WMIPYQY

SEQ ID NO: 31122 - protein, 7 aa, Artificial Sequence
  Synthetic construct
WMIPYDF

SEQ ID NO: 31123 - protein, 7 aa, Artificial Sequence
  Synthetic construct
WMIPYDY

SEQ ID NO: 31124 - protein, 7 aa, Artificial Sequence
  Synthetic construct
WMIPYVF

SEQ ID NO: 31125 - protein, 7 aa, Artificial Sequence
  Synthetic construct
WMIPYVY

SEQ ID NO: 31126 - protein, 7 aa, Artificial Sequence
  Synthetic construct
WMIPFFF

SEQ ID NO: 31127 - protein, 7 aa, Artificial Sequence
  Synthetic construct
WMIPFFY

SEQ ID NO: 31128 - protein, 7 aa, Artificial Sequence
  Synthetic construct
WMIPFRF

SEQ ID NO: 31129 - protein, 7 aa, Artificial Sequence
  Synthetic construct
WMIPFRY

SEQ ID NO: 31130 - protein, 7 aa, Artificial Sequence
  Synthetic construct
WMIPFCF

SEQ ID NO: 31131 - protein, 7 aa, Artificial Sequence
  Synthetic construct
WMIPFCY

SEQ ID NO: 31132 - protein, 7 aa, Artificial Sequence
  Synthetic construct
WMIPFLF

SEQ ID NO: 31133 - protein, 7 aa, Artificial Sequence
  Synthetic construct
WMIPFLY

SEQ ID NO: 31134 - protein, 7 aa, Artificial Sequence
  Synthetic construct
WMIPFAF

SEQ ID NO: 31135 - protein, 7 aa, Artificial Sequence
  Synthetic construct
WMIPFAY

SEQ ID NO: 31136 - protein, 7 aa, Artificial Sequence
  Synthetic construct
WMIPFQF

SEQ ID NO: 31137 - protein, 7 aa, Artificial Sequence
  Synthetic construct
WMIPFQY

SEQ ID NO: 31138 - protein, 7 aa, Artificial Sequence
  Synthetic construct
WMIPFDF

SEQ ID NO: 31139 - protein, 7 aa, Artificial Sequence
  Synthetic construct
WMIPFDY

SEQ ID NO: 31140 - protein, 7 aa, Artificial Sequence
  Synthetic construct
WMIPFVF

SEQ ID NO: 31141 - protein, 7 aa, Artificial Sequence
  Synthetic construct
WMIPFVY

SEQ ID NO: 31142 - protein, 7 aa, Artificial Sequence
  Synthetic construct
WMIPVFF

SEQ ID NO: 31143 - protein, 7 aa, Artificial Sequence
  Synthetic construct
WMIPVFY

SEQ ID NO: 31144 - protein, 7 aa, Artificial Sequence
  Synthetic construct
WMIPVRF

SEQ ID NO: 31145 - protein, 7 aa, Artificial Sequence
  Synthetic construct
WMIPVRY

SEQ ID NO: 31146 - protein, 7 aa, Artificial Sequence
  Synthetic construct
WMIPVCF

SEQ ID NO: 31147 - protein, 7 aa, Artificial Sequence
  Synthetic construct
WMIPVCY

SEQ ID NO: 31148 - protein, 7 aa, Artificial Sequence
  Synthetic construct
WMIPVLF

SEQ ID NO: 31149 - protein, 7 aa, Artificial Sequence
  Synthetic construct
WMIPVLY

SEQ ID NO: 31150 - protein, 7 aa, Artificial Sequence
  Synthetic construct
WMIPVAF

SEQ ID NO: 31151 - protein, 7 aa, Artificial Sequence
  Synthetic construct
WMIPVAY

SEQ ID NO: 31152 - protein, 7 aa, Artificial Sequence
  Synthetic construct
WMIPVQF

SEQ ID NO: 31153 - protein, 7 aa, Artificial Sequence
  Synthetic construct
WMIPVQY

SEQ ID NO: 31154 - protein, 7 aa, Artificial Sequence
  Synthetic construct
WMIPVDF

SEQ ID NO: 31155 - protein, 7 aa, Artificial Sequence
  Synthetic construct
WMIPVDY

SEQ ID NO: 31156 - protein, 7 aa, Artificial Sequence
  Synthetic construct
WMIPVVF

SEQ ID NO: 31157 - protein, 7 aa, Artificial Sequence
  Synthetic construct
WMIPVVY

SEQ ID NO: 31158 - protein, 7 aa, Artificial Sequence
  Synthetic construct
WMIPTFF

SEQ ID NO: 31159 - protein, 7 aa, Artificial Sequence
  Synthetic construct
WMIPTFY

SEQ ID NO: 31160 - protein, 7 aa, Artificial Sequence
  Synthetic construct
WMIPTRF

SEQ ID NO: 31161 - protein, 7 aa, Artificial Sequence
  Synthetic construct
WMIPTRY

SEQ ID NO: 31162 - protein, 7 aa, Artificial Sequence
  Synthetic construct
WMIPTCF

SEQ ID NO: 31163 - protein, 7 aa, Artificial Sequence
  Synthetic construct
WMIPTCY

SEQ ID NO: 31164 - protein, 7 aa, Artificial Sequence
  Synthetic construct
WMIPTLF

SEQ ID NO: 31165 - protein, 7 aa, Artificial Sequence
  Synthetic construct
WMIPTLY

SEQ ID NO: 31166 - protein, 7 aa, Artificial Sequence
  Synthetic construct
WMIPTAF

SEQ ID NO: 31167 - protein, 7 aa, Artificial Sequence
  Synthetic construct
WMIPTAY

SEQ ID NO: 31168 - protein, 7 aa, Artificial Sequence
  Synthetic construct
WMIPTQF

SEQ ID NO: 31169 - protein, 7 aa, Artificial Sequence
  Synthetic construct
WMIPTQY

SEQ ID NO: 31170 - protein, 7 aa, Artificial Sequence
  Synthetic construct
WMIPTDF

SEQ ID NO: 31171 - protein, 7 aa, Artificial Sequence
  Synthetic construct
WMIPTDY

SEQ ID NO: 31172 - protein, 7 aa, Artificial Sequence
  Synthetic construct
WMIPTVF

SEQ ID NO: 31173 - protein, 7 aa, Artificial Sequence
  Synthetic construct
WMIPTVY

SEQ ID NO: 31174 - protein, 7 aa, Artificial Sequence
  Synthetic construct
WMIPGFF

SEQ ID NO: 31175 - protein, 7 aa, Artificial Sequence
  Synthetic construct
WMIPGFY

SEQ ID NO: 31176 - protein, 7 aa, Artificial Sequence
  Synthetic construct
WMIPGRF

SEQ ID NO: 31177 - protein, 7 aa, Artificial Sequence
  Synthetic construct
WMIPGRY

SEQ ID NO: 31178 - protein, 7 aa, Artificial Sequence
  Synthetic construct
WMIPGCF

SEQ ID NO: 31179 - protein, 7 aa, Artificial Sequence
  Synthetic construct
WMIPGCY

SEQ ID NO: 31180 - protein, 7 aa, Artificial Sequence
  Synthetic construct
WMIPGLF

SEQ ID NO: 31181 - protein, 7 aa, Artificial Sequence
  Synthetic construct
WMIPGLY

SEQ ID NO: 31182 - protein, 7 aa, Artificial Sequence
  Synthetic construct
WMIPGAF

SEQ ID NO: 31183 - protein, 7 aa, Artificial Sequence
  Synthetic construct
WMIPGAY

SEQ ID NO: 31184 - protein, 7 aa, Artificial Sequence
  Synthetic construct
WMIPGQF

SEQ ID NO: 31185 - protein, 7 aa, Artificial Sequence
  Synthetic construct
WMIPGQY

SEQ ID NO: 31186 - protein, 7 aa, Artificial Sequence
  Synthetic construct
WMIPGDF

SEQ ID NO: 31187 - protein, 7 aa, Artificial Sequence
  Synthetic construct
WMIPGDY

SEQ ID NO: 31188 - protein, 7 aa, Artificial Sequence
  Synthetic construct
WMIPGVF

SEQ ID NO: 31189 - protein, 7 aa, Artificial Sequence
  Synthetic construct
WMIPGVY

SEQ ID NO: 31190 - protein, 7 aa, Artificial Sequence
  Synthetic construct
WMIPAFF

SEQ ID NO: 31191 - protein, 7 aa, Artificial Sequence
  Synthetic construct
WMIPAFY

SEQ ID NO: 31192 - protein, 7 aa, Artificial Sequence
  Synthetic construct
WMIPARF

SEQ ID NO: 31193 - protein, 7 aa, Artificial Sequence
  Synthetic construct
WMIPARY

SEQ ID NO: 31194 - protein, 7 aa, Artificial Sequence
  Synthetic construct
WMIPACF

SEQ ID NO: 31195 - protein, 7 aa, Artificial Sequence
  Synthetic construct
WMIPACY

SEQ ID NO: 31196 - protein, 7 aa, Artificial Sequence
  Synthetic construct
WMIPALF

SEQ ID NO: 31197 - protein, 7 aa, Artificial Sequence
  Synthetic construct
WMIPALY

SEQ ID NO: 31198 - protein, 7 aa, Artificial Sequence
  Synthetic construct
WMIPAAF

SEQ ID NO: 31199 - protein, 7 aa, Artificial Sequence
  Synthetic construct
WMIPAAY

SEQ ID NO: 31200 - protein, 7 aa, Artificial Sequence
  Synthetic construct
WMIPAQF

SEQ ID NO: 31201 - protein, 7 aa, Artificial Sequence
  Synthetic construct
WMIPAQY

SEQ ID NO: 31202 - protein, 7 aa, Artificial Sequence
  Synthetic construct
WMIPADF

SEQ ID NO: 31203 - protein, 7 aa, Artificial Sequence
  Synthetic construct
WMIPADY

SEQ ID NO: 31204 - protein, 7 aa, Artificial Sequence
  Synthetic construct
WMIPAVF

SEQ ID NO: 31205 - protein, 7 aa, Artificial Sequence
  Synthetic construct
WMIPAVY

SEQ ID NO: 31206 - protein, 7 aa, Artificial Sequence
  Synthetic construct
WMIPQFF

SEQ ID NO: 31207 - protein, 7 aa, Artificial Sequence
  Synthetic construct
WMIPQFY

SEQ ID NO: 31208 - protein, 7 aa, Artificial Sequence
  Synthetic construct
WMIPQRF

SEQ ID NO: 31209 - protein, 7 aa, Artificial Sequence
  Synthetic construct
WMIPQRY

SEQ ID NO: 31210 - protein, 7 aa, Artificial Sequence
  Synthetic construct
WMIPQCF

SEQ ID NO: 31211 - protein, 7 aa, Artificial Sequence
  Synthetic construct
WMIPQCY

SEQ ID NO: 31212 - protein, 7 aa, Artificial Sequence
  Synthetic construct
WMIPQLF

SEQ ID NO: 31213 - protein, 7 aa, Artificial Sequence
  Synthetic construct
WMIPQLY

SEQ ID NO: 31214 - protein, 7 aa, Artificial Sequence
  Synthetic construct
WMIPQAF

SEQ ID NO: 31215 - protein, 7 aa, Artificial Sequence
  Synthetic construct
WMIPQAY

SEQ ID NO: 31216 - protein, 7 aa, Artificial Sequence
  Synthetic construct
WMIPQQF

SEQ ID NO: 31217 - protein, 7 aa, Artificial Sequence
  Synthetic construct
WMIPQQY

SEQ ID NO: 31218 - protein, 7 aa, Artificial Sequence
  Synthetic construct
WMIPQDF

SEQ ID NO: 31219 - protein, 7 aa, Artificial Sequence
  Synthetic construct
WMIPQDY

SEQ ID NO: 31220 - protein, 7 aa, Artificial Sequence
  Synthetic construct
WMIPQVF

SEQ ID NO: 31221 - protein, 7 aa, Artificial Sequence
  Synthetic construct
WMIPQVY

SEQ ID NO: 31222 - protein, 7 aa, Artificial Sequence
  Synthetic construct
WMIHIFF

SEQ ID NO: 31223 - protein, 7 aa, Artificial Sequence
  Synthetic construct
WMIHIFY

SEQ ID NO: 31224 - protein, 7 aa, Artificial Sequence
  Synthetic construct
WMIHIRF

SEQ ID NO: 31225 - protein, 7 aa, Artificial Sequence
  Synthetic construct
WMIHIRY

SEQ ID NO: 31226 - protein, 7 aa, Artificial Sequence
  Synthetic construct
WMIHICF

SEQ ID NO: 31227 - protein, 7 aa, Artificial Sequence
  Synthetic construct
WMIHICY

SEQ ID NO: 31228 - protein, 7 aa, Artificial Sequence
  Synthetic construct
WMIHILF

SEQ ID NO: 31229 - protein, 7 aa, Artificial Sequence
  Synthetic construct
WMIHILY

SEQ ID NO: 31230 - protein, 7 aa, Artificial Sequence
  Synthetic construct
WMIHIAF

SEQ ID NO: 31231 - protein, 7 aa, Artificial Sequence
  Synthetic construct
WMIHIAY

SEQ ID NO: 31232 - protein, 7 aa, Artificial Sequence
  Synthetic construct
WMIHIQF

SEQ ID NO: 31233 - protein, 7 aa, Artificial Sequence
  Synthetic construct
WMIHIQY

SEQ ID NO: 31234 - protein, 7 aa, Artificial Sequence
  Synthetic construct
WMIHIDF

SEQ ID NO: 31235 - protein, 7 aa, Artificial Sequence
  Synthetic construct
WMIHIDY

SEQ ID NO: 31236 - protein, 7 aa, Artificial Sequence
  Synthetic construct
WMIHIVF

SEQ ID NO: 31237 - protein, 7 aa, Artificial Sequence
  Synthetic construct
WMIHIVY

SEQ ID NO: 31238 - protein, 7 aa, Artificial Sequence
  Synthetic construct
WMIHDFF

SEQ ID NO: 31239 - protein, 7 aa, Artificial Sequence
  Synthetic construct
WMIHDFY

SEQ ID NO: 31240 - protein, 7 aa, Artificial Sequence
  Synthetic construct
WMIHDRF

SEQ ID NO: 31241 - protein, 7 aa, Artificial Sequence
  Synthetic construct
WMIHDRY

SEQ ID NO: 31242 - protein, 7 aa, Artificial Sequence
  Synthetic construct
WMIHDCF

SEQ ID NO: 31243 - protein, 7 aa, Artificial Sequence
  Synthetic construct
WMIHDCY

SEQ ID NO: 31244 - protein, 7 aa, Artificial Sequence
  Synthetic construct
WMIHDLF

SEQ ID NO: 31245 - protein, 7 aa, Artificial Sequence
  Synthetic construct
WMIHDLY

SEQ ID NO: 31246 - protein, 7 aa, Artificial Sequence
  Synthetic construct
WMIHDAF

SEQ ID NO: 31247 - protein, 7 aa, Artificial Sequence
  Synthetic construct
WMIHDAY

SEQ ID NO: 31248 - protein, 7 aa, Artificial Sequence
  Synthetic construct
WMIHDQF

SEQ ID NO: 31249 - protein, 7 aa, Artificial Sequence
  Synthetic construct
WMIHDQY

SEQ ID NO: 31250 - protein, 7 aa, Artificial Sequence
  Synthetic construct
WMIHDDF

SEQ ID NO: 31251 - protein, 7 aa, Artificial Sequence
  Synthetic construct
WMIHDDY

SEQ ID NO: 31252 - protein, 7 aa, Artificial Sequence
  Synthetic construct
WMIHDVF

SEQ ID NO: 31253 - protein, 7 aa, Artificial Sequence
  Synthetic construct
WMIHDVY

SEQ ID NO: 31254 - protein, 7 aa, Artificial Sequence
  Synthetic construct
WMIHYFF

SEQ ID NO: 31255 - protein, 7 aa, Artificial Sequence
  Synthetic construct
WMIHYFY

SEQ ID NO: 31256 - protein, 7 aa, Artificial Sequence
  Synthetic construct
WMIHYRF

SEQ ID NO: 31257 - protein, 7 aa, Artificial Sequence
  Synthetic construct
WMIHYRY

SEQ ID NO: 31258 - protein, 7 aa, Artificial Sequence
  Synthetic construct
WMIHYCF

SEQ ID NO: 31259 - protein, 7 aa, Artificial Sequence
  Synthetic construct
WMIHYCY

SEQ ID NO: 31260 - protein, 7 aa, Artificial Sequence
  Synthetic construct
WMIHYLF

SEQ ID NO: 31261 - protein, 7 aa, Artificial Sequence
  Synthetic construct
WMIHYLY

SEQ ID NO: 31262 - protein, 7 aa, Artificial Sequence
  Synthetic construct
WMIHYAF

SEQ ID NO: 31263 - protein, 7 aa, Artificial Sequence
  Synthetic construct
WMIHYAY

SEQ ID NO: 31264 - protein, 7 aa, Artificial Sequence
  Synthetic construct
WMIHYQF

SEQ ID NO: 31265 - protein, 7 aa, Artificial Sequence
  Synthetic construct
WMIHYQY

SEQ ID NO: 31266 - protein, 7 aa, Artificial Sequence
  Synthetic construct
WMIHYDF

SEQ ID NO: 31267 - protein, 7 aa, Artificial Sequence
  Synthetic construct
WMIHYDY

SEQ ID NO: 31268 - protein, 7 aa, Artificial Sequence
  Synthetic construct
WMIHYVF

SEQ ID NO: 31269 - protein, 7 aa, Artificial Sequence
  Synthetic construct
WMIHYVY

SEQ ID NO: 31270 - protein, 7 aa, Artificial Sequence
  Synthetic construct
WMIHFFF

SEQ ID NO: 31271 - protein, 7 aa, Artificial Sequence
  Synthetic construct
WMIHFFY

SEQ ID NO: 31272 - protein, 7 aa, Artificial Sequence
  Synthetic construct
WMIHFRF

SEQ ID NO: 31273 - protein, 7 aa, Artificial Sequence
  Synthetic construct
WMIHFRY

SEQ ID NO: 31274 - protein, 7 aa, Artificial Sequence
  Synthetic construct
WMIHFCF

SEQ ID NO: 31275 - protein, 7 aa, Artificial Sequence
  Synthetic construct
WMIHFCY

SEQ ID NO: 31276 - protein, 7 aa, Artificial Sequence
  Synthetic construct
WMIHFLF

SEQ ID NO: 31277 - protein, 7 aa, Artificial Sequence
  Synthetic construct
WMIHFLY

SEQ ID NO: 31278 - protein, 7 aa, Artificial Sequence
  Synthetic construct
WMIHFAF

SEQ ID NO: 31279 - protein, 7 aa, Artificial Sequence
  Synthetic construct
WMIHFAY

SEQ ID NO: 31280 - protein, 7 aa, Artificial Sequence
  Synthetic construct
WMIHFQF

SEQ ID NO: 31281 - protein, 7 aa, Artificial Sequence
  Synthetic construct
WMIHFQY

SEQ ID NO: 31282 - protein, 7 aa, Artificial Sequence
  Synthetic construct
WMIHFDF

SEQ ID NO: 31283 - protein, 7 aa, Artificial Sequence
  Synthetic construct
WMIHFDY

SEQ ID NO: 31284 - protein, 7 aa, Artificial Sequence
  Synthetic construct
WMIHFVF

SEQ ID NO: 31285 - protein, 7 aa, Artificial Sequence
  Synthetic construct
WMIHFVY

SEQ ID NO: 31286 - protein, 7 aa, Artificial Sequence
  Synthetic construct
WMIHVFF

SEQ ID NO: 31287 - protein, 7 aa, Artificial Sequence
  Synthetic construct
WMIHVFY

SEQ ID NO: 31288 - protein, 7 aa, Artificial Sequence
  Synthetic construct
WMIHVRF

SEQ ID NO: 31289 - protein, 7 aa, Artificial Sequence
  Synthetic construct
WMIHVRY

SEQ ID NO: 31290 - protein, 7 aa, Artificial Sequence
  Synthetic construct
WMIHVCF

SEQ ID NO: 31291 - protein, 7 aa, Artificial Sequence
  Synthetic construct
WMIHVCY

SEQ ID NO: 31292 - protein, 7 aa, Artificial Sequence
  Synthetic construct
WMIHVLF

SEQ ID NO: 31293 - protein, 7 aa, Artificial Sequence
  Synthetic construct
WMIHVLY

SEQ ID NO: 31294 - protein, 7 aa, Artificial Sequence
  Synthetic construct
WMIHVAF

SEQ ID NO: 31295 - protein, 7 aa, Artificial Sequence
  Synthetic construct
WMIHVAY

SEQ ID NO: 31296 - protein, 7 aa, Artificial Sequence
  Synthetic construct
WMIHVQF

SEQ ID NO: 31297 - protein, 7 aa, Artificial Sequence
  Synthetic construct
WMIHVQY

SEQ ID NO: 31298 - protein, 7 aa, Artificial Sequence
  Synthetic construct
WMIHVDF

SEQ ID NO: 31299 - protein, 7 aa, Artificial Sequence
  Synthetic construct
WMIHVDY

SEQ ID NO: 31300 - protein, 7 aa, Artificial Sequence
  Synthetic construct
WMIHVVF

SEQ ID NO: 31301 - protein, 7 aa, Artificial Sequence
  Synthetic construct
WMIHVVY

SEQ ID NO: 31302 - protein, 7 aa, Artificial Sequence
  Synthetic construct
WMIHTFF

SEQ ID NO: 31303 - protein, 7 aa, Artificial Sequence
  Synthetic construct
WMIHTFY

SEQ ID NO: 31304 - protein, 7 aa, Artificial Sequence
  Synthetic construct
WMIHTRF

SEQ ID NO: 31305 - protein, 7 aa, Artificial Sequence
  Synthetic construct
WMIHTRY

SEQ ID NO: 31306 - protein, 7 aa, Artificial Sequence
  Synthetic construct
WMIHTCF

SEQ ID NO: 31307 - protein, 7 aa, Artificial Sequence
  Synthetic construct
WMIHTCY

SEQ ID NO: 31308 - protein, 7 aa, Artificial Sequence
  Synthetic construct
WMIHTLF

SEQ ID NO: 31309 - protein, 7 aa, Artificial Sequence
  Synthetic construct
WMIHTLY

SEQ ID NO: 31310 - protein, 7 aa, Artificial Sequence
  Synthetic construct
WMIHTAF

SEQ ID NO: 31311 - protein, 7 aa, Artificial Sequence
  Synthetic construct
WMIHTAY

SEQ ID NO: 31312 - protein, 7 aa, Artificial Sequence
  Synthetic construct
WMIHTQF

SEQ ID NO: 31313 - protein, 7 aa, Artificial Sequence
  Synthetic construct
WMIHTQY

SEQ ID NO: 31314 - protein, 7 aa, Artificial Sequence
  Synthetic construct
WMIHTDF

SEQ ID NO: 31315 - protein, 7 aa, Artificial Sequence
  Synthetic construct
WMIHTDY

SEQ ID NO: 31316 - protein, 7 aa, Artificial Sequence
  Synthetic construct
WMIHTVF

SEQ ID NO: 31317 - protein, 7 aa, Artificial Sequence
  Synthetic construct
WMIHTVY

SEQ ID NO: 31318 - protein, 7 aa, Artificial Sequence
  Synthetic construct
WMIHGFF

SEQ ID NO: 31319 - protein, 7 aa, Artificial Sequence
  Synthetic construct
WMIHGFY

SEQ ID NO: 31320 - protein, 7 aa, Artificial Sequence
  Synthetic construct
WMIHGRF

SEQ ID NO: 31321 - protein, 7 aa, Artificial Sequence
  Synthetic construct
WMIHGRY

SEQ ID NO: 31322 - protein, 7 aa, Artificial Sequence
  Synthetic construct
WMIHGCF

SEQ ID NO: 31323 - protein, 7 aa, Artificial Sequence
  Synthetic construct
WMIHGCY

SEQ ID NO: 31324 - protein, 7 aa, Artificial Sequence
  Synthetic construct
WMIHGLF

SEQ ID NO: 31325 - protein, 7 aa, Artificial Sequence
  Synthetic construct
WMIHGLY

SEQ ID NO: 31326 - protein, 7 aa, Artificial Sequence
  Synthetic construct
WMIHGAF

SEQ ID NO: 31327 - protein, 7 aa, Artificial Sequence
  Synthetic construct
WMIHGAY

SEQ ID NO: 31328 - protein, 7 aa, Artificial Sequence
  Synthetic construct
WMIHGQF

SEQ ID NO: 31329 - protein, 7 aa, Artificial Sequence
  Synthetic construct
WMIHGQY

SEQ ID NO: 31330 - protein, 7 aa, Artificial Sequence
  Synthetic construct
WMIHGDF

SEQ ID NO: 31331 - protein, 7 aa, Artificial Sequence
  Synthetic construct
WMIHGDY

SEQ ID NO: 31332 - protein, 7 aa, Artificial Sequence
  Synthetic construct
WMIHGVF

SEQ ID NO: 31333 - protein, 7 aa, Artificial Sequence
  Synthetic construct
WMIHGVY

SEQ ID NO: 31334 - protein, 7 aa, Artificial Sequence
  Synthetic construct
WMIHAFF

SEQ ID NO: 31335 - protein, 7 aa, Artificial Sequence
  Synthetic construct
WMIHAFY

SEQ ID NO: 31336 - protein, 7 aa, Artificial Sequence
  Synthetic construct
WMIHARF

SEQ ID NO: 31337 - protein, 7 aa, Artificial Sequence
  Synthetic construct
WMIHARY

SEQ ID NO: 31338 - protein, 7 aa, Artificial Sequence
  Synthetic construct
WMIHACF

SEQ ID NO: 31339 - protein, 7 aa, Artificial Sequence
  Synthetic construct
WMIHACY

SEQ ID NO: 31340 - protein, 7 aa, Artificial Sequence
  Synthetic construct
WMIHALF

SEQ ID NO: 31341 - protein, 7 aa, Artificial Sequence
  Synthetic construct
WMIHALY

SEQ ID NO: 31342 - protein, 7 aa, Artificial Sequence
  Synthetic construct
WMIHAAF

SEQ ID NO: 31343 - protein, 7 aa, Artificial Sequence
  Synthetic construct
WMIHAAY

SEQ ID NO: 31344 - protein, 7 aa, Artificial Sequence
  Synthetic construct
WMIHAQF

SEQ ID NO: 31345 - protein, 7 aa, Artificial Sequence
  Synthetic construct
WMIHAQY

SEQ ID NO: 31346 - protein, 7 aa, Artificial Sequence
  Synthetic construct
WMIHADF

SEQ ID NO: 31347 - protein, 7 aa, Artificial Sequence
  Synthetic construct
WMIHADY

SEQ ID NO: 31348 - protein, 7 aa, Artificial Sequence
  Synthetic construct
WMIHAVF

SEQ ID NO: 31349 - protein, 7 aa, Artificial Sequence
  Synthetic construct
WMIHAVY

SEQ ID NO: 31350 - protein, 7 aa, Artificial Sequence
  Synthetic construct
WMIHQFF

SEQ ID NO: 31351 - protein, 7 aa, Artificial Sequence
  Synthetic construct
WMIHQFY

SEQ ID NO: 31352 - protein, 7 aa, Artificial Sequence
  Synthetic construct
WMIHQRF

SEQ ID NO: 31353 - protein, 7 aa, Artificial Sequence
  Synthetic construct
WMIHQRY

SEQ ID NO: 31354 - protein, 7 aa, Artificial Sequence
  Synthetic construct
WMIHQCF

SEQ ID NO: 31355 - protein, 7 aa, Artificial Sequence
  Synthetic construct
WMIHQCY

SEQ ID NO: 31356 - protein, 7 aa, Artificial Sequence
  Synthetic construct
WMIHQLF

SEQ ID NO: 31357 - protein, 7 aa, Artificial Sequence
  Synthetic construct
WMIHQLY

SEQ ID NO: 31358 - protein, 7 aa, Artificial Sequence
  Synthetic construct
WMIHQAF

SEQ ID NO: 31359 - protein, 7 aa, Artificial Sequence
  Synthetic construct
WMIHQAY

SEQ ID NO: 31360 - protein, 7 aa, Artificial Sequence
  Synthetic construct
WMIHQQF

SEQ ID NO: 31361 - protein, 7 aa, Artificial Sequence
  Synthetic construct
WMIHQQY

SEQ ID NO: 31362 - protein, 7 aa, Artificial Sequence
  Synthetic construct
WMIHQDF

SEQ ID NO: 31363 - protein, 7 aa, Artificial Sequence
  Synthetic construct
WMIHQDY

SEQ ID NO: 31364 - protein, 7 aa, Artificial Sequence
  Synthetic construct
WMIHQVF

SEQ ID NO: 31365 - protein, 7 aa, Artificial Sequence
  Synthetic construct
WMIHQVY

SEQ ID NO: 31366 - protein, 7 aa, Artificial Sequence
  Synthetic construct
WMILIFF

SEQ ID NO: 31367 - protein, 7 aa, Artificial Sequence
  Synthetic construct
WMILIFY

SEQ ID NO: 31368 - protein, 7 aa, Artificial Sequence
  Synthetic construct
WMILIRF

SEQ ID NO: 31369 - protein, 7 aa, Artificial Sequence
  Synthetic construct
WMILIRY

SEQ ID NO: 31370 - protein, 7 aa, Artificial Sequence
  Synthetic construct
WMILICF

SEQ ID NO: 31371 - protein, 7 aa, Artificial Sequence
  Synthetic construct
WMILICY

SEQ ID NO: 31372 - protein, 7 aa, Artificial Sequence
  Synthetic construct
WMILILF

SEQ ID NO: 31373 - protein, 7 aa, Artificial Sequence
  Synthetic construct
WMILILY

SEQ ID NO: 31374 - protein, 7 aa, Artificial Sequence
  Synthetic construct
WMILIAF

SEQ ID NO: 31375 - protein, 7 aa, Artificial Sequence
  Synthetic construct
WMILIAY

SEQ ID NO: 31376 - protein, 7 aa, Artificial Sequence
  Synthetic construct
WMILIQF

SEQ ID NO: 31377 - protein, 7 aa, Artificial Sequence
  Synthetic construct
WMILIQY

SEQ ID NO: 31378 - protein, 7 aa, Artificial Sequence
  Synthetic construct
WMILIDF

SEQ ID NO: 31379 - protein, 7 aa, Artificial Sequence
  Synthetic construct
WMILIDY

SEQ ID NO: 31380 - protein, 7 aa, Artificial Sequence
  Synthetic construct
WMILIVF

SEQ ID NO: 31381 - protein, 7 aa, Artificial Sequence
  Synthetic construct
WMILIVY

SEQ ID NO: 31382 - protein, 7 aa, Artificial Sequence
  Synthetic construct
WMILDFF

SEQ ID NO: 31383 - protein, 7 aa, Artificial Sequence
  Synthetic construct
WMILDFY

SEQ ID NO: 31384 - protein, 7 aa, Artificial Sequence
  Synthetic construct
WMILDRF

SEQ ID NO: 31385 - protein, 7 aa, Artificial Sequence
  Synthetic construct
WMILDRY

SEQ ID NO: 31386 - protein, 7 aa, Artificial Sequence
  Synthetic construct
WMILDCF

SEQ ID NO: 31387 - protein, 7 aa, Artificial Sequence
  Synthetic construct
WMILDCY

SEQ ID NO: 31388 - protein, 7 aa, Artificial Sequence
  Synthetic construct
WMILDLF

SEQ ID NO: 31389 - protein, 7 aa, Artificial Sequence
  Synthetic construct
WMILDLY

SEQ ID NO: 31390 - protein, 7 aa, Artificial Sequence
  Synthetic construct
WMILDAF

SEQ ID NO: 31391 - protein, 7 aa, Artificial Sequence
  Synthetic construct
WMILDAY

SEQ ID NO: 31392 - protein, 7 aa, Artificial Sequence
  Synthetic construct
WMILDQF

SEQ ID NO: 31393 - protein, 7 aa, Artificial Sequence
  Synthetic construct
WMILDQY

SEQ ID NO: 31394 - protein, 7 aa, Artificial Sequence
  Synthetic construct
WMILDDF

SEQ ID NO: 31395 - protein, 7 aa, Artificial Sequence
  Synthetic construct
WMILDDY

SEQ ID NO: 31396 - protein, 7 aa, Artificial Sequence
  Synthetic construct
WMILDVF

SEQ ID NO: 31397 - protein, 7 aa, Artificial Sequence
  Synthetic construct
WMILDVY

SEQ ID NO: 31398 - protein, 7 aa, Artificial Sequence
  Synthetic construct
WMILYFF

SEQ ID NO: 31399 - protein, 7 aa, Artificial Sequence
  Synthetic construct
WMILYFY

SEQ ID NO: 31400 - protein, 7 aa, Artificial Sequence
  Synthetic construct
WMILYRF

SEQ ID NO: 31401 - protein, 7 aa, Artificial Sequence
  Synthetic construct
WMILYRY

SEQ ID NO: 31402 - protein, 7 aa, Artificial Sequence
  Synthetic construct
WMILYCF

SEQ ID NO: 31403 - protein, 7 aa, Artificial Sequence
  Synthetic construct
WMILYCY

SEQ ID NO: 31404 - protein, 7 aa, Artificial Sequence
  Synthetic construct
WMILYLF

SEQ ID NO: 31405 - protein, 7 aa, Artificial Sequence
  Synthetic construct
WMILYLY

SEQ ID NO: 31406 - protein, 7 aa, Artificial Sequence
  Synthetic construct
WMILYAF

SEQ ID NO: 31407 - protein, 7 aa, Artificial Sequence
  Synthetic construct
WMILYAY

SEQ ID NO: 31408 - protein, 7 aa, Artificial Sequence
  Synthetic construct
WMILYQF

SEQ ID NO: 31409 - protein, 7 aa, Artificial Sequence
  Synthetic construct
WMILYQY

SEQ ID NO: 31410 - protein, 7 aa, Artificial Sequence
  Synthetic construct
WMILYDF

SEQ ID NO: 31411 - protein, 7 aa, Artificial Sequence
  Synthetic construct
WMILYDY

SEQ ID NO: 31412 - protein, 7 aa, Artificial Sequence
  Synthetic construct
WMILYVF

SEQ ID NO: 31413 - protein, 7 aa, Artificial Sequence
  Synthetic construct
WMILYVY

SEQ ID NO: 31414 - protein, 7 aa, Artificial Sequence
  Synthetic construct
WMILFFF

SEQ ID NO: 31415 - protein, 7 aa, Artificial Sequence
  Synthetic construct
WMILFFY

SEQ ID NO: 31416 - protein, 7 aa, Artificial Sequence
  Synthetic construct
WMILFRF

SEQ ID NO: 31417 - protein, 7 aa, Artificial Sequence
  Synthetic construct
WMILFRY

SEQ ID NO: 31418 - protein, 7 aa, Artificial Sequence
  Synthetic construct
WMILFCF

SEQ ID NO: 31419 - protein, 7 aa, Artificial Sequence
  Synthetic construct
WMILFCY

SEQ ID NO: 31420 - protein, 7 aa, Artificial Sequence
  Synthetic construct
WMILFLF

SEQ ID NO: 31421 - protein, 7 aa, Artificial Sequence
  Synthetic construct
WMILFLY

SEQ ID NO: 31422 - protein, 7 aa, Artificial Sequence
  Synthetic construct
WMILFAF

SEQ ID NO: 31423 - protein, 7 aa, Artificial Sequence
  Synthetic construct
WMILFAY

SEQ ID NO: 31424 - protein, 7 aa, Artificial Sequence
  Synthetic construct
WMILFQF

SEQ ID NO: 31425 - protein, 7 aa, Artificial Sequence
  Synthetic construct
WMILFQY

SEQ ID NO: 31426 - protein, 7 aa, Artificial Sequence
  Synthetic construct
WMILFDF

SEQ ID NO: 31427 - protein, 7 aa, Artificial Sequence
  Synthetic construct
WMILFDY

SEQ ID NO: 31428 - protein, 7 aa, Artificial Sequence
  Synthetic construct
WMILFVF

SEQ ID NO: 31429 - protein, 7 aa, Artificial Sequence
  Synthetic construct
WMILFVY

SEQ ID NO: 31430 - protein, 7 aa, Artificial Sequence
  Synthetic construct
WMILVFF

SEQ ID NO: 31431 - protein, 7 aa, Artificial Sequence
  Synthetic construct
WMILVFY

SEQ ID NO: 31432 - protein, 7 aa, Artificial Sequence
  Synthetic construct
WMILVRF

SEQ ID NO: 31433 - protein, 7 aa, Artificial Sequence
  Synthetic construct
WMILVRY

SEQ ID NO: 31434 - protein, 7 aa, Artificial Sequence
  Synthetic construct
WMILVCF

SEQ ID NO: 31435 - protein, 7 aa, Artificial Sequence
  Synthetic construct
WMILVCY

SEQ ID NO: 31436 - protein, 7 aa, Artificial Sequence
  Synthetic construct
WMILVLF

SEQ ID NO: 31437 - protein, 7 aa, Artificial Sequence
  Synthetic construct
WMILVLY

SEQ ID NO: 31438 - protein, 7 aa, Artificial Sequence
  Synthetic construct
WMILVAF

SEQ ID NO: 31439 - protein, 7 aa, Artificial Sequence
  Synthetic construct
WMILVAY

SEQ ID NO: 31440 - protein, 7 aa, Artificial Sequence
  Synthetic construct
WMILVQF

SEQ ID NO: 31441 - protein, 7 aa, Artificial Sequence
  Synthetic construct
WMILVQY

SEQ ID NO: 31442 - protein, 7 aa, Artificial Sequence
  Synthetic construct
WMILVDF

SEQ ID NO: 31443 - protein, 7 aa, Artificial Sequence
  Synthetic construct
WMILVDY

SEQ ID NO: 31444 - protein, 7 aa, Artificial Sequence
  Synthetic construct
WMILVVF

SEQ ID NO: 31445 - protein, 7 aa, Artificial Sequence
  Synthetic construct
WMILVVY

SEQ ID NO: 31446 - protein, 7 aa, Artificial Sequence
  Synthetic construct
WMILTFF

SEQ ID NO: 31447 - protein, 7 aa, Artificial Sequence
  Synthetic construct
WMILTFY

SEQ ID NO: 31448 - protein, 7 aa, Artificial Sequence
  Synthetic construct
WMILTRF

SEQ ID NO: 31449 - protein, 7 aa, Artificial Sequence
  Synthetic construct
WMILTRY

SEQ ID NO: 31450 - protein, 7 aa, Artificial Sequence
  Synthetic construct
WMILTCF

SEQ ID NO: 31451 - protein, 7 aa, Artificial Sequence
  Synthetic construct
WMILTCY

SEQ ID NO: 31452 - protein, 7 aa, Artificial Sequence
  Synthetic construct
WMILTLF

SEQ ID NO: 31453 - protein, 7 aa, Artificial Sequence
  Synthetic construct
WMILTLY

SEQ ID NO: 31454 - protein, 7 aa, Artificial Sequence
  Synthetic construct
WMILTAF

SEQ ID NO: 31455 - protein, 7 aa, Artificial Sequence
  Synthetic construct
WMILTAY

SEQ ID NO: 31456 - protein, 7 aa, Artificial Sequence
  Synthetic construct
WMILTQF

SEQ ID NO: 31457 - protein, 7 aa, Artificial Sequence
  Synthetic construct
WMILTQY

SEQ ID NO: 31458 - protein, 7 aa, Artificial Sequence
  Synthetic construct
WMILTDF

SEQ ID NO: 31459 - protein, 7 aa, Artificial Sequence
  Synthetic construct
WMILTDY

SEQ ID NO: 31460 - protein, 7 aa, Artificial Sequence
  Synthetic construct
WMILTVF

SEQ ID NO: 31461 - protein, 7 aa, Artificial Sequence
  Synthetic construct
WMILTVY

SEQ ID NO: 31462 - protein, 7 aa, Artificial Sequence
  Synthetic construct
WMILGFF

SEQ ID NO: 31463 - protein, 7 aa, Artificial Sequence
  Synthetic construct
WMILGFY

SEQ ID NO: 31464 - protein, 7 aa, Artificial Sequence
  Synthetic construct
WMILGRF

SEQ ID NO: 31465 - protein, 7 aa, Artificial Sequence
  Synthetic construct
WMILGRY

SEQ ID NO: 31466 - protein, 7 aa, Artificial Sequence
  Synthetic construct
WMILGCF

SEQ ID NO: 31467 - protein, 7 aa, Artificial Sequence
  Synthetic construct
WMILGCY

SEQ ID NO: 31468 - protein, 7 aa, Artificial Sequence
  Synthetic construct
WMILGLF

SEQ ID NO: 31469 - protein, 7 aa, Artificial Sequence
  Synthetic construct
WMILGLY

SEQ ID NO: 31470 - protein, 7 aa, Artificial Sequence
  Synthetic construct
WMILGAF

SEQ ID NO: 31471 - protein, 7 aa, Artificial Sequence
  Synthetic construct
WMILGAY

SEQ ID NO: 31472 - protein, 7 aa, Artificial Sequence
  Synthetic construct
WMILGQF

SEQ ID NO: 31473 - protein, 7 aa, Artificial Sequence
  Synthetic construct
WMILGQY

SEQ ID NO: 31474 - protein, 7 aa, Artificial Sequence
  Synthetic construct
WMILGDF

SEQ ID NO: 31475 - protein, 7 aa, Artificial Sequence
  Synthetic construct
WMILGDY

SEQ ID NO: 31476 - protein, 7 aa, Artificial Sequence
  Synthetic construct
WMILGVF

SEQ ID NO: 31477 - protein, 7 aa, Artificial Sequence
  Synthetic construct
WMILGVY

SEQ ID NO: 31478 - protein, 7 aa, Artificial Sequence
  Synthetic construct
WMILAFF

SEQ ID NO: 31479 - protein, 7 aa, Artificial Sequence
  Synthetic construct
WMILAFY

SEQ ID NO: 31480 - protein, 7 aa, Artificial Sequence
  Synthetic construct
WMILARF

SEQ ID NO: 31481 - protein, 7 aa, Artificial Sequence
  Synthetic construct
WMILARY

SEQ ID NO: 31482 - protein, 7 aa, Artificial Sequence
  Synthetic construct
WMILACF

SEQ ID NO: 31483 - protein, 7 aa, Artificial Sequence
  Synthetic construct
WMILACY

SEQ ID NO: 31484 - protein, 7 aa, Artificial Sequence
  Synthetic construct
WMILALF

SEQ ID NO: 31485 - protein, 7 aa, Artificial Sequence
  Synthetic construct
WMILALY

SEQ ID NO: 31486 - protein, 7 aa, Artificial Sequence
  Synthetic construct
WMILAAF

SEQ ID NO: 31487 - protein, 7 aa, Artificial Sequence
  Synthetic construct
WMILAAY

SEQ ID NO: 31488 - protein, 7 aa, Artificial Sequence
  Synthetic construct
WMILAQF

SEQ ID NO: 31489 - protein, 7 aa, Artificial Sequence
  Synthetic construct
WMILAQY

SEQ ID NO: 31490 - protein, 7 aa, Artificial Sequence
  Synthetic construct
WMILADF

SEQ ID NO: 31491 - protein, 7 aa, Artificial Sequence
  Synthetic construct
WMILADY

SEQ ID NO: 31492 - protein, 7 aa, Artificial Sequence
  Synthetic construct
WMILAVF

SEQ ID NO: 31493 - protein, 7 aa, Artificial Sequence
  Synthetic construct
WMILAVY

SEQ ID NO: 31494 - protein, 7 aa, Artificial Sequence
  Synthetic construct
WMILQFF

SEQ ID NO: 31495 - protein, 7 aa, Artificial Sequence
  Synthetic construct
WMILQFY

SEQ ID NO: 31496 - protein, 7 aa, Artificial Sequence
  Synthetic construct
WMILQRF

SEQ ID NO: 31497 - protein, 7 aa, Artificial Sequence
  Synthetic construct
WMILQRY

SEQ ID NO: 31498 - protein, 7 aa, Artificial Sequence
  Synthetic construct
WMILQCF

SEQ ID NO: 31499 - protein, 7 aa, Artificial Sequence
  Synthetic construct
WMILQCY

SEQ ID NO: 31500 - protein, 7 aa, Artificial Sequence
  Synthetic construct
WMILQLF

SEQ ID NO: 31501 - protein, 7 aa, Artificial Sequence
  Synthetic construct
WMILQLY

SEQ ID NO: 31502 - protein, 7 aa, Artificial Sequence
  Synthetic construct
WMILQAF

SEQ ID NO: 31503 - protein, 7 aa, Artificial Sequence
  Synthetic construct
WMILQAY

SEQ ID NO: 31504 - protein, 7 aa, Artificial Sequence
  Synthetic construct
WMILQQF

SEQ ID NO: 31505 - protein, 7 aa, Artificial Sequence
  Synthetic construct
WMILQQY

SEQ ID NO: 31506 - protein, 7 aa, Artificial Sequence
  Synthetic construct
WMILQDF

SEQ ID NO: 31507 - protein, 7 aa, Artificial Sequence
  Synthetic construct
WMILQDY

SEQ ID NO: 31508 - protein, 7 aa, Artificial Sequence
  Synthetic construct
WMILQVF

SEQ ID NO: 31509 - protein, 7 aa, Artificial Sequence
  Synthetic construct
WMILQVY

SEQ ID NO: 31510 - protein, 7 aa, Artificial Sequence
  Synthetic construct
WMIFIFF

SEQ ID NO: 31511 - protein, 7 aa, Artificial Sequence
  Synthetic construct
WMIFIFY

SEQ ID NO: 31512 - protein, 7 aa, Artificial Sequence
  Synthetic construct
WMIFIRF

SEQ ID NO: 31513 - protein, 7 aa, Artificial Sequence
  Synthetic construct
WMIFIRY

SEQ ID NO: 31514 - protein, 7 aa, Artificial Sequence
  Synthetic construct
WMIFICF

SEQ ID NO: 31515 - protein, 7 aa, Artificial Sequence
  Synthetic construct
WMIFICY

SEQ ID NO: 31516 - protein, 7 aa, Artificial Sequence
  Synthetic construct
WMIFILF

SEQ ID NO: 31517 - protein, 7 aa, Artificial Sequence
  Synthetic construct
WMIFILY

SEQ ID NO: 31518 - protein, 7 aa, Artificial Sequence
  Synthetic construct
WMIFIAF

SEQ ID NO: 31519 - protein, 7 aa, Artificial Sequence
  Synthetic construct
WMIFIAY

SEQ ID NO: 31520 - protein, 7 aa, Artificial Sequence
  Synthetic construct
WMIFIQF

SEQ ID NO: 31521 - protein, 7 aa, Artificial Sequence
  Synthetic construct
WMIFIQY

SEQ ID NO: 31522 - protein, 7 aa, Artificial Sequence
  Synthetic construct
WMIFIDF

SEQ ID NO: 31523 - protein, 7 aa, Artificial Sequence
  Synthetic construct
WMIFIDY

SEQ ID NO: 31524 - protein, 7 aa, Artificial Sequence
  Synthetic construct
WMIFIVF

SEQ ID NO: 31525 - protein, 7 aa, Artificial Sequence
  Synthetic construct
WMIFIVY

SEQ ID NO: 31526 - protein, 7 aa, Artificial Sequence
  Synthetic construct
WMIFDFF

SEQ ID NO: 31527 - protein, 7 aa, Artificial Sequence
  Synthetic construct
WMIFDFY

SEQ ID NO: 31528 - protein, 7 aa, Artificial Sequence
  Synthetic construct
WMIFDRF

SEQ ID NO: 31529 - protein, 7 aa, Artificial Sequence
  Synthetic construct
WMIFDRY

SEQ ID NO: 31530 - protein, 7 aa, Artificial Sequence
  Synthetic construct
WMIFDCF

SEQ ID NO: 31531 - protein, 7 aa, Artificial Sequence
  Synthetic construct
WMIFDCY

SEQ ID NO: 31532 - protein, 7 aa, Artificial Sequence
  Synthetic construct
WMIFDLF

SEQ ID NO: 31533 - protein, 7 aa, Artificial Sequence
  Synthetic construct
WMIFDLY

SEQ ID NO: 31534 - protein, 7 aa, Artificial Sequence
  Synthetic construct
WMIFDAF

SEQ ID NO: 31535 - protein, 7 aa, Artificial Sequence
  Synthetic construct
WMIFDAY

SEQ ID NO: 31536 - protein, 7 aa, Artificial Sequence
  Synthetic construct
WMIFDQF

SEQ ID NO: 31537 - protein, 7 aa, Artificial Sequence
  Synthetic construct
WMIFDQY

SEQ ID NO: 31538 - protein, 7 aa, Artificial Sequence
  Synthetic construct
WMIFDDF

SEQ ID NO: 31539 - protein, 7 aa, Artificial Sequence
  Synthetic construct
WMIFDDY

SEQ ID NO: 31540 - protein, 7 aa, Artificial Sequence
  Synthetic construct
WMIFDVF

SEQ ID NO: 31541 - protein, 7 aa, Artificial Sequence
  Synthetic construct
WMIFDVY

SEQ ID NO: 31542 - protein, 7 aa, Artificial Sequence
  Synthetic construct
WMIFYFF

SEQ ID NO: 31543 - protein, 7 aa, Artificial Sequence
  Synthetic construct
WMIFYFY

SEQ ID NO: 31544 - protein, 7 aa, Artificial Sequence
  Synthetic construct
WMIFYRF

SEQ ID NO: 31545 - protein, 7 aa, Artificial Sequence
  Synthetic construct
WMIFYRY

SEQ ID NO: 31546 - protein, 7 aa, Artificial Sequence
  Synthetic construct
WMIFYCF

SEQ ID NO: 31547 - protein, 7 aa, Artificial Sequence
  Synthetic construct
WMIFYCY

SEQ ID NO: 31548 - protein, 7 aa, Artificial Sequence
  Synthetic construct
WMIFYLF

SEQ ID NO: 31549 - protein, 7 aa, Artificial Sequence
  Synthetic construct
WMIFYLY

SEQ ID NO: 31550 - protein, 7 aa, Artificial Sequence
  Synthetic construct
WMIFYAF

SEQ ID NO: 31551 - protein, 7 aa, Artificial Sequence
  Synthetic construct
WMIFYAY

SEQ ID NO: 31552 - protein, 7 aa, Artificial Sequence
  Synthetic construct
WMIFYQF

SEQ ID NO: 31553 - protein, 7 aa, Artificial Sequence
  Synthetic construct
WMIFYQY

SEQ ID NO: 31554 - protein, 7 aa, Artificial Sequence
  Synthetic construct
WMIFYDF

SEQ ID NO: 31555 - protein, 7 aa, Artificial Sequence
  Synthetic construct
WMIFYDY

SEQ ID NO: 31556 - protein, 7 aa, Artificial Sequence
  Synthetic construct
WMIFYVF

SEQ ID NO: 31557 - protein, 7 aa, Artificial Sequence
  Synthetic construct
WMIFYVY

SEQ ID NO: 31558 - protein, 7 aa, Artificial Sequence
  Synthetic construct
WMIFFFF

SEQ ID NO: 31559 - protein, 7 aa, Artificial Sequence
  Synthetic construct
WMIFFFY

SEQ ID NO: 31560 - protein, 7 aa, Artificial Sequence
  Synthetic construct
WMIFFRF

SEQ ID NO: 31561 - protein, 7 aa, Artificial Sequence
  Synthetic construct
WMIFFRY

SEQ ID NO: 31562 - protein, 7 aa, Artificial Sequence
  Synthetic construct
WMIFFCF

SEQ ID NO: 31563 - protein, 7 aa, Artificial Sequence
  Synthetic construct
WMIFFCY

SEQ ID NO: 31564 - protein, 7 aa, Artificial Sequence
  Synthetic construct
WMIFFLF

SEQ ID NO: 31565 - protein, 7 aa, Artificial Sequence
  Synthetic construct
WMIFFLY

SEQ ID NO: 31566 - protein, 7 aa, Artificial Sequence
  Synthetic construct
WMIFFAF

SEQ ID NO: 31567 - protein, 7 aa, Artificial Sequence
  Synthetic construct
WMIFFAY

SEQ ID NO: 31568 - protein, 7 aa, Artificial Sequence
  Synthetic construct
WMIFFQF

SEQ ID NO: 31569 - protein, 7 aa, Artificial Sequence
  Synthetic construct
WMIFFQY

SEQ ID NO: 31570 - protein, 7 aa, Artificial Sequence
  Synthetic construct
WMIFFDF

SEQ ID NO: 31571 - protein, 7 aa, Artificial Sequence
  Synthetic construct
WMIFFDY

SEQ ID NO: 31572 - protein, 7 aa, Artificial Sequence
  Synthetic construct
WMIFFVF

SEQ ID NO: 31573 - protein, 7 aa, Artificial Sequence
  Synthetic construct
WMIFFVY

SEQ ID NO: 31574 - protein, 7 aa, Artificial Sequence
  Synthetic construct
WMIFVFF

SEQ ID NO: 31575 - protein, 7 aa, Artificial Sequence
  Synthetic construct
WMIFVFY

SEQ ID NO: 31576 - protein, 7 aa, Artificial Sequence
  Synthetic construct
WMIFVRF

SEQ ID NO: 31577 - protein, 7 aa, Artificial Sequence
  Synthetic construct
WMIFVRY

SEQ ID NO: 31578 - protein, 7 aa, Artificial Sequence
  Synthetic construct
WMIFVCF

SEQ ID NO: 31579 - protein, 7 aa, Artificial Sequence
  Synthetic construct
WMIFVCY

SEQ ID NO: 31580 - protein, 7 aa, Artificial Sequence
  Synthetic construct
WMIFVLF

SEQ ID NO: 31581 - protein, 7 aa, Artificial Sequence
  Synthetic construct
WMIFVLY

SEQ ID NO: 31582 - protein, 7 aa, Artificial Sequence
  Synthetic construct
WMIFVAF

SEQ ID NO: 31583 - protein, 7 aa, Artificial Sequence
  Synthetic construct
WMIFVAY

SEQ ID NO: 31584 - protein, 7 aa, Artificial Sequence
  Synthetic construct
WMIFVQF

SEQ ID NO: 31585 - protein, 7 aa, Artificial Sequence
  Synthetic construct
WMIFVQY

SEQ ID NO: 31586 - protein, 7 aa, Artificial Sequence
  Synthetic construct
WMIFVDF

SEQ ID NO: 31587 - protein, 7 aa, Artificial Sequence
  Synthetic construct
WMIFVDY

SEQ ID NO: 31588 - protein, 7 aa, Artificial Sequence
  Synthetic construct
WMIFVVF

SEQ ID NO: 31589 - protein, 7 aa, Artificial Sequence
  Synthetic construct
WMIFVVY

SEQ ID NO: 31590 - protein, 7 aa, Artificial Sequence
  Synthetic construct
WMIFTFF

SEQ ID NO: 31591 - protein, 7 aa, Artificial Sequence
  Synthetic construct
WMIFTFY

SEQ ID NO: 31592 - protein, 7 aa, Artificial Sequence
  Synthetic construct
WMIFTRF

SEQ ID NO: 31593 - protein, 7 aa, Artificial Sequence
  Synthetic construct
WMIFTRY

SEQ ID NO: 31594 - protein, 7 aa, Artificial Sequence
  Synthetic construct
WMIFTCF

SEQ ID NO: 31595 - protein, 7 aa, Artificial Sequence
  Synthetic construct
WMIFTCY

SEQ ID NO: 31596 - protein, 7 aa, Artificial Sequence
  Synthetic construct
WMIFTLF

SEQ ID NO: 31597 - protein, 7 aa, Artificial Sequence
  Synthetic construct
WMIFTLY

SEQ ID NO: 31598 - protein, 7 aa, Artificial Sequence
  Synthetic construct
WMIFTAF

SEQ ID NO: 31599 - protein, 7 aa, Artificial Sequence
  Synthetic construct
WMIFTAY

SEQ ID NO: 31600 - protein, 7 aa, Artificial Sequence
  Synthetic construct
WMIFTQF

SEQ ID NO: 31601 - protein, 7 aa, Artificial Sequence
  Synthetic construct
WMIFTQY

SEQ ID NO: 31602 - protein, 7 aa, Artificial Sequence
  Synthetic construct
WMIFTDF

SEQ ID NO: 31603 - protein, 7 aa, Artificial Sequence
  Synthetic construct
WMIFTDY

SEQ ID NO: 31604 - protein, 7 aa, Artificial Sequence
  Synthetic construct
WMIFTVF

SEQ ID NO: 31605 - protein, 7 aa, Artificial Sequence
  Synthetic construct
WMIFTVY

SEQ ID NO: 31606 - protein, 7 aa, Artificial Sequence
  Synthetic construct
WMIFGFF

SEQ ID NO: 31607 - protein, 7 aa, Artificial Sequence
  Synthetic construct
WMIFGFY

SEQ ID NO: 31608 - protein, 7 aa, Artificial Sequence
  Synthetic construct
WMIFGRF

SEQ ID NO: 31609 - protein, 7 aa, Artificial Sequence
  Synthetic construct
WMIFGRY

SEQ ID NO: 31610 - protein, 7 aa, Artificial Sequence
  Synthetic construct
WMIFGCF

SEQ ID NO: 31611 - protein, 7 aa, Artificial Sequence
  Synthetic construct
WMIFGCY

SEQ ID NO: 31612 - protein, 7 aa, Artificial Sequence
  Synthetic construct
WMIFGLF

SEQ ID NO: 31613 - protein, 7 aa, Artificial Sequence
  Synthetic construct
WMIFGLY

SEQ ID NO: 31614 - protein, 7 aa, Artificial Sequence
  Synthetic construct
WMIFGAF

SEQ ID NO: 31615 - protein, 7 aa, Artificial Sequence
  Synthetic construct
WMIFGAY

SEQ ID NO: 31616 - protein, 7 aa, Artificial Sequence
  Synthetic construct
WMIFGQF

SEQ ID NO: 31617 - protein, 7 aa, Artificial Sequence
  Synthetic construct
WMIFGQY

SEQ ID NO: 31618 - protein, 7 aa, Artificial Sequence
  Synthetic construct
WMIFGDF

SEQ ID NO: 31619 - protein, 7 aa, Artificial Sequence
  Synthetic construct
WMIFGDY

SEQ ID NO: 31620 - protein, 7 aa, Artificial Sequence
  Synthetic construct
WMIFGVF

SEQ ID NO: 31621 - protein, 7 aa, Artificial Sequence
  Synthetic construct
WMIFGVY

SEQ ID NO: 31622 - protein, 7 aa, Artificial Sequence
  Synthetic construct
WMIFAFF

SEQ ID NO: 31623 - protein, 7 aa, Artificial Sequence
  Synthetic construct
WMIFAFY

SEQ ID NO: 31624 - protein, 7 aa, Artificial Sequence
  Synthetic construct
WMIFARF

SEQ ID NO: 31625 - protein, 7 aa, Artificial Sequence
  Synthetic construct
WMIFARY

SEQ ID NO: 31626 - protein, 7 aa, Artificial Sequence
  Synthetic construct
WMIFACF

SEQ ID NO: 31627 - protein, 7 aa, Artificial Sequence
  Synthetic construct
WMIFACY

SEQ ID NO: 31628 - protein, 7 aa, Artificial Sequence
  Synthetic construct
WMIFALF

SEQ ID NO: 31629 - protein, 7 aa, Artificial Sequence
  Synthetic construct
WMIFALY

SEQ ID NO: 31630 - protein, 7 aa, Artificial Sequence
  Synthetic construct
WMIFAAF

SEQ ID NO: 31631 - protein, 7 aa, Artificial Sequence
  Synthetic construct
WMIFAAY

SEQ ID NO: 31632 - protein, 7 aa, Artificial Sequence
  Synthetic construct
WMIFAQF

SEQ ID NO: 31633 - protein, 7 aa, Artificial Sequence
  Synthetic construct
WMIFAQY

SEQ ID NO: 31634 - protein, 7 aa, Artificial Sequence
  Synthetic construct
WMIFADF

SEQ ID NO: 31635 - protein, 7 aa, Artificial Sequence
  Synthetic construct
WMIFADY

SEQ ID NO: 31636 - protein, 7 aa, Artificial Sequence
  Synthetic construct
WMIFAVF

SEQ ID NO: 31637 - protein, 7 aa, Artificial Sequence
  Synthetic construct
WMIFAVY

SEQ ID NO: 31638 - protein, 7 aa, Artificial Sequence
  Synthetic construct
WMIFQFF

SEQ ID NO: 31639 - protein, 7 aa, Artificial Sequence
  Synthetic construct
WMIFQFY

SEQ ID NO: 31640 - protein, 7 aa, Artificial Sequence
  Synthetic construct
WMIFQRF

SEQ ID NO: 31641 - protein, 7 aa, Artificial Sequence
  Synthetic construct
WMIFQRY

SEQ ID NO: 31642 - protein, 7 aa, Artificial Sequence
  Synthetic construct
WMIFQCF

SEQ ID NO: 31643 - protein, 7 aa, Artificial Sequence
  Synthetic construct
WMIFQCY

SEQ ID NO: 31644 - protein, 7 aa, Artificial Sequence
  Synthetic construct
WMIFQLF

SEQ ID NO: 31645 - protein, 7 aa, Artificial Sequence
  Synthetic construct
WMIFQLY

SEQ ID NO: 31646 - protein, 7 aa, Artificial Sequence
  Synthetic construct
WMIFQAF

SEQ ID NO: 31647 - protein, 7 aa, Artificial Sequence
  Synthetic construct
WMIFQAY

SEQ ID NO: 31648 - protein, 7 aa, Artificial Sequence
  Synthetic construct
WMIFQQF

SEQ ID NO: 31649 - protein, 7 aa, Artificial Sequence
  Synthetic construct
WMIFQQY

SEQ ID NO: 31650 - protein, 7 aa, Artificial Sequence
  Synthetic construct
WMIFQDF

SEQ ID NO: 31651 - protein, 7 aa, Artificial Sequence
  Synthetic construct
WMIFQDY

SEQ ID NO: 31652 - protein, 7 aa, Artificial Sequence
  Synthetic construct
WMIFQVF

SEQ ID NO: 31653 - protein, 7 aa, Artificial Sequence
  Synthetic construct
WMIFQVY

SEQ ID NO: 31654 - protein, 7 aa, Artificial Sequence
  Synthetic construct
WMGYIFF

SEQ ID NO: 31655 - protein, 7 aa, Artificial Sequence
  Synthetic construct
WMGYIFY

SEQ ID NO: 31656 - protein, 7 aa, Artificial Sequence
  Synthetic construct
WMGYIRF

SEQ ID NO: 31657 - protein, 7 aa, Artificial Sequence
  Synthetic construct
WMGYIRY

SEQ ID NO: 31658 - protein, 7 aa, Artificial Sequence
  Synthetic construct
WMGYICF

SEQ ID NO: 31659 - protein, 7 aa, Artificial Sequence
  Synthetic construct
WMGYICY

SEQ ID NO: 31660 - protein, 7 aa, Artificial Sequence
  Synthetic construct
WMGYILF

SEQ ID NO: 31661 - protein, 7 aa, Artificial Sequence
  Synthetic construct
WMGYILY

SEQ ID NO: 31662 - protein, 7 aa, Artificial Sequence
  Synthetic construct
WMGYIAF

SEQ ID NO: 31663 - protein, 7 aa, Artificial Sequence
  Synthetic construct
WMGYIAY

SEQ ID NO: 31664 - protein, 7 aa, Artificial Sequence
  Synthetic construct
WMGYIQF

SEQ ID NO: 31665 - protein, 7 aa, Artificial Sequence
  Synthetic construct
WMGYIQY

SEQ ID NO: 31666 - protein, 7 aa, Artificial Sequence
  Synthetic construct
WMGYIDF

SEQ ID NO: 31667 - protein, 7 aa, Artificial Sequence
  Synthetic construct
WMGYIDY

SEQ ID NO: 31668 - protein, 7 aa, Artificial Sequence
  Synthetic construct
WMGYIVF

SEQ ID NO: 31669 - protein, 7 aa, Artificial Sequence
  Synthetic construct
WMGYIVY

SEQ ID NO: 31670 - protein, 7 aa, Artificial Sequence
  Synthetic construct
WMGYDFF

SEQ ID NO: 31671 - protein, 7 aa, Artificial Sequence
  Synthetic construct
WMGYDFY

SEQ ID NO: 31672 - protein, 7 aa, Artificial Sequence
  Synthetic construct
WMGYDRF

SEQ ID NO: 31673 - protein, 7 aa, Artificial Sequence
  Synthetic construct
WMGYDRY

SEQ ID NO: 31674 - protein, 7 aa, Artificial Sequence
  Synthetic construct
WMGYDCF

SEQ ID NO: 31675 - protein, 7 aa, Artificial Sequence
  Synthetic construct
WMGYDCY

SEQ ID NO: 31676 - protein, 7 aa, Artificial Sequence
  Synthetic construct
WMGYDLF

SEQ ID NO: 31677 - protein, 7 aa, Artificial Sequence
  Synthetic construct
WMGYDLY

SEQ ID NO: 31678 - protein, 7 aa, Artificial Sequence
  Synthetic construct
WMGYDAF

SEQ ID NO: 31679 - protein, 7 aa, Artificial Sequence
  Synthetic construct
WMGYDAY

SEQ ID NO: 31680 - protein, 7 aa, Artificial Sequence
  Synthetic construct
WMGYDQF

SEQ ID NO: 31681 - protein, 7 aa, Artificial Sequence
  Synthetic construct
WMGYDQY

SEQ ID NO: 31682 - protein, 7 aa, Artificial Sequence
  Synthetic construct
WMGYDDF

SEQ ID NO: 31683 - protein, 7 aa, Artificial Sequence
  Synthetic construct
WMGYDDY

SEQ ID NO: 31684 - protein, 7 aa, Artificial Sequence
  Synthetic construct
WMGYDVF

SEQ ID NO: 31685 - protein, 7 aa, Artificial Sequence
  Synthetic construct
WMGYDVY

SEQ ID NO: 31686 - protein, 7 aa, Artificial Sequence
  Synthetic construct
WMGYYFF

SEQ ID NO: 31687 - protein, 7 aa, Artificial Sequence
  Synthetic construct
WMGYYFY

SEQ ID NO: 31688 - protein, 7 aa, Artificial Sequence
  Synthetic construct
WMGYYRF

SEQ ID NO: 31689 - protein, 7 aa, Artificial Sequence
  Synthetic construct
WMGYYRY

SEQ ID NO: 31690 - protein, 7 aa, Artificial Sequence
  Synthetic construct
WMGYYCF

SEQ ID NO: 31691 - protein, 7 aa, Artificial Sequence
  Synthetic construct
WMGYYCY

SEQ ID NO: 31692 - protein, 7 aa, Artificial Sequence
  Synthetic construct
WMGYYLF

SEQ ID NO: 31693 - protein, 7 aa, Artificial Sequence
  Synthetic construct
WMGYYLY

SEQ ID NO: 31694 - protein, 7 aa, Artificial Sequence
  Synthetic construct
WMGYYAF

SEQ ID NO: 31695 - protein, 7 aa, Artificial Sequence
  Synthetic construct
WMGYYAY

SEQ ID NO: 31696 - protein, 7 aa, Artificial Sequence
  Synthetic construct
WMGYYQF

SEQ ID NO: 31697 - protein, 7 aa, Artificial Sequence
  Synthetic construct
WMGYYQY

SEQ ID NO: 31698 - protein, 7 aa, Artificial Sequence
  Synthetic construct
WMGYYDF

SEQ ID NO: 31699 - protein, 7 aa, Artificial Sequence
  Synthetic construct
WMGYYDY

SEQ ID NO: 31700 - protein, 7 aa, Artificial Sequence
  Synthetic construct
WMGYYVF

SEQ ID NO: 31701 - protein, 7 aa, Artificial Sequence
  Synthetic construct
WMGYYVY

SEQ ID NO: 31702 - protein, 7 aa, Artificial Sequence
  Synthetic construct
WMGYFFF

SEQ ID NO: 31703 - protein, 7 aa, Artificial Sequence
  Synthetic construct
WMGYFFY

SEQ ID NO: 31704 - protein, 7 aa, Artificial Sequence
  Synthetic construct
WMGYFRF

SEQ ID NO: 31705 - protein, 7 aa, Artificial Sequence
  Synthetic construct
WMGYFRY

SEQ ID NO: 31706 - protein, 7 aa, Artificial Sequence
  Synthetic construct
WMGYFCF

SEQ ID NO: 31707 - protein, 7 aa, Artificial Sequence
  Synthetic construct
WMGYFCY

SEQ ID NO: 31708 - protein, 7 aa, Artificial Sequence
  Synthetic construct
WMGYFLF

SEQ ID NO: 31709 - protein, 7 aa, Artificial Sequence
  Synthetic construct
WMGYFLY

SEQ ID NO: 31710 - protein, 7 aa, Artificial Sequence
  Synthetic construct
WMGYFAF

SEQ ID NO: 31711 - protein, 7 aa, Artificial Sequence
  Synthetic construct
WMGYFAY

SEQ ID NO: 31712 - protein, 7 aa, Artificial Sequence
  Synthetic construct
WMGYFQF

SEQ ID NO: 31713 - protein, 7 aa, Artificial Sequence
  Synthetic construct
WMGYFQY

SEQ ID NO: 31714 - protein, 7 aa, Artificial Sequence
  Synthetic construct
WMGYFDF

SEQ ID NO: 31715 - protein, 7 aa, Artificial Sequence
  Synthetic construct
WMGYFDY

SEQ ID NO: 31716 - protein, 7 aa, Artificial Sequence
  Synthetic construct
WMGYFVF

SEQ ID NO: 31717 - protein, 7 aa, Artificial Sequence
  Synthetic construct
WMGYFVY

SEQ ID NO: 31718 - protein, 7 aa, Artificial Sequence
  Synthetic construct
WMGYVFF

SEQ ID NO: 31719 - protein, 7 aa, Artificial Sequence
  Synthetic construct
WMGYVFY

SEQ ID NO: 31720 - protein, 7 aa, Artificial Sequence
  Synthetic construct
WMGYVRF

SEQ ID NO: 31721 - protein, 7 aa, Artificial Sequence
  Synthetic construct
WMGYVRY

SEQ ID NO: 31722 - protein, 7 aa, Artificial Sequence
  Synthetic construct
WMGYVCF

SEQ ID NO: 31723 - protein, 7 aa, Artificial Sequence
  Synthetic construct
WMGYVCY

SEQ ID NO: 31724 - protein, 7 aa, Artificial Sequence
  Synthetic construct
WMGYVLF

SEQ ID NO: 31725 - protein, 7 aa, Artificial Sequence
  Synthetic construct
WMGYVLY

SEQ ID NO: 31726 - protein, 7 aa, Artificial Sequence
  Synthetic construct
WMGYVAF

SEQ ID NO: 31727 - protein, 7 aa, Artificial Sequence
  Synthetic construct
WMGYVAY

SEQ ID NO: 31728 - protein, 7 aa, Artificial Sequence
  Synthetic construct
WMGYVQF

SEQ ID NO: 31729 - protein, 7 aa, Artificial Sequence
  Synthetic construct
WMGYVQY

SEQ ID NO: 31730 - protein, 7 aa, Artificial Sequence
  Synthetic construct
WMGYVDF

SEQ ID NO: 31731 - protein, 7 aa, Artificial Sequence
  Synthetic construct
WMGYVDY

SEQ ID NO: 31732 - protein, 7 aa, Artificial Sequence
  Synthetic construct
WMGYVVF

SEQ ID NO: 31733 - protein, 7 aa, Artificial Sequence
  Synthetic construct
WMGYVVY

SEQ ID NO: 31734 - protein, 7 aa, Artificial Sequence
  Synthetic construct
WMGYTFF

SEQ ID NO: 31735 - protein, 7 aa, Artificial Sequence
  Synthetic construct
WMGYTFY

SEQ ID NO: 31736 - protein, 7 aa, Artificial Sequence
  Synthetic construct
WMGYTRF

SEQ ID NO: 31737 - protein, 7 aa, Artificial Sequence
  Synthetic construct
WMGYTRY

SEQ ID NO: 31738 - protein, 7 aa, Artificial Sequence
  Synthetic construct
WMGYTCF

SEQ ID NO: 31739 - protein, 7 aa, Artificial Sequence
  Synthetic construct
WMGYTCY

SEQ ID NO: 31740 - protein, 7 aa, Artificial Sequence
  Synthetic construct
WMGYTLF

SEQ ID NO: 31741 - protein, 7 aa, Artificial Sequence
  Synthetic construct
WMGYTLY

SEQ ID NO: 31742 - protein, 7 aa, Artificial Sequence
  Synthetic construct
WMGYTAF

SEQ ID NO: 31743 - protein, 7 aa, Artificial Sequence
  Synthetic construct
WMGYTAY

SEQ ID NO: 31744 - protein, 7 aa, Artificial Sequence
  Synthetic construct
WMGYTQF

SEQ ID NO: 31745 - protein, 7 aa, Artificial Sequence
  Synthetic construct
WMGYTQY

SEQ ID NO: 31746 - protein, 7 aa, Artificial Sequence
  Synthetic construct
WMGYTDF

SEQ ID NO: 31747 - protein, 7 aa, Artificial Sequence
  Synthetic construct
WMGYTDY

SEQ ID NO: 31748 - protein, 7 aa, Artificial Sequence
  Synthetic construct
WMGYTVF

SEQ ID NO: 31749 - protein, 7 aa, Artificial Sequence
  Synthetic construct
WMGYTVY

SEQ ID NO: 31750 - protein, 7 aa, Artificial Sequence
  Synthetic construct
WMGYGFF

SEQ ID NO: 31751 - protein, 7 aa, Artificial Sequence
  Synthetic construct
WMGYGFY

SEQ ID NO: 31752 - protein, 7 aa, Artificial Sequence
  Synthetic construct
WMGYGRF

SEQ ID NO: 31753 - protein, 7 aa, Artificial Sequence
  Synthetic construct
WMGYGRY

SEQ ID NO: 31754 - protein, 7 aa, Artificial Sequence
  Synthetic construct
WMGYGCF

SEQ ID NO: 31755 - protein, 7 aa, Artificial Sequence
  Synthetic construct
WMGYGCY

SEQ ID NO: 31756 - protein, 7 aa, Artificial Sequence
  Synthetic construct
WMGYGLF

SEQ ID NO: 31757 - protein, 7 aa, Artificial Sequence
  Synthetic construct
WMGYGLY

SEQ ID NO: 31758 - protein, 7 aa, Artificial Sequence
  Synthetic construct
WMGYGAF

SEQ ID NO: 31759 - protein, 7 aa, Artificial Sequence
  Synthetic construct
WMGYGAY

SEQ ID NO: 31760 - protein, 7 aa, Artificial Sequence
  Synthetic construct
WMGYGQF

SEQ ID NO: 31761 - protein, 7 aa, Artificial Sequence
  Synthetic construct
WMGYGQY

SEQ ID NO: 31762 - protein, 7 aa, Artificial Sequence
  Synthetic construct
WMGYGDF

SEQ ID NO: 31763 - protein, 7 aa, Artificial Sequence
  Synthetic construct
WMGYGDY

SEQ ID NO: 31764 - protein, 7 aa, Artificial Sequence
  Synthetic construct
WMGYGVF

SEQ ID NO: 31765 - protein, 7 aa, Artificial Sequence
  Synthetic construct
WMGYGVY

SEQ ID NO: 31766 - protein, 7 aa, Artificial Sequence
  Synthetic construct
WMGYAFF

SEQ ID NO: 31767 - protein, 7 aa, Artificial Sequence
  Synthetic construct
WMGYAFY

SEQ ID NO: 31768 - protein, 7 aa, Artificial Sequence
  Synthetic construct
WMGYARF

SEQ ID NO: 31769 - protein, 7 aa, Artificial Sequence
  Synthetic construct
WMGYARY

SEQ ID NO: 31770 - protein, 7 aa, Artificial Sequence
  Synthetic construct
WMGYACF

SEQ ID NO: 31771 - protein, 7 aa, Artificial Sequence
  Synthetic construct
WMGYACY

SEQ ID NO: 31772 - protein, 7 aa, Artificial Sequence
  Synthetic construct
WMGYALF

SEQ ID NO: 31773 - protein, 7 aa, Artificial Sequence
  Synthetic construct
WMGYALY

SEQ ID NO: 31774 - protein, 7 aa, Artificial Sequence
  Synthetic construct
WMGYAAF

SEQ ID NO: 31775 - protein, 7 aa, Artificial Sequence
  Synthetic construct
WMGYAAY

SEQ ID NO: 31776 - protein, 7 aa, Artificial Sequence
  Synthetic construct
WMGYAQF

SEQ ID NO: 31777 - protein, 7 aa, Artificial Sequence
  Synthetic construct
WMGYAQY

SEQ ID NO: 31778 - protein, 7 aa, Artificial Sequence
  Synthetic construct
WMGYADF

SEQ ID NO: 31779 - protein, 7 aa, Artificial Sequence
  Synthetic construct
WMGYADY

SEQ ID NO: 31780 - protein, 7 aa, Artificial Sequence
  Synthetic construct
WMGYAVF

SEQ ID NO: 31781 - protein, 7 aa, Artificial Sequence
  Synthetic construct
WMGYAVY

SEQ ID NO: 31782 - protein, 7 aa, Artificial Sequence
  Synthetic construct
WMGYQFF

SEQ ID NO: 31783 - protein, 7 aa, Artificial Sequence
  Synthetic construct
WMGYQFY

SEQ ID NO: 31784 - protein, 7 aa, Artificial Sequence
  Synthetic construct
WMGYQRF

SEQ ID NO: 31785 - protein, 7 aa, Artificial Sequence
  Synthetic construct
WMGYQRY

SEQ ID NO: 31786 - protein, 7 aa, Artificial Sequence
  Synthetic construct
WMGYQCF

SEQ ID NO: 31787 - protein, 7 aa, Artificial Sequence
  Synthetic construct
WMGYQCY

SEQ ID NO: 31788 - protein, 7 aa, Artificial Sequence
  Synthetic construct
WMGYQLF

SEQ ID NO: 31789 - protein, 7 aa, Artificial Sequence
  Synthetic construct
WMGYQLY

SEQ ID NO: 31790 - protein, 7 aa, Artificial Sequence
  Synthetic construct
WMGYQAF

SEQ ID NO: 31791 - protein, 7 aa, Artificial Sequence
  Synthetic construct
WMGYQAY

SEQ ID NO: 31792 - protein, 7 aa, Artificial Sequence
  Synthetic construct
WMGYQQF

SEQ ID NO: 31793 - protein, 7 aa, Artificial Sequence
  Synthetic construct
WMGYQQY

SEQ ID NO: 31794 - protein, 7 aa, Artificial Sequence
  Synthetic construct
WMGYQDF

SEQ ID NO: 31795 - protein, 7 aa, Artificial Sequence
  Synthetic construct
WMGYQDY

SEQ ID NO: 31796 - protein, 7 aa, Artificial Sequence
  Synthetic construct
WMGYQVF

SEQ ID NO: 31797 - protein, 7 aa, Artificial Sequence
  Synthetic construct
WMGYQVY

SEQ ID NO: 31798 - protein, 7 aa, Artificial Sequence
  Synthetic construct
WMGPIFF

SEQ ID NO: 31799 - protein, 7 aa, Artificial Sequence
  Synthetic construct
WMGPIFY

SEQ ID NO: 31800 - protein, 7 aa, Artificial Sequence
  Synthetic construct
WMGPIRF

SEQ ID NO: 31801 - protein, 7 aa, Artificial Sequence
  Synthetic construct
WMGPIRY

SEQ ID NO: 31802 - protein, 7 aa, Artificial Sequence
  Synthetic construct
WMGPICF

SEQ ID NO: 31803 - protein, 7 aa, Artificial Sequence
  Synthetic construct
WMGPICY

SEQ ID NO: 31804 - protein, 7 aa, Artificial Sequence
  Synthetic construct
WMGPILF

SEQ ID NO: 31805 - protein, 7 aa, Artificial Sequence
  Synthetic construct
WMGPILY

SEQ ID NO: 31806 - protein, 7 aa, Artificial Sequence
  Synthetic construct
WMGPIAF

SEQ ID NO: 31807 - protein, 7 aa, Artificial Sequence
  Synthetic construct
WMGPIAY

SEQ ID NO: 31808 - protein, 7 aa, Artificial Sequence
  Synthetic construct
WMGPIQF

SEQ ID NO: 31809 - protein, 7 aa, Artificial Sequence
  Synthetic construct
WMGPIQY

SEQ ID NO: 31810 - protein, 7 aa, Artificial Sequence
  Synthetic construct
WMGPIDF

SEQ ID NO: 31811 - protein, 7 aa, Artificial Sequence
  Synthetic construct
WMGPIDY

SEQ ID NO: 31812 - protein, 7 aa, Artificial Sequence
  Synthetic construct
WMGPIVF

SEQ ID NO: 31813 - protein, 7 aa, Artificial Sequence
  Synthetic construct
WMGPIVY

SEQ ID NO: 31814 - protein, 7 aa, Artificial Sequence
  Synthetic construct
WMGPDFF

SEQ ID NO: 31815 - protein, 7 aa, Artificial Sequence
  Synthetic construct
WMGPDFY

SEQ ID NO: 31816 - protein, 7 aa, Artificial Sequence
  Synthetic construct
WMGPDRF

SEQ ID NO: 31817 - protein, 7 aa, Artificial Sequence
  Synthetic construct
WMGPDRY

SEQ ID NO: 31818 - protein, 7 aa, Artificial Sequence
  Synthetic construct
WMGPDCF

SEQ ID NO: 31819 - protein, 7 aa, Artificial Sequence
  Synthetic construct
WMGPDCY

SEQ ID NO: 31820 - protein, 7 aa, Artificial Sequence
  Synthetic construct
WMGPDLF

SEQ ID NO: 31821 - protein, 7 aa, Artificial Sequence
  Synthetic construct
WMGPDLY

SEQ ID NO: 31822 - protein, 7 aa, Artificial Sequence
  Synthetic construct
WMGPDAF

SEQ ID NO: 31823 - protein, 7 aa, Artificial Sequence
  Synthetic construct
WMGPDAY

SEQ ID NO: 31824 - protein, 7 aa, Artificial Sequence
  Synthetic construct
WMGPDQF

SEQ ID NO: 31825 - protein, 7 aa, Artificial Sequence
  Synthetic construct
WMGPDQY

SEQ ID NO: 31826 - protein, 7 aa, Artificial Sequence
  Synthetic construct
WMGPDDF

SEQ ID NO: 31827 - protein, 7 aa, Artificial Sequence
  Synthetic construct
WMGPDDY

SEQ ID NO: 31828 - protein, 7 aa, Artificial Sequence
  Synthetic construct
WMGPDVF

SEQ ID NO: 31829 - protein, 7 aa, Artificial Sequence
  Synthetic construct
WMGPDVY

SEQ ID NO: 31830 - protein, 7 aa, Artificial Sequence
  Synthetic construct
WMGPYFF

SEQ ID NO: 31831 - protein, 7 aa, Artificial Sequence
  Synthetic construct
WMGPYFY

SEQ ID NO: 31832 - protein, 7 aa, Artificial Sequence
  Synthetic construct
WMGPYRF

SEQ ID NO: 31833 - protein, 7 aa, Artificial Sequence
  Synthetic construct
WMGPYRY

SEQ ID NO: 31834 - protein, 7 aa, Artificial Sequence
  Synthetic construct
WMGPYCF

SEQ ID NO: 31835 - protein, 7 aa, Artificial Sequence
  Synthetic construct
WMGPYCY

SEQ ID NO: 31836 - protein, 7 aa, Artificial Sequence
  Synthetic construct
WMGPYLF

SEQ ID NO: 31837 - protein, 7 aa, Artificial Sequence
  Synthetic construct
WMGPYLY

SEQ ID NO: 31838 - protein, 7 aa, Artificial Sequence
  Synthetic construct
WMGPYAF

SEQ ID NO: 31839 - protein, 7 aa, Artificial Sequence
  Synthetic construct
WMGPYAY

SEQ ID NO: 31840 - protein, 7 aa, Artificial Sequence
  Synthetic construct
WMGPYQF

SEQ ID NO: 31841 - protein, 7 aa, Artificial Sequence
  Synthetic construct
WMGPYQY

SEQ ID NO: 31842 - protein, 7 aa, Artificial Sequence
  Synthetic construct
WMGPYDF

SEQ ID NO: 31843 - protein, 7 aa, Artificial Sequence
  Synthetic construct
WMGPYDY

SEQ ID NO: 31844 - protein, 7 aa, Artificial Sequence
  Synthetic construct
WMGPYVF

SEQ ID NO: 31845 - protein, 7 aa, Artificial Sequence
  Synthetic construct
WMGPYVY

SEQ ID NO: 31846 - protein, 7 aa, Artificial Sequence
  Synthetic construct
WMGPFFF

SEQ ID NO: 31847 - protein, 7 aa, Artificial Sequence
  Synthetic construct
WMGPFFY

SEQ ID NO: 31848 - protein, 7 aa, Artificial Sequence
  Synthetic construct
WMGPFRF

SEQ ID NO: 31849 - protein, 7 aa, Artificial Sequence
  Synthetic construct
WMGPFRY

SEQ ID NO: 31850 - protein, 7 aa, Artificial Sequence
  Synthetic construct
WMGPFCF

SEQ ID NO: 31851 - protein, 7 aa, Artificial Sequence
  Synthetic construct
WMGPFCY

SEQ ID NO: 31852 - protein, 7 aa, Artificial Sequence
  Synthetic construct
WMGPFLF

SEQ ID NO: 31853 - protein, 7 aa, Artificial Sequence
  Synthetic construct
WMGPFLY

SEQ ID NO: 31854 - protein, 7 aa, Artificial Sequence
  Synthetic construct
WMGPFAF

SEQ ID NO: 31855 - protein, 7 aa, Artificial Sequence
  Synthetic construct
WMGPFAY

SEQ ID NO: 31856 - protein, 7 aa, Artificial Sequence
  Synthetic construct
WMGPFQF

SEQ ID NO: 31857 - protein, 7 aa, Artificial Sequence
  Synthetic construct
WMGPFQY

SEQ ID NO: 31858 - protein, 7 aa, Artificial Sequence
  Synthetic construct
WMGPFDF

SEQ ID NO: 31859 - protein, 7 aa, Artificial Sequence
  Synthetic construct
WMGPFDY

SEQ ID NO: 31860 - protein, 7 aa, Artificial Sequence
  Synthetic construct
WMGPFVF

SEQ ID NO: 31861 - protein, 7 aa, Artificial Sequence
  Synthetic construct
WMGPFVY

SEQ ID NO: 31862 - protein, 7 aa, Artificial Sequence
  Synthetic construct
WMGPVFF

SEQ ID NO: 31863 - protein, 7 aa, Artificial Sequence
  Synthetic construct
WMGPVFY

SEQ ID NO: 31864 - protein, 7 aa, Artificial Sequence
  Synthetic construct
WMGPVRF

SEQ ID NO: 31865 - protein, 7 aa, Artificial Sequence
  Synthetic construct
WMGPVRY

SEQ ID NO: 31866 - protein, 7 aa, Artificial Sequence
  Synthetic construct
WMGPVCF

SEQ ID NO: 31867 - protein, 7 aa, Artificial Sequence
  Synthetic construct
WMGPVCY

SEQ ID NO: 31868 - protein, 7 aa, Artificial Sequence
  Synthetic construct
WMGPVLF

SEQ ID NO: 31869 - protein, 7 aa, Artificial Sequence
  Synthetic construct
WMGPVLY

SEQ ID NO: 31870 - protein, 7 aa, Artificial Sequence
  Synthetic construct
WMGPVAF

SEQ ID NO: 31871 - protein, 7 aa, Artificial Sequence
  Synthetic construct
WMGPVAY

SEQ ID NO: 31872 - protein, 7 aa, Artificial Sequence
  Synthetic construct
WMGPVQF

SEQ ID NO: 31873 - protein, 7 aa, Artificial Sequence
  Synthetic construct
WMGPVQY

SEQ ID NO: 31874 - protein, 7 aa, Artificial Sequence
  Synthetic construct
WMGPVDF

SEQ ID NO: 31875 - protein, 7 aa, Artificial Sequence
  Synthetic construct
WMGPVDY

SEQ ID NO: 31876 - protein, 7 aa, Artificial Sequence
  Synthetic construct
WMGPVVF

SEQ ID NO: 31877 - protein, 7 aa, Artificial Sequence
  Synthetic construct
WMGPVVY

SEQ ID NO: 31878 - protein, 7 aa, Artificial Sequence
  Synthetic construct
WMGPTFF

SEQ ID NO: 31879 - protein, 7 aa, Artificial Sequence
  Synthetic construct
WMGPTFY

SEQ ID NO: 31880 - protein, 7 aa, Artificial Sequence
  Synthetic construct
WMGPTRF

SEQ ID NO: 31881 - protein, 7 aa, Artificial Sequence
  Synthetic construct
WMGPTRY

SEQ ID NO: 31882 - protein, 7 aa, Artificial Sequence
  Synthetic construct
WMGPTCF

SEQ ID NO: 31883 - protein, 7 aa, Artificial Sequence
  Synthetic construct
WMGPTCY

SEQ ID NO: 31884 - protein, 7 aa, Artificial Sequence
  Synthetic construct
WMGPTLF

SEQ ID NO: 31885 - protein, 7 aa, Artificial Sequence
  Synthetic construct
WMGPTLY

SEQ ID NO: 31886 - protein, 7 aa, Artificial Sequence
  Synthetic construct
WMGPTAF

SEQ ID NO: 31887 - protein, 7 aa, Artificial Sequence
  Synthetic construct
WMGPTAY

SEQ ID NO: 31888 - protein, 7 aa, Artificial Sequence
  Synthetic construct
WMGPTQF

SEQ ID NO: 31889 - protein, 7 aa, Artificial Sequence
  Synthetic construct
WMGPTQY

SEQ ID NO: 31890 - protein, 7 aa, Artificial Sequence
  Synthetic construct
WMGPTDF

SEQ ID NO: 31891 - protein, 7 aa, Artificial Sequence
  Synthetic construct
WMGPTDY

SEQ ID NO: 31892 - protein, 7 aa, Artificial Sequence
  Synthetic construct
WMGPTVF

SEQ ID NO: 31893 - protein, 7 aa, Artificial Sequence
  Synthetic construct
WMGPTVY

SEQ ID NO: 31894 - protein, 7 aa, Artificial Sequence
  Synthetic construct
WMGPGFF

SEQ ID NO: 31895 - protein, 7 aa, Artificial Sequence
  Synthetic construct
WMGPGFY

SEQ ID NO: 31896 - protein, 7 aa, Artificial Sequence
  Synthetic construct
WMGPGRF

SEQ ID NO: 31897 - protein, 7 aa, Artificial Sequence
  Synthetic construct
WMGPGRY

SEQ ID NO: 31898 - protein, 7 aa, Artificial Sequence
  Synthetic construct
WMGPGCF

SEQ ID NO: 31899 - protein, 7 aa, Artificial Sequence
  Synthetic construct
WMGPGCY

SEQ ID NO: 31900 - protein, 7 aa, Artificial Sequence
  Synthetic construct
WMGPGLF

SEQ ID NO: 31901 - protein, 7 aa, Artificial Sequence
  Synthetic construct
WMGPGLY

SEQ ID NO: 31902 - protein, 7 aa, Artificial Sequence
  Synthetic construct
WMGPGAF

SEQ ID NO: 31903 - protein, 7 aa, Artificial Sequence
  Synthetic construct
WMGPGAY

SEQ ID NO: 31904 - protein, 7 aa, Artificial Sequence
  Synthetic construct
WMGPGQF

SEQ ID NO: 31905 - protein, 7 aa, Artificial Sequence
  Synthetic construct
WMGPGQY

SEQ ID NO: 31906 - protein, 7 aa, Artificial Sequence
  Synthetic construct
WMGPGDF

SEQ ID NO: 31907 - protein, 7 aa, Artificial Sequence
  Synthetic construct
WMGPGDY

SEQ ID NO: 31908 - protein, 7 aa, Artificial Sequence
  Synthetic construct
WMGPGVF

SEQ ID NO: 31909 - protein, 7 aa, Artificial Sequence
  Synthetic construct
WMGPGVY

SEQ ID NO: 31910 - protein, 7 aa, Artificial Sequence
  Synthetic construct
WMGPAFF

SEQ ID NO: 31911 - protein, 7 aa, Artificial Sequence
  Synthetic construct
WMGPAFY

SEQ ID NO: 31912 - protein, 7 aa, Artificial Sequence
  Synthetic construct
WMGPARF

SEQ ID NO: 31913 - protein, 7 aa, Artificial Sequence
  Synthetic construct
WMGPARY

SEQ ID NO: 31914 - protein, 7 aa, Artificial Sequence
  Synthetic construct
WMGPACF

SEQ ID NO: 31915 - protein, 7 aa, Artificial Sequence
  Synthetic construct
WMGPACY

SEQ ID NO: 31916 - protein, 7 aa, Artificial Sequence
  Synthetic construct
WMGPALF

SEQ ID NO: 31917 - protein, 7 aa, Artificial Sequence
  Synthetic construct
WMGPALY

SEQ ID NO: 31918 - protein, 7 aa, Artificial Sequence
  Synthetic construct
WMGPAAF

SEQ ID NO: 31919 - protein, 7 aa, Artificial Sequence
  Synthetic construct
WMGPAAY

SEQ ID NO: 31920 - protein, 7 aa, Artificial Sequence
  Synthetic construct
WMGPAQF

SEQ ID NO: 31921 - protein, 7 aa, Artificial Sequence
  Synthetic construct
WMGPAQY

SEQ ID NO: 31922 - protein, 7 aa, Artificial Sequence
  Synthetic construct
WMGPADF

SEQ ID NO: 31923 - protein, 7 aa, Artificial Sequence
  Synthetic construct
WMGPADY

SEQ ID NO: 31924 - protein, 7 aa, Artificial Sequence
  Synthetic construct
WMGPAVF

SEQ ID NO: 31925 - protein, 7 aa, Artificial Sequence
  Synthetic construct
WMGPAVY

SEQ ID NO: 31926 - protein, 7 aa, Artificial Sequence
  Synthetic construct
WMGPQFF

SEQ ID NO: 31927 - protein, 7 aa, Artificial Sequence
  Synthetic construct
WMGPQFY

SEQ ID NO: 31928 - protein, 7 aa, Artificial Sequence
  Synthetic construct
WMGPQRF

SEQ ID NO: 31929 - protein, 7 aa, Artificial Sequence
  Synthetic construct
WMGPQRY

SEQ ID NO: 31930 - protein, 7 aa, Artificial Sequence
  Synthetic construct
WMGPQCF

SEQ ID NO: 31931 - protein, 7 aa, Artificial Sequence
  Synthetic construct
WMGPQCY

SEQ ID NO: 31932 - protein, 7 aa, Artificial Sequence
  Synthetic construct
WMGPQLF

SEQ ID NO: 31933 - protein, 7 aa, Artificial Sequence
  Synthetic construct
WMGPQLY

SEQ ID NO: 31934 - protein, 7 aa, Artificial Sequence
  Synthetic construct
WMGPQAF

SEQ ID NO: 31935 - protein, 7 aa, Artificial Sequence
  Synthetic construct
WMGPQAY

SEQ ID NO: 31936 - protein, 7 aa, Artificial Sequence
  Synthetic construct
WMGPQQF

SEQ ID NO: 31937 - protein, 7 aa, Artificial Sequence
  Synthetic construct
WMGPQQY

SEQ ID NO: 31938 - protein, 7 aa, Artificial Sequence
  Synthetic construct
WMGPQDF

SEQ ID NO: 31939 - protein, 7 aa, Artificial Sequence
  Synthetic construct
WMGPQDY

SEQ ID NO: 31940 - protein, 7 aa, Artificial Sequence
  Synthetic construct
WMGPQVF

SEQ ID NO: 31941 - protein, 7 aa, Artificial Sequence
  Synthetic construct
WMGPQVY

SEQ ID NO: 31942 - protein, 7 aa, Artificial Sequence
  Synthetic construct
WMGHIFF

SEQ ID NO: 31943 - protein, 7 aa, Artificial Sequence
  Synthetic construct
WMGHIFY

SEQ ID NO: 31944 - protein, 7 aa, Artificial Sequence
  Synthetic construct
WMGHIRF

SEQ ID NO: 31945 - protein, 7 aa, Artificial Sequence
  Synthetic construct
WMGHIRY

SEQ ID NO: 31946 - protein, 7 aa, Artificial Sequence
  Synthetic construct
WMGHICF

SEQ ID NO: 31947 - protein, 7 aa, Artificial Sequence
  Synthetic construct
WMGHICY

SEQ ID NO: 31948 - protein, 7 aa, Artificial Sequence
  Synthetic construct
WMGHILF

SEQ ID NO: 31949 - protein, 7 aa, Artificial Sequence
  Synthetic construct
WMGHILY

SEQ ID NO: 31950 - protein, 7 aa, Artificial Sequence
  Synthetic construct
WMGHIAF

SEQ ID NO: 31951 - protein, 7 aa, Artificial Sequence
  Synthetic construct
WMGHIAY

SEQ ID NO: 31952 - protein, 7 aa, Artificial Sequence
  Synthetic construct
WMGHIQF

SEQ ID NO: 31953 - protein, 7 aa, Artificial Sequence
  Synthetic construct
WMGHIQY

SEQ ID NO: 31954 - protein, 7 aa, Artificial Sequence
  Synthetic construct
WMGHIDF

SEQ ID NO: 31955 - protein, 7 aa, Artificial Sequence
  Synthetic construct
WMGHIDY

SEQ ID NO: 31956 - protein, 7 aa, Artificial Sequence
  Synthetic construct
WMGHIVF

SEQ ID NO: 31957 - protein, 7 aa, Artificial Sequence
  Synthetic construct
WMGHIVY

SEQ ID NO: 31958 - protein, 7 aa, Artificial Sequence
  Synthetic construct
WMGHDFF

SEQ ID NO: 31959 - protein, 7 aa, Artificial Sequence
  Synthetic construct
WMGHDFY

SEQ ID NO: 31960 - protein, 7 aa, Artificial Sequence
  Synthetic construct
WMGHDRF

SEQ ID NO: 31961 - protein, 7 aa, Artificial Sequence
  Synthetic construct
WMGHDRY

SEQ ID NO: 31962 - protein, 7 aa, Artificial Sequence
  Synthetic construct
WMGHDCF

SEQ ID NO: 31963 - protein, 7 aa, Artificial Sequence
  Synthetic construct
WMGHDCY

SEQ ID NO: 31964 - protein, 7 aa, Artificial Sequence
  Synthetic construct
WMGHDLF

SEQ ID NO: 31965 - protein, 7 aa, Artificial Sequence
  Synthetic construct
WMGHDLY

SEQ ID NO: 31966 - protein, 7 aa, Artificial Sequence
  Synthetic construct
WMGHDAF

SEQ ID NO: 31967 - protein, 7 aa, Artificial Sequence
  Synthetic construct
WMGHDAY

SEQ ID NO: 31968 - protein, 7 aa, Artificial Sequence
  Synthetic construct
WMGHDQF

SEQ ID NO: 31969 - protein, 7 aa, Artificial Sequence
  Synthetic construct
WMGHDQY

SEQ ID NO: 31970 - protein, 7 aa, Artificial Sequence
  Synthetic construct
WMGHDDF

SEQ ID NO: 31971 - protein, 7 aa, Artificial Sequence
  Synthetic construct
WMGHDDY

SEQ ID NO: 31972 - protein, 7 aa, Artificial Sequence
  Synthetic construct
WMGHDVF

SEQ ID NO: 31973 - protein, 7 aa, Artificial Sequence
  Synthetic construct
WMGHDVY

SEQ ID NO: 31974 - protein, 7 aa, Artificial Sequence
  Synthetic construct
WMGHYFF

SEQ ID NO: 31975 - protein, 7 aa, Artificial Sequence
  Synthetic construct
WMGHYFY

SEQ ID NO: 31976 - protein, 7 aa, Artificial Sequence
  Synthetic construct
WMGHYRF

SEQ ID NO: 31977 - protein, 7 aa, Artificial Sequence
  Synthetic construct
WMGHYRY

SEQ ID NO: 31978 - protein, 7 aa, Artificial Sequence
  Synthetic construct
WMGHYCF

SEQ ID NO: 31979 - protein, 7 aa, Artificial Sequence
  Synthetic construct
WMGHYCY

SEQ ID NO: 31980 - protein, 7 aa, Artificial Sequence
  Synthetic construct
WMGHYLF

SEQ ID NO: 31981 - protein, 7 aa, Artificial Sequence
  Synthetic construct
WMGHYLY

SEQ ID NO: 31982 - protein, 7 aa, Artificial Sequence
  Synthetic construct
WMGHYAF

SEQ ID NO: 31983 - protein, 7 aa, Artificial Sequence
  Synthetic construct
WMGHYAY

SEQ ID NO: 31984 - protein, 7 aa, Artificial Sequence
  Synthetic construct
WMGHYQF

SEQ ID NO: 31985 - protein, 7 aa, Artificial Sequence
  Synthetic construct
WMGHYQY

SEQ ID NO: 31986 - protein, 7 aa, Artificial Sequence
  Synthetic construct
WMGHYDF

SEQ ID NO: 31987 - protein, 7 aa, Artificial Sequence
  Synthetic construct
WMGHYDY

SEQ ID NO: 31988 - protein, 7 aa, Artificial Sequence
  Synthetic construct
WMGHYVF

SEQ ID NO: 31989 - protein, 7 aa, Artificial Sequence
  Synthetic construct
WMGHYVY

SEQ ID NO: 31990 - protein, 7 aa, Artificial Sequence
  Synthetic construct
WMGHFFF

SEQ ID NO: 31991 - protein, 7 aa, Artificial Sequence
  Synthetic construct
WMGHFFY

SEQ ID NO: 31992 - protein, 7 aa, Artificial Sequence
  Synthetic construct
WMGHFRF

SEQ ID NO: 31993 - protein, 7 aa, Artificial Sequence
  Synthetic construct
WMGHFRY

SEQ ID NO: 31994 - protein, 7 aa, Artificial Sequence
  Synthetic construct
WMGHFCF

SEQ ID NO: 31995 - protein, 7 aa, Artificial Sequence
  Synthetic construct
WMGHFCY

SEQ ID NO: 31996 - protein, 7 aa, Artificial Sequence
  Synthetic construct
WMGHFLF

SEQ ID NO: 31997 - protein, 7 aa, Artificial Sequence
  Synthetic construct
WMGHFLY

SEQ ID NO: 31998 - protein, 7 aa, Artificial Sequence
  Synthetic construct
WMGHFAF

SEQ ID NO: 31999 - protein, 7 aa, Artificial Sequence
  Synthetic construct
WMGHFAY

SEQ ID NO: 32000 - protein, 7 aa, Artificial Sequence
  Synthetic construct
WMGHFQF

SEQ ID NO: 32001 - protein, 7 aa, Artificial Sequence
  Synthetic construct
WMGHFQY

SEQ ID NO: 32002 - protein, 7 aa, Artificial Sequence
  Synthetic construct
WMGHFDF

SEQ ID NO: 32003 - protein, 7 aa, Artificial Sequence
  Synthetic construct
WMGHFDY

SEQ ID NO: 32004 - protein, 7 aa, Artificial Sequence
  Synthetic construct
WMGHFVF

SEQ ID NO: 32005 - protein, 7 aa, Artificial Sequence
  Synthetic construct
WMGHFVY

SEQ ID NO: 32006 - protein, 7 aa, Artificial Sequence
  Synthetic construct
WMGHVFF

SEQ ID NO: 32007 - protein, 7 aa, Artificial Sequence
  Synthetic construct
WMGHVFY

SEQ ID NO: 32008 - protein, 7 aa, Artificial Sequence
  Synthetic construct
WMGHVRF

SEQ ID NO: 32009 - protein, 7 aa, Artificial Sequence
  Synthetic construct
WMGHVRY

SEQ ID NO: 32010 - protein, 7 aa, Artificial Sequence
  Synthetic construct
WMGHVCF

SEQ ID NO: 32011 - protein, 7 aa, Artificial Sequence
  Synthetic construct
WMGHVCY

SEQ ID NO: 32012 - protein, 7 aa, Artificial Sequence
  Synthetic construct
WMGHVLF

SEQ ID NO: 32013 - protein, 7 aa, Artificial Sequence
  Synthetic construct
WMGHVLY

SEQ ID NO: 32014 - protein, 7 aa, Artificial Sequence
  Synthetic construct
WMGHVAF

SEQ ID NO: 32015 - protein, 7 aa, Artificial Sequence
  Synthetic construct
WMGHVAY

SEQ ID NO: 32016 - protein, 7 aa, Artificial Sequence
  Synthetic construct
WMGHVQF

SEQ ID NO: 32017 - protein, 7 aa, Artificial Sequence
  Synthetic construct
WMGHVQY

SEQ ID NO: 32018 - protein, 7 aa, Artificial Sequence
  Synthetic construct
WMGHVDF

SEQ ID NO: 32019 - protein, 7 aa, Artificial Sequence
  Synthetic construct
WMGHVDY

SEQ ID NO: 32020 - protein, 7 aa, Artificial Sequence
  Synthetic construct
WMGHVVF

SEQ ID NO: 32021 - protein, 7 aa, Artificial Sequence
  Synthetic construct
WMGHVVY

SEQ ID NO: 32022 - protein, 7 aa, Artificial Sequence
  Synthetic construct
WMGHTFF

SEQ ID NO: 32023 - protein, 7 aa, Artificial Sequence
  Synthetic construct
WMGHTFY

SEQ ID NO: 32024 - protein, 7 aa, Artificial Sequence
  Synthetic construct
WMGHTRF

SEQ ID NO: 32025 - protein, 7 aa, Artificial Sequence
  Synthetic construct
WMGHTRY

SEQ ID NO: 32026 - protein, 7 aa, Artificial Sequence
  Synthetic construct
WMGHTCF

SEQ ID NO: 32027 - protein, 7 aa, Artificial Sequence
  Synthetic construct
WMGHTCY

SEQ ID NO: 32028 - protein, 7 aa, Artificial Sequence
  Synthetic construct
WMGHTLF

SEQ ID NO: 32029 - protein, 7 aa, Artificial Sequence
  Synthetic construct
WMGHTLY

SEQ ID NO: 32030 - protein, 7 aa, Artificial Sequence
  Synthetic construct
WMGHTAF

SEQ ID NO: 32031 - protein, 7 aa, Artificial Sequence
  Synthetic construct
WMGHTAY

SEQ ID NO: 32032 - protein, 7 aa, Artificial Sequence
  Synthetic construct
WMGHTQF

SEQ ID NO: 32033 - protein, 7 aa, Artificial Sequence
  Synthetic construct
WMGHTQY

SEQ ID NO: 32034 - protein, 7 aa, Artificial Sequence
  Synthetic construct
WMGHTDF

SEQ ID NO: 32035 - protein, 7 aa, Artificial Sequence
  Synthetic construct
WMGHTDY

SEQ ID NO: 32036 - protein, 7 aa, Artificial Sequence
  Synthetic construct
WMGHTVF

SEQ ID NO: 32037 - protein, 7 aa, Artificial Sequence
  Synthetic construct
WMGHTVY

SEQ ID NO: 32038 - protein, 7 aa, Artificial Sequence
  Synthetic construct
WMGHGFF

SEQ ID NO: 32039 - protein, 7 aa, Artificial Sequence
  Synthetic construct
WMGHGFY

SEQ ID NO: 32040 - protein, 7 aa, Artificial Sequence
  Synthetic construct
WMGHGRF

SEQ ID NO: 32041 - protein, 7 aa, Artificial Sequence
  Synthetic construct
WMGHGRY

SEQ ID NO: 32042 - protein, 7 aa, Artificial Sequence
  Synthetic construct
WMGHGCF

SEQ ID NO: 32043 - protein, 7 aa, Artificial Sequence
  Synthetic construct
WMGHGCY

SEQ ID NO: 32044 - protein, 7 aa, Artificial Sequence
  Synthetic construct
WMGHGLF

SEQ ID NO: 32045 - protein, 7 aa, Artificial Sequence
  Synthetic construct
WMGHGLY

SEQ ID NO: 32046 - protein, 7 aa, Artificial Sequence
  Synthetic construct
WMGHGAF

SEQ ID NO: 32047 - protein, 7 aa, Artificial Sequence
  Synthetic construct
WMGHGAY

SEQ ID NO: 32048 - protein, 7 aa, Artificial Sequence
  Synthetic construct
WMGHGQF

SEQ ID NO: 32049 - protein, 7 aa, Artificial Sequence
  Synthetic construct
WMGHGQY

SEQ ID NO: 32050 - protein, 7 aa, Artificial Sequence
  Synthetic construct
WMGHGDF

SEQ ID NO: 32051 - protein, 7 aa, Artificial Sequence
  Synthetic construct
WMGHGDY

SEQ ID NO: 32052 - protein, 7 aa, Artificial Sequence
  Synthetic construct
WMGHGVF

SEQ ID NO: 32053 - protein, 7 aa, Artificial Sequence
  Synthetic construct
WMGHGVY

SEQ ID NO: 32054 - protein, 7 aa, Artificial Sequence
  Synthetic construct
WMGHAFF

SEQ ID NO: 32055 - protein, 7 aa, Artificial Sequence
  Synthetic construct
WMGHAFY

SEQ ID NO: 32056 - protein, 7 aa, Artificial Sequence
  Synthetic construct
WMGHARF

SEQ ID NO: 32057 - protein, 7 aa, Artificial Sequence
  Synthetic construct
WMGHARY

SEQ ID NO: 32058 - protein, 7 aa, Artificial Sequence
  Synthetic construct
WMGHACF

SEQ ID NO: 32059 - protein, 7 aa, Artificial Sequence
  Synthetic construct
WMGHACY

SEQ ID NO: 32060 - protein, 7 aa, Artificial Sequence
  Synthetic construct
WMGHALF

SEQ ID NO: 32061 - protein, 7 aa, Artificial Sequence
  Synthetic construct
WMGHALY

SEQ ID NO: 32062 - protein, 7 aa, Artificial Sequence
  Synthetic construct
WMGHAAF

SEQ ID NO: 32063 - protein, 7 aa, Artificial Sequence
  Synthetic construct
WMGHAAY

SEQ ID NO: 32064 - protein, 7 aa, Artificial Sequence
  Synthetic construct
WMGHAQF

SEQ ID NO: 32065 - protein, 7 aa, Artificial Sequence
  Synthetic construct
WMGHAQY

SEQ ID NO: 32066 - protein, 7 aa, Artificial Sequence
  Synthetic construct
WMGHADF

SEQ ID NO: 32067 - protein, 7 aa, Artificial Sequence
  Synthetic construct
WMGHADY

SEQ ID NO: 32068 - protein, 7 aa, Artificial Sequence
  Synthetic construct
WMGHAVF

SEQ ID NO: 32069 - protein, 7 aa, Artificial Sequence
  Synthetic construct
WMGHAVY

SEQ ID NO: 32070 - protein, 7 aa, Artificial Sequence
  Synthetic construct
WMGHQFF

SEQ ID NO: 32071 - protein, 7 aa, Artificial Sequence
  Synthetic construct
WMGHQFY

SEQ ID NO: 32072 - protein, 7 aa, Artificial Sequence
  Synthetic construct
WMGHQRF

SEQ ID NO: 32073 - protein, 7 aa, Artificial Sequence
  Synthetic construct
WMGHQRY

SEQ ID NO: 32074 - protein, 7 aa, Artificial Sequence
  Synthetic construct
WMGHQCF

SEQ ID NO: 32075 - protein, 7 aa, Artificial Sequence
  Synthetic construct
WMGHQCY

SEQ ID NO: 32076 - protein, 7 aa, Artificial Sequence
  Synthetic construct
WMGHQLF

SEQ ID NO: 32077 - protein, 7 aa, Artificial Sequence
  Synthetic construct
WMGHQLY

SEQ ID NO: 32078 - protein, 7 aa, Artificial Sequence
  Synthetic construct
WMGHQAF

SEQ ID NO: 32079 - protein, 7 aa, Artificial Sequence
  Synthetic construct
WMGHQAY

SEQ ID NO: 32080 - protein, 7 aa, Artificial Sequence
  Synthetic construct
WMGHQQF

SEQ ID NO: 32081 - protein, 7 aa, Artificial Sequence
  Synthetic construct
WMGHQQY

SEQ ID NO: 32082 - protein, 7 aa, Artificial Sequence
  Synthetic construct
WMGHQDF

SEQ ID NO: 32083 - protein, 7 aa, Artificial Sequence
  Synthetic construct
WMGHQDY

SEQ ID NO: 32084 - protein, 7 aa, Artificial Sequence
  Synthetic construct
WMGHQVF

SEQ ID NO: 32085 - protein, 7 aa, Artificial Sequence
  Synthetic construct
WMGHQVY

SEQ ID NO: 32086 - protein, 7 aa, Artificial Sequence
  Synthetic construct
WMGLIFF

SEQ ID NO: 32087 - protein, 7 aa, Artificial Sequence
  Synthetic construct
WMGLIFY

SEQ ID NO: 32088 - protein, 7 aa, Artificial Sequence
  Synthetic construct
WMGLIRF

SEQ ID NO: 32089 - protein, 7 aa, Artificial Sequence
  Synthetic construct
WMGLIRY

SEQ ID NO: 32090 - protein, 7 aa, Artificial Sequence
  Synthetic construct
WMGLICF

SEQ ID NO: 32091 - protein, 7 aa, Artificial Sequence
  Synthetic construct
WMGLICY

SEQ ID NO: 32092 - protein, 7 aa, Artificial Sequence
  Synthetic construct
WMGLILF

SEQ ID NO: 32093 - protein, 7 aa, Artificial Sequence
  Synthetic construct
WMGLILY

SEQ ID NO: 32094 - protein, 7 aa, Artificial Sequence
  Synthetic construct
WMGLIAF

SEQ ID NO: 32095 - protein, 7 aa, Artificial Sequence
  Synthetic construct
WMGLIAY

SEQ ID NO: 32096 - protein, 7 aa, Artificial Sequence
  Synthetic construct
WMGLIQF

SEQ ID NO: 32097 - protein, 7 aa, Artificial Sequence
  Synthetic construct
WMGLIQY

SEQ ID NO: 32098 - protein, 7 aa, Artificial Sequence
  Synthetic construct
WMGLIDF

SEQ ID NO: 32099 - protein, 7 aa, Artificial Sequence
  Synthetic construct
WMGLIDY

SEQ ID NO: 32100 - protein, 7 aa, Artificial Sequence
  Synthetic construct
WMGLIVF

SEQ ID NO: 32101 - protein, 7 aa, Artificial Sequence
  Synthetic construct
WMGLIVY

SEQ ID NO: 32102 - protein, 7 aa, Artificial Sequence
  Synthetic construct
WMGLDFF

SEQ ID NO: 32103 - protein, 7 aa, Artificial Sequence
  Synthetic construct
WMGLDFY

SEQ ID NO: 32104 - protein, 7 aa, Artificial Sequence
  Synthetic construct
WMGLDRF

SEQ ID NO: 32105 - protein, 7 aa, Artificial Sequence
  Synthetic construct
WMGLDRY

SEQ ID NO: 32106 - protein, 7 aa, Artificial Sequence
  Synthetic construct
WMGLDCF

SEQ ID NO: 32107 - protein, 7 aa, Artificial Sequence
  Synthetic construct
WMGLDCY

SEQ ID NO: 32108 - protein, 7 aa, Artificial Sequence
  Synthetic construct
WMGLDLF

SEQ ID NO: 32109 - protein, 7 aa, Artificial Sequence
  Synthetic construct
WMGLDLY

SEQ ID NO: 32110 - protein, 7 aa, Artificial Sequence
  Synthetic construct
WMGLDAF

SEQ ID NO: 32111 - protein, 7 aa, Artificial Sequence
  Synthetic construct
WMGLDAY

SEQ ID NO: 32112 - protein, 7 aa, Artificial Sequence
  Synthetic construct
WMGLDQF

SEQ ID NO: 32113 - protein, 7 aa, Artificial Sequence
  Synthetic construct
WMGLDQY

SEQ ID NO: 32114 - protein, 7 aa, Artificial Sequence
  Synthetic construct
WMGLDDF

SEQ ID NO: 32115 - protein, 7 aa, Artificial Sequence
  Synthetic construct
WMGLDDY

SEQ ID NO: 32116 - protein, 7 aa, Artificial Sequence
  Synthetic construct
WMGLDVF

SEQ ID NO: 32117 - protein, 7 aa, Artificial Sequence
  Synthetic construct
WMGLDVY

SEQ ID NO: 32118 - protein, 7 aa, Artificial Sequence
  Synthetic construct
WMGLYFF

SEQ ID NO: 32119 - protein, 7 aa, Artificial Sequence
  Synthetic construct
WMGLYFY

SEQ ID NO: 32120 - protein, 7 aa, Artificial Sequence
  Synthetic construct
WMGLYRF

SEQ ID NO: 32121 - protein, 7 aa, Artificial Sequence
  Synthetic construct
WMGLYRY

SEQ ID NO: 32122 - protein, 7 aa, Artificial Sequence
  Synthetic construct
WMGLYCF

SEQ ID NO: 32123 - protein, 7 aa, Artificial Sequence
  Synthetic construct
WMGLYCY

SEQ ID NO: 32124 - protein, 7 aa, Artificial Sequence
  Synthetic construct
WMGLYLF

SEQ ID NO: 32125 - protein, 7 aa, Artificial Sequence
  Synthetic construct
WMGLYLY

SEQ ID NO: 32126 - protein, 7 aa, Artificial Sequence
  Synthetic construct
WMGLYAF

SEQ ID NO: 32127 - protein, 7 aa, Artificial Sequence
  Synthetic construct
WMGLYAY

SEQ ID NO: 32128 - protein, 7 aa, Artificial Sequence
  Synthetic construct
WMGLYQF

SEQ ID NO: 32129 - protein, 7 aa, Artificial Sequence
  Synthetic construct
WMGLYQY

SEQ ID NO: 32130 - protein, 7 aa, Artificial Sequence
  Synthetic construct
WMGLYDF

SEQ ID NO: 32131 - protein, 7 aa, Artificial Sequence
  Synthetic construct
WMGLYDY

SEQ ID NO: 32132 - protein, 7 aa, Artificial Sequence
  Synthetic construct
WMGLYVF

SEQ ID NO: 32133 - protein, 7 aa, Artificial Sequence
  Synthetic construct
WMGLYVY

SEQ ID NO: 32134 - protein, 7 aa, Artificial Sequence
  Synthetic construct
WMGLFFF

SEQ ID NO: 32135 - protein, 7 aa, Artificial Sequence
  Synthetic construct
WMGLFFY

SEQ ID NO: 32136 - protein, 7 aa, Artificial Sequence
  Synthetic construct
WMGLFRF

SEQ ID NO: 32137 - protein, 7 aa, Artificial Sequence
  Synthetic construct
WMGLFRY

SEQ ID NO: 32138 - protein, 7 aa, Artificial Sequence
  Synthetic construct
WMGLFCF

SEQ ID NO: 32139 - protein, 7 aa, Artificial Sequence
  Synthetic construct
WMGLFCY

SEQ ID NO: 32140 - protein, 7 aa, Artificial Sequence
  Synthetic construct
WMGLFLF

SEQ ID NO: 32141 - protein, 7 aa, Artificial Sequence
  Synthetic construct
WMGLFLY

SEQ ID NO: 32142 - protein, 7 aa, Artificial Sequence
  Synthetic construct
WMGLFAF

SEQ ID NO: 32143 - protein, 7 aa, Artificial Sequence
  Synthetic construct
WMGLFAY

SEQ ID NO: 32144 - protein, 7 aa, Artificial Sequence
  Synthetic construct
WMGLFQF

SEQ ID NO: 32145 - protein, 7 aa, Artificial Sequence
  Synthetic construct
WMGLFQY

SEQ ID NO: 32146 - protein, 7 aa, Artificial Sequence
  Synthetic construct
WMGLFDF

SEQ ID NO: 32147 - protein, 7 aa, Artificial Sequence
  Synthetic construct
WMGLFDY

SEQ ID NO: 32148 - protein, 7 aa, Artificial Sequence
  Synthetic construct
WMGLFVF

SEQ ID NO: 32149 - protein, 7 aa, Artificial Sequence
  Synthetic construct
WMGLFVY

SEQ ID NO: 32150 - protein, 7 aa, Artificial Sequence
  Synthetic construct
WMGLVFF

SEQ ID NO: 32151 - protein, 7 aa, Artificial Sequence
  Synthetic construct
WMGLVFY

SEQ ID NO: 32152 - protein, 7 aa, Artificial Sequence
  Synthetic construct
WMGLVRF

SEQ ID NO: 32153 - protein, 7 aa, Artificial Sequence
  Synthetic construct
WMGLVRY

SEQ ID NO: 32154 - protein, 7 aa, Artificial Sequence
  Synthetic construct
WMGLVCF

SEQ ID NO: 32155 - protein, 7 aa, Artificial Sequence
  Synthetic construct
WMGLVCY

SEQ ID NO: 32156 - protein, 7 aa, Artificial Sequence
  Synthetic construct
WMGLVLF

SEQ ID NO: 32157 - protein, 7 aa, Artificial Sequence
  Synthetic construct
WMGLVLY

SEQ ID NO: 32158 - protein, 7 aa, Artificial Sequence
  Synthetic construct
WMGLVAF

SEQ ID NO: 32159 - protein, 7 aa, Artificial Sequence
  Synthetic construct
WMGLVAY

SEQ ID NO: 32160 - protein, 7 aa, Artificial Sequence
  Synthetic construct
WMGLVQF

SEQ ID NO: 32161 - protein, 7 aa, Artificial Sequence
  Synthetic construct
WMGLVQY

SEQ ID NO: 32162 - protein, 7 aa, Artificial Sequence
  Synthetic construct
WMGLVDF

SEQ ID NO: 32163 - protein, 7 aa, Artificial Sequence
  Synthetic construct
WMGLVDY

SEQ ID NO: 32164 - protein, 7 aa, Artificial Sequence
  Synthetic construct
WMGLVVF

SEQ ID NO: 32165 - protein, 7 aa, Artificial Sequence
  Synthetic construct
WMGLVVY

SEQ ID NO: 32166 - protein, 7 aa, Artificial Sequence
  Synthetic construct
WMGLTFF

SEQ ID NO: 32167 - protein, 7 aa, Artificial Sequence
  Synthetic construct
WMGLTFY

SEQ ID NO: 32168 - protein, 7 aa, Artificial Sequence
  Synthetic construct
WMGLTRF

SEQ ID NO: 32169 - protein, 7 aa, Artificial Sequence
  Synthetic construct
WMGLTRY

SEQ ID NO: 32170 - protein, 7 aa, Artificial Sequence
  Synthetic construct
WMGLTCF

SEQ ID NO: 32171 - protein, 7 aa, Artificial Sequence
  Synthetic construct
WMGLTCY

SEQ ID NO: 32172 - protein, 7 aa, Artificial Sequence
  Synthetic construct
WMGLTLF

SEQ ID NO: 32173 - protein, 7 aa, Artificial Sequence
  Synthetic construct
WMGLTLY

SEQ ID NO: 32174 - protein, 7 aa, Artificial Sequence
  Synthetic construct
WMGLTAF

SEQ ID NO: 32175 - protein, 7 aa, Artificial Sequence
  Synthetic construct
WMGLTAY

SEQ ID NO: 32176 - protein, 7 aa, Artificial Sequence
  Synthetic construct
WMGLTQF

SEQ ID NO: 32177 - protein, 7 aa, Artificial Sequence
  Synthetic construct
WMGLTQY

SEQ ID NO: 32178 - protein, 7 aa, Artificial Sequence
  Synthetic construct
WMGLTDF

SEQ ID NO: 32179 - protein, 7 aa, Artificial Sequence
  Synthetic construct
WMGLTDY

SEQ ID NO: 32180 - protein, 7 aa, Artificial Sequence
  Synthetic construct
WMGLTVF

SEQ ID NO: 32181 - protein, 7 aa, Artificial Sequence
  Synthetic construct
WMGLTVY

SEQ ID NO: 32182 - protein, 7 aa, Artificial Sequence
  Synthetic construct
WMGLGFF

SEQ ID NO: 32183 - protein, 7 aa, Artificial Sequence
  Synthetic construct
WMGLGFY

SEQ ID NO: 32184 - protein, 7 aa, Artificial Sequence
  Synthetic construct
WMGLGRF

SEQ ID NO: 32185 - protein, 7 aa, Artificial Sequence
  Synthetic construct
WMGLGRY

SEQ ID NO: 32186 - protein, 7 aa, Artificial Sequence
  Synthetic construct
WMGLGCF

SEQ ID NO: 32187 - protein, 7 aa, Artificial Sequence
  Synthetic construct
WMGLGCY

SEQ ID NO: 32188 - protein, 7 aa, Artificial Sequence
  Synthetic construct
WMGLGLF

SEQ ID NO: 32189 - protein, 7 aa, Artificial Sequence
  Synthetic construct
WMGLGLY

SEQ ID NO: 32190 - protein, 7 aa, Artificial Sequence
  Synthetic construct
WMGLGAF

SEQ ID NO: 32191 - protein, 7 aa, Artificial Sequence
  Synthetic construct
WMGLGAY

SEQ ID NO: 32192 - protein, 7 aa, Artificial Sequence
  Synthetic construct
WMGLGQF

SEQ ID NO: 32193 - protein, 7 aa, Artificial Sequence
  Synthetic construct
WMGLGQY

SEQ ID NO: 32194 - protein, 7 aa, Artificial Sequence
  Synthetic construct
WMGLGDF

SEQ ID NO: 32195 - protein, 7 aa, Artificial Sequence
  Synthetic construct
WMGLGDY

SEQ ID NO: 32196 - protein, 7 aa, Artificial Sequence
  Synthetic construct
WMGLGVF

SEQ ID NO: 32197 - protein, 7 aa, Artificial Sequence
  Synthetic construct
WMGLGVY

SEQ ID NO: 32198 - protein, 7 aa, Artificial Sequence
  Synthetic construct
WMGLAFF

SEQ ID NO: 32199 - protein, 7 aa, Artificial Sequence
  Synthetic construct
WMGLAFY

SEQ ID NO: 32200 - protein, 7 aa, Artificial Sequence
  Synthetic construct
WMGLARF

SEQ ID NO: 32201 - protein, 7 aa, Artificial Sequence
  Synthetic construct
WMGLARY

SEQ ID NO: 32202 - protein, 7 aa, Artificial Sequence
  Synthetic construct
WMGLACF

SEQ ID NO: 32203 - protein, 7 aa, Artificial Sequence
  Synthetic construct
WMGLACY

SEQ ID NO: 32204 - protein, 7 aa, Artificial Sequence
  Synthetic construct
WMGLALF

SEQ ID NO: 32205 - protein, 7 aa, Artificial Sequence
  Synthetic construct
WMGLALY

SEQ ID NO: 32206 - protein, 7 aa, Artificial Sequence
  Synthetic construct
WMGLAAF

SEQ ID NO: 32207 - protein, 7 aa, Artificial Sequence
  Synthetic construct
WMGLAAY

SEQ ID NO: 32208 - protein, 7 aa, Artificial Sequence
  Synthetic construct
WMGLAQF

SEQ ID NO: 32209 - protein, 7 aa, Artificial Sequence
  Synthetic construct
WMGLAQY

SEQ ID NO: 32210 - protein, 7 aa, Artificial Sequence
  Synthetic construct
WMGLADF

SEQ ID NO: 32211 - protein, 7 aa, Artificial Sequence
  Synthetic construct
WMGLADY

SEQ ID NO: 32212 - protein, 7 aa, Artificial Sequence
  Synthetic construct
WMGLAVF

SEQ ID NO: 32213 - protein, 7 aa, Artificial Sequence
  Synthetic construct
WMGLAVY

SEQ ID NO: 32214 - protein, 7 aa, Artificial Sequence
  Synthetic construct
WMGLQFF

SEQ ID NO: 32215 - protein, 7 aa, Artificial Sequence
  Synthetic construct
WMGLQFY

SEQ ID NO: 32216 - protein, 7 aa, Artificial Sequence
  Synthetic construct
WMGLQRF

SEQ ID NO: 32217 - protein, 7 aa, Artificial Sequence
  Synthetic construct
WMGLQRY

SEQ ID NO: 32218 - protein, 7 aa, Artificial Sequence
  Synthetic construct
WMGLQCF

SEQ ID NO: 32219 - protein, 7 aa, Artificial Sequence
  Synthetic construct
WMGLQCY

SEQ ID NO: 32220 - protein, 7 aa, Artificial Sequence
  Synthetic construct
WMGLQLF

SEQ ID NO: 32221 - protein, 7 aa, Artificial Sequence
  Synthetic construct
WMGLQLY

SEQ ID NO: 32222 - protein, 7 aa, Artificial Sequence
  Synthetic construct
WMGLQAF

SEQ ID NO: 32223 - protein, 7 aa, Artificial Sequence
  Synthetic construct
WMGLQAY

SEQ ID NO: 32224 - protein, 7 aa, Artificial Sequence
  Synthetic construct
WMGLQQF

SEQ ID NO: 32225 - protein, 7 aa, Artificial Sequence
  Synthetic construct
WMGLQQY

SEQ ID NO: 32226 - protein, 7 aa, Artificial Sequence
  Synthetic construct
WMGLQDF

SEQ ID NO: 32227 - protein, 7 aa, Artificial Sequence
  Synthetic construct
WMGLQDY

SEQ ID NO: 32228 - protein, 7 aa, Artificial Sequence
  Synthetic construct
WMGLQVF

SEQ ID NO: 32229 - protein, 7 aa, Artificial Sequence
  Synthetic construct
WMGLQVY

SEQ ID NO: 32230 - protein, 7 aa, Artificial Sequence
  Synthetic construct
WMGFIFF

SEQ ID NO: 32231 - protein, 7 aa, Artificial Sequence
  Synthetic construct
WMGFIFY

SEQ ID NO: 32232 - protein, 7 aa, Artificial Sequence
  Synthetic construct
WMGFIRF

SEQ ID NO: 32233 - protein, 7 aa, Artificial Sequence
  Synthetic construct
WMGFIRY

SEQ ID NO: 32234 - protein, 7 aa, Artificial Sequence
  Synthetic construct
WMGFICF

SEQ ID NO: 32235 - protein, 7 aa, Artificial Sequence
  Synthetic construct
WMGFICY

SEQ ID NO: 32236 - protein, 7 aa, Artificial Sequence
  Synthetic construct
WMGFILF

SEQ ID NO: 32237 - protein, 7 aa, Artificial Sequence
  Synthetic construct
WMGFILY

SEQ ID NO: 32238 - protein, 7 aa, Artificial Sequence
  Synthetic construct
WMGFIAF

SEQ ID NO: 32239 - protein, 7 aa, Artificial Sequence
  Synthetic construct
WMGFIAY

SEQ ID NO: 32240 - protein, 7 aa, Artificial Sequence
  Synthetic construct
WMGFIQF

SEQ ID NO: 32241 - protein, 7 aa, Artificial Sequence
  Synthetic construct
WMGFIQY

SEQ ID NO: 32242 - protein, 7 aa, Artificial Sequence
  Synthetic construct
WMGFIDF

SEQ ID NO: 32243 - protein, 7 aa, Artificial Sequence
  Synthetic construct
WMGFIDY

SEQ ID NO: 32244 - protein, 7 aa, Artificial Sequence
  Synthetic construct
WMGFIVF

SEQ ID NO: 32245 - protein, 7 aa, Artificial Sequence
  Synthetic construct
WMGFIVY

SEQ ID NO: 32246 - protein, 7 aa, Artificial Sequence
  Synthetic construct
WMGFDFF

SEQ ID NO: 32247 - protein, 7 aa, Artificial Sequence
  Synthetic construct
WMGFDFY

SEQ ID NO: 32248 - protein, 7 aa, Artificial Sequence
  Synthetic construct
WMGFDRF

SEQ ID NO: 32249 - protein, 7 aa, Artificial Sequence
  Synthetic construct
WMGFDRY

SEQ ID NO: 32250 - protein, 7 aa, Artificial Sequence
  Synthetic construct
WMGFDCF

SEQ ID NO: 32251 - protein, 7 aa, Artificial Sequence
  Synthetic construct
WMGFDCY

SEQ ID NO: 32252 - protein, 7 aa, Artificial Sequence
  Synthetic construct
WMGFDLF

SEQ ID NO: 32253 - protein, 7 aa, Artificial Sequence
  Synthetic construct
WMGFDLY

SEQ ID NO: 32254 - protein, 7 aa, Artificial Sequence
  Synthetic construct
WMGFDAF

SEQ ID NO: 32255 - protein, 7 aa, Artificial Sequence
  Synthetic construct
WMGFDAY

SEQ ID NO: 32256 - protein, 7 aa, Artificial Sequence
  Synthetic construct
WMGFDQF

SEQ ID NO: 32257 - protein, 7 aa, Artificial Sequence
  Synthetic construct
WMGFDQY

SEQ ID NO: 32258 - protein, 7 aa, Artificial Sequence
  Synthetic construct
WMGFDDF

SEQ ID NO: 32259 - protein, 7 aa, Artificial Sequence
  Synthetic construct
WMGFDDY

SEQ ID NO: 32260 - protein, 7 aa, Artificial Sequence
  Synthetic construct
WMGFDVF

SEQ ID NO: 32261 - protein, 7 aa, Artificial Sequence
  Synthetic construct
WMGFDVY

SEQ ID NO: 32262 - protein, 7 aa, Artificial Sequence
  Synthetic construct
WMGFYFF

SEQ ID NO: 32263 - protein, 7 aa, Artificial Sequence
  Synthetic construct
WMGFYFY

SEQ ID NO: 32264 - protein, 7 aa, Artificial Sequence
  Synthetic construct
WMGFYRF

SEQ ID NO: 32265 - protein, 7 aa, Artificial Sequence
  Synthetic construct
WMGFYRY

SEQ ID NO: 32266 - protein, 7 aa, Artificial Sequence
  Synthetic construct
WMGFYCF

SEQ ID NO: 32267 - protein, 7 aa, Artificial Sequence
  Synthetic construct
WMGFYCY

SEQ ID NO: 32268 - protein, 7 aa, Artificial Sequence
  Synthetic construct
WMGFYLF

SEQ ID NO: 32269 - protein, 7 aa, Artificial Sequence
  Synthetic construct
WMGFYLY

SEQ ID NO: 32270 - protein, 7 aa, Artificial Sequence
  Synthetic construct
WMGFYAF

SEQ ID NO: 32271 - protein, 7 aa, Artificial Sequence
  Synthetic construct
WMGFYAY

SEQ ID NO: 32272 - protein, 7 aa, Artificial Sequence
  Synthetic construct
WMGFYQF

SEQ ID NO: 32273 - protein, 7 aa, Artificial Sequence
  Synthetic construct
WMGFYQY

SEQ ID NO: 32274 - protein, 7 aa, Artificial Sequence
  Synthetic construct
WMGFYDF

SEQ ID NO: 32275 - protein, 7 aa, Artificial Sequence
  Synthetic construct
WMGFYDY

SEQ ID NO: 32276 - protein, 7 aa, Artificial Sequence
  Synthetic construct
WMGFYVF

SEQ ID NO: 32277 - protein, 7 aa, Artificial Sequence
  Synthetic construct
WMGFYVY

SEQ ID NO: 32278 - protein, 7 aa, Artificial Sequence
  Synthetic construct
WMGFFFF

SEQ ID NO: 32279 - protein, 7 aa, Artificial Sequence
  Synthetic construct
WMGFFFY

SEQ ID NO: 32280 - protein, 7 aa, Artificial Sequence
  Synthetic construct
WMGFFRF

SEQ ID NO: 32281 - protein, 7 aa, Artificial Sequence
  Synthetic construct
WMGFFRY

SEQ ID NO: 32282 - protein, 7 aa, Artificial Sequence
  Synthetic construct
WMGFFCF

SEQ ID NO: 32283 - protein, 7 aa, Artificial Sequence
  Synthetic construct
WMGFFCY

SEQ ID NO: 32284 - protein, 7 aa, Artificial Sequence
  Synthetic construct
WMGFFLF

SEQ ID NO: 32285 - protein, 7 aa, Artificial Sequence
  Synthetic construct
WMGFFLY

SEQ ID NO: 32286 - protein, 7 aa, Artificial Sequence
  Synthetic construct
WMGFFAF

SEQ ID NO: 32287 - protein, 7 aa, Artificial Sequence
  Synthetic construct
WMGFFAY

SEQ ID NO: 32288 - protein, 7 aa, Artificial Sequence
  Synthetic construct
WMGFFQF

SEQ ID NO: 32289 - protein, 7 aa, Artificial Sequence
  Synthetic construct
WMGFFQY

SEQ ID NO: 32290 - protein, 7 aa, Artificial Sequence
  Synthetic construct
WMGFFDF

SEQ ID NO: 32291 - protein, 7 aa, Artificial Sequence
  Synthetic construct
WMGFFDY

SEQ ID NO: 32292 - protein, 7 aa, Artificial Sequence
  Synthetic construct
WMGFFVF

SEQ ID NO: 32293 - protein, 7 aa, Artificial Sequence
  Synthetic construct
WMGFFVY

SEQ ID NO: 32294 - protein, 7 aa, Artificial Sequence
  Synthetic construct
WMGFVFF

SEQ ID NO: 32295 - protein, 7 aa, Artificial Sequence
  Synthetic construct
WMGFVFY

SEQ ID NO: 32296 - protein, 7 aa, Artificial Sequence
  Synthetic construct
WMGFVRF

SEQ ID NO: 32297 - protein, 7 aa, Artificial Sequence
  Synthetic construct
WMGFVRY

SEQ ID NO: 32298 - protein, 7 aa, Artificial Sequence
  Synthetic construct
WMGFVCF

SEQ ID NO: 32299 - protein, 7 aa, Artificial Sequence
  Synthetic construct
WMGFVCY

SEQ ID NO: 32300 - protein, 7 aa, Artificial Sequence
  Synthetic construct
WMGFVLF

SEQ ID NO: 32301 - protein, 7 aa, Artificial Sequence
  Synthetic construct
WMGFVLY

SEQ ID NO: 32302 - protein, 7 aa, Artificial Sequence
  Synthetic construct
WMGFVAF

SEQ ID NO: 32303 - protein, 7 aa, Artificial Sequence
  Synthetic construct
WMGFVAY

SEQ ID NO: 32304 - protein, 7 aa, Artificial Sequence
  Synthetic construct
WMGFVQF

SEQ ID NO: 32305 - protein, 7 aa, Artificial Sequence
  Synthetic construct
WMGFVQY

SEQ ID NO: 32306 - protein, 7 aa, Artificial Sequence
  Synthetic construct
WMGFVDF

SEQ ID NO: 32307 - protein, 7 aa, Artificial Sequence
  Synthetic construct
WMGFVDY

SEQ ID NO: 32308 - protein, 7 aa, Artificial Sequence
  Synthetic construct
WMGFVVF

SEQ ID NO: 32309 - protein, 7 aa, Artificial Sequence
  Synthetic construct
WMGFVVY

SEQ ID NO: 32310 - protein, 7 aa, Artificial Sequence
  Synthetic construct
WMGFTFF

SEQ ID NO: 32311 - protein, 7 aa, Artificial Sequence
  Synthetic construct
WMGFTFY

SEQ ID NO: 32312 - protein, 7 aa, Artificial Sequence
  Synthetic construct
WMGFTRF

SEQ ID NO: 32313 - protein, 7 aa, Artificial Sequence
  Synthetic construct
WMGFTRY

SEQ ID NO: 32314 - protein, 7 aa, Artificial Sequence
  Synthetic construct
WMGFTCF

SEQ ID NO: 32315 - protein, 7 aa, Artificial Sequence
  Synthetic construct
WMGFTCY

SEQ ID NO: 32316 - protein, 7 aa, Artificial Sequence
  Synthetic construct
WMGFTLF

SEQ ID NO: 32317 - protein, 7 aa, Artificial Sequence
  Synthetic construct
WMGFTLY

SEQ ID NO: 32318 - protein, 7 aa, Artificial Sequence
  Synthetic construct
WMGFTAF

SEQ ID NO: 32319 - protein, 7 aa, Artificial Sequence
  Synthetic construct
WMGFTAY

SEQ ID NO: 32320 - protein, 7 aa, Artificial Sequence
  Synthetic construct
WMGFTQF

SEQ ID NO: 32321 - protein, 7 aa, Artificial Sequence
  Synthetic construct
WMGFTQY

SEQ ID NO: 32322 - protein, 7 aa, Artificial Sequence
  Synthetic construct
WMGFTDF

SEQ ID NO: 32323 - protein, 7 aa, Artificial Sequence
  Synthetic construct
WMGFTDY

SEQ ID NO: 32324 - protein, 7 aa, Artificial Sequence
  Synthetic construct
WMGFTVF

SEQ ID NO: 32325 - protein, 7 aa, Artificial Sequence
  Synthetic construct
WMGFTVY

SEQ ID NO: 32326 - protein, 7 aa, Artificial Sequence
  Synthetic construct
WMGFGFF

SEQ ID NO: 32327 - protein, 7 aa, Artificial Sequence
  Synthetic construct
WMGFGFY

SEQ ID NO: 32328 - protein, 7 aa, Artificial Sequence
  Synthetic construct
WMGFGRF

SEQ ID NO: 32329 - protein, 7 aa, Artificial Sequence
  Synthetic construct
WMGFGRY

SEQ ID NO: 32330 - protein, 7 aa, Artificial Sequence
  Synthetic construct
WMGFGCF

SEQ ID NO: 32331 - protein, 7 aa, Artificial Sequence
  Synthetic construct
WMGFGCY

SEQ ID NO: 32332 - protein, 7 aa, Artificial Sequence
  Synthetic construct
WMGFGLF

SEQ ID NO: 32333 - protein, 7 aa, Artificial Sequence
  Synthetic construct
WMGFGLY

SEQ ID NO: 32334 - protein, 7 aa, Artificial Sequence
  Synthetic construct
WMGFGAF

SEQ ID NO: 32335 - protein, 7 aa, Artificial Sequence
  Synthetic construct
WMGFGAY

SEQ ID NO: 32336 - protein, 7 aa, Artificial Sequence
  Synthetic construct
WMGFGQF

SEQ ID NO: 32337 - protein, 7 aa, Artificial Sequence
  Synthetic construct
WMGFGQY

SEQ ID NO: 32338 - protein, 7 aa, Artificial Sequence
  Synthetic construct
WMGFGDF

SEQ ID NO: 32339 - protein, 7 aa, Artificial Sequence
  Synthetic construct
WMGFGDY

SEQ ID NO: 32340 - protein, 7 aa, Artificial Sequence
  Synthetic construct
WMGFGVF

SEQ ID NO: 32341 - protein, 7 aa, Artificial Sequence
  Synthetic construct
WMGFGVY

SEQ ID NO: 32342 - protein, 7 aa, Artificial Sequence
  Synthetic construct
WMGFAFF

SEQ ID NO: 32343 - protein, 7 aa, Artificial Sequence
  Synthetic construct
WMGFAFY

SEQ ID NO: 32344 - protein, 7 aa, Artificial Sequence
  Synthetic construct
WMGFARF

SEQ ID NO: 32345 - protein, 7 aa, Artificial Sequence
  Synthetic construct
WMGFARY

SEQ ID NO: 32346 - protein, 7 aa, Artificial Sequence
  Synthetic construct
WMGFACF

SEQ ID NO: 32347 - protein, 7 aa, Artificial Sequence
  Synthetic construct
WMGFACY

SEQ ID NO: 32348 - protein, 7 aa, Artificial Sequence
  Synthetic construct
WMGFALF

SEQ ID NO: 32349 - protein, 7 aa, Artificial Sequence
  Synthetic construct
WMGFALY

SEQ ID NO: 32350 - protein, 7 aa, Artificial Sequence
  Synthetic construct
WMGFAAF

SEQ ID NO: 32351 - protein, 7 aa, Artificial Sequence
  Synthetic construct
WMGFAAY

SEQ ID NO: 32352 - protein, 7 aa, Artificial Sequence
  Synthetic construct
WMGFAQF

SEQ ID NO: 32353 - protein, 7 aa, Artificial Sequence
  Synthetic construct
WMGFAQY

SEQ ID NO: 32354 - protein, 7 aa, Artificial Sequence
  Synthetic construct
WMGFADF

SEQ ID NO: 32355 - protein, 7 aa, Artificial Sequence
  Synthetic construct
WMGFADY

SEQ ID NO: 32356 - protein, 7 aa, Artificial Sequence
  Synthetic construct
WMGFAVF

SEQ ID NO: 32357 - protein, 7 aa, Artificial Sequence
  Synthetic construct
WMGFAVY

SEQ ID NO: 32358 - protein, 7 aa, Artificial Sequence
  Synthetic construct
WMGFQFF

SEQ ID NO: 32359 - protein, 7 aa, Artificial Sequence
  Synthetic construct
WMGFQFY

SEQ ID NO: 32360 - protein, 7 aa, Artificial Sequence
  Synthetic construct
WMGFQRF

SEQ ID NO: 32361 - protein, 7 aa, Artificial Sequence
  Synthetic construct
WMGFQRY

SEQ ID NO: 32362 - protein, 7 aa, Artificial Sequence
  Synthetic construct
WMGFQCF

SEQ ID NO: 32363 - protein, 7 aa, Artificial Sequence
  Synthetic construct
WMGFQCY

SEQ ID NO: 32364 - protein, 7 aa, Artificial Sequence
  Synthetic construct
WMGFQLF

SEQ ID NO: 32365 - protein, 7 aa, Artificial Sequence
  Synthetic construct
WMGFQLY

SEQ ID NO: 32366 - protein, 7 aa, Artificial Sequence
  Synthetic construct
WMGFQAF

SEQ ID NO: 32367 - protein, 7 aa, Artificial Sequence
  Synthetic construct
WMGFQAY

SEQ ID NO: 32368 - protein, 7 aa, Artificial Sequence
  Synthetic construct
WMGFQQF

SEQ ID NO: 32369 - protein, 7 aa, Artificial Sequence
  Synthetic construct
WMGFQQY

SEQ ID NO: 32370 - protein, 7 aa, Artificial Sequence
  Synthetic construct
WMGFQDF

SEQ ID NO: 32371 - protein, 7 aa, Artificial Sequence
  Synthetic construct
WMGFQDY

SEQ ID NO: 32372 - protein, 7 aa, Artificial Sequence
  Synthetic construct
WMGFQVF

SEQ ID NO: 32373 - protein, 7 aa, Artificial Sequence
  Synthetic construct
WMGFQVY

SEQ ID NO: 32374 - protein, 7 aa, Artificial Sequence
  Synthetic construct
WSIYIFF

SEQ ID NO: 32375 - protein, 7 aa, Artificial Sequence
  Synthetic construct
WSIYIFY

SEQ ID NO: 32376 - protein, 7 aa, Artificial Sequence
  Synthetic construct
WSIYIRF

SEQ ID NO: 32377 - protein, 7 aa, Artificial Sequence
  Synthetic construct
WSIYIRY

SEQ ID NO: 32378 - protein, 7 aa, Artificial Sequence
  Synthetic construct
WSIYICF

SEQ ID NO: 32379 - protein, 7 aa, Artificial Sequence
  Synthetic construct
WSIYICY

SEQ ID NO: 32380 - protein, 7 aa, Artificial Sequence
  Synthetic construct
WSIYILF

SEQ ID NO: 32381 - protein, 7 aa, Artificial Sequence
  Synthetic construct
WSIYILY

SEQ ID NO: 32382 - protein, 7 aa, Artificial Sequence
  Synthetic construct
WSIYIAF

SEQ ID NO: 32383 - protein, 7 aa, Artificial Sequence
  Synthetic construct
WSIYIAY

SEQ ID NO: 32384 - protein, 7 aa, Artificial Sequence
  Synthetic construct
WSIYIQF

SEQ ID NO: 32385 - protein, 7 aa, Artificial Sequence
  Synthetic construct
WSIYIQY

SEQ ID NO: 32386 - protein, 7 aa, Artificial Sequence
  Synthetic construct
WSIYIDF

SEQ ID NO: 32387 - protein, 7 aa, Artificial Sequence
  Synthetic construct
WSIYIDY

SEQ ID NO: 32388 - protein, 7 aa, Artificial Sequence
  Synthetic construct
WSIYIVF

SEQ ID NO: 32389 - protein, 7 aa, Artificial Sequence
  Synthetic construct
WSIYIVY

SEQ ID NO: 32390 - protein, 7 aa, Artificial Sequence
  Synthetic construct
WSIYDFF

SEQ ID NO: 32391 - protein, 7 aa, Artificial Sequence
  Synthetic construct
WSIYDFY

SEQ ID NO: 32392 - protein, 7 aa, Artificial Sequence
  Synthetic construct
WSIYDRF

SEQ ID NO: 32393 - protein, 7 aa, Artificial Sequence
  Synthetic construct
WSIYDRY

SEQ ID NO: 32394 - protein, 7 aa, Artificial Sequence
  Synthetic construct
WSIYDCF

SEQ ID NO: 32395 - protein, 7 aa, Artificial Sequence
  Synthetic construct
WSIYDCY

SEQ ID NO: 32396 - protein, 7 aa, Artificial Sequence
  Synthetic construct
WSIYDLF

SEQ ID NO: 32397 - protein, 7 aa, Artificial Sequence
  Synthetic construct
WSIYDLY

SEQ ID NO: 32398 - protein, 7 aa, Artificial Sequence
  Synthetic construct
WSIYDAF

SEQ ID NO: 32399 - protein, 7 aa, Artificial Sequence
  Synthetic construct
WSIYDAY

SEQ ID NO: 32400 - protein, 7 aa, Artificial Sequence
  Synthetic construct
WSIYDQF

SEQ ID NO: 32401 - protein, 7 aa, Artificial Sequence
  Synthetic construct
WSIYDQY

SEQ ID NO: 32402 - protein, 7 aa, Artificial Sequence
  Synthetic construct
WSIYDDF

SEQ ID NO: 32403 - protein, 7 aa, Artificial Sequence
  Synthetic construct
WSIYDDY

SEQ ID NO: 32404 - protein, 7 aa, Artificial Sequence
  Synthetic construct
WSIYDVF

SEQ ID NO: 32405 - protein, 7 aa, Artificial Sequence
  Synthetic construct
WSIYDVY

SEQ ID NO: 32406 - protein, 7 aa, Artificial Sequence
  Synthetic construct
WSIYYFF

SEQ ID NO: 32407 - protein, 7 aa, Artificial Sequence
  Synthetic construct
WSIYYFY

SEQ ID NO: 32408 - protein, 7 aa, Artificial Sequence
  Synthetic construct
WSIYYRF

SEQ ID NO: 32409 - protein, 7 aa, Artificial Sequence
  Synthetic construct
WSIYYRY

SEQ ID NO: 32410 - protein, 7 aa, Artificial Sequence
  Synthetic construct
WSIYYCF

SEQ ID NO: 32411 - protein, 7 aa, Artificial Sequence
  Synthetic construct
WSIYYCY

SEQ ID NO: 32412 - protein, 7 aa, Artificial Sequence
  Synthetic construct
WSIYYLF

SEQ ID NO: 32413 - protein, 7 aa, Artificial Sequence
  Synthetic construct
WSIYYLY

SEQ ID NO: 32414 - protein, 7 aa, Artificial Sequence
  Synthetic construct
WSIYYAF

SEQ ID NO: 32415 - protein, 7 aa, Artificial Sequence
  Synthetic construct
WSIYYAY

SEQ ID NO: 32416 - protein, 7 aa, Artificial Sequence
  Synthetic construct
WSIYYQF

SEQ ID NO: 32417 - protein, 7 aa, Artificial Sequence
  Synthetic construct
WSIYYQY

SEQ ID NO: 32418 - protein, 7 aa, Artificial Sequence
  Synthetic construct
WSIYYDF

SEQ ID NO: 32419 - protein, 7 aa, Artificial Sequence
  Synthetic construct
WSIYYDY

SEQ ID NO: 32420 - protein, 7 aa, Artificial Sequence
  Synthetic construct
WSIYYVF

SEQ ID NO: 32421 - protein, 7 aa, Artificial Sequence
  Synthetic construct
WSIYYVY

SEQ ID NO: 32422 - protein, 7 aa, Artificial Sequence
  Synthetic construct
WSIYFFF

SEQ ID NO: 32423 - protein, 7 aa, Artificial Sequence
  Synthetic construct
WSIYFFY

SEQ ID NO: 32424 - protein, 7 aa, Artificial Sequence
  Synthetic construct
WSIYFRF

SEQ ID NO: 32425 - protein, 7 aa, Artificial Sequence
  Synthetic construct
WSIYFRY

SEQ ID NO: 32426 - protein, 7 aa, Artificial Sequence
  Synthetic construct
WSIYFCF

SEQ ID NO: 32427 - protein, 7 aa, Artificial Sequence
  Synthetic construct
WSIYFCY

SEQ ID NO: 32428 - protein, 7 aa, Artificial Sequence
  Synthetic construct
WSIYFLF

SEQ ID NO: 32429 - protein, 7 aa, Artificial Sequence
  Synthetic construct
WSIYFLY

SEQ ID NO: 32430 - protein, 7 aa, Artificial Sequence
  Synthetic construct
WSIYFAF

SEQ ID NO: 32431 - protein, 7 aa, Artificial Sequence
  Synthetic construct
WSIYFAY

SEQ ID NO: 32432 - protein, 7 aa, Artificial Sequence
  Synthetic construct
WSIYFQF

SEQ ID NO: 32433 - protein, 7 aa, Artificial Sequence
  Synthetic construct
WSIYFQY

SEQ ID NO: 32434 - protein, 7 aa, Artificial Sequence
  Synthetic construct
WSIYFDF

SEQ ID NO: 32435 - protein, 7 aa, Artificial Sequence
  Synthetic construct
WSIYFDY

SEQ ID NO: 32436 - protein, 7 aa, Artificial Sequence
  Synthetic construct
WSIYFVF

SEQ ID NO: 32437 - protein, 7 aa, Artificial Sequence
  Synthetic construct
WSIYFVY

SEQ ID NO: 32438 - protein, 7 aa, Artificial Sequence
  Synthetic construct
WSIYVFF

SEQ ID NO: 32439 - protein, 7 aa, Artificial Sequence
  Synthetic construct
WSIYVFY

SEQ ID NO: 32440 - protein, 7 aa, Artificial Sequence
  Synthetic construct
WSIYVRF

SEQ ID NO: 32441 - protein, 7 aa, Artificial Sequence
  Synthetic construct
WSIYVRY

SEQ ID NO: 32442 - protein, 7 aa, Artificial Sequence
  Synthetic construct
WSIYVCF

SEQ ID NO: 32443 - protein, 7 aa, Artificial Sequence
  Synthetic construct
WSIYVCY

SEQ ID NO: 32444 - protein, 7 aa, Artificial Sequence
  Synthetic construct
WSIYVLF

SEQ ID NO: 32445 - protein, 7 aa, Artificial Sequence
  Synthetic construct
WSIYVLY

SEQ ID NO: 32446 - protein, 7 aa, Artificial Sequence
  Synthetic construct
WSIYVAF

SEQ ID NO: 32447 - protein, 7 aa, Artificial Sequence
  Synthetic construct
WSIYVAY

SEQ ID NO: 32448 - protein, 7 aa, Artificial Sequence
  Synthetic construct
WSIYVQF

SEQ ID NO: 32449 - protein, 7 aa, Artificial Sequence
  Synthetic construct
WSIYVQY

SEQ ID NO: 32450 - protein, 7 aa, Artificial Sequence
  Synthetic construct
WSIYVDF

SEQ ID NO: 32451 - protein, 7 aa, Artificial Sequence
  Synthetic construct
WSIYVDY

SEQ ID NO: 32452 - protein, 7 aa, Artificial Sequence
  Synthetic construct
WSIYVVF

SEQ ID NO: 32453 - protein, 7 aa, Artificial Sequence
  Synthetic construct
WSIYVVY

SEQ ID NO: 32454 - protein, 7 aa, Artificial Sequence
  Synthetic construct
WSIYTFF

SEQ ID NO: 32455 - protein, 7 aa, Artificial Sequence
  Synthetic construct
WSIYTFY

SEQ ID NO: 32456 - protein, 7 aa, Artificial Sequence
  Synthetic construct
WSIYTRF

SEQ ID NO: 32457 - protein, 7 aa, Artificial Sequence
  Synthetic construct
WSIYTRY

SEQ ID NO: 32458 - protein, 7 aa, Artificial Sequence
  Synthetic construct
WSIYTCF

SEQ ID NO: 32459 - protein, 7 aa, Artificial Sequence
  Synthetic construct
WSIYTCY

SEQ ID NO: 32460 - protein, 7 aa, Artificial Sequence
  Synthetic construct
WSIYTLF

SEQ ID NO: 32461 - protein, 7 aa, Artificial Sequence
  Synthetic construct
WSIYTLY

SEQ ID NO: 32462 - protein, 7 aa, Artificial Sequence
  Synthetic construct
WSIYTAF

SEQ ID NO: 32463 - protein, 7 aa, Artificial Sequence
  Synthetic construct
WSIYTAY

SEQ ID NO: 32464 - protein, 7 aa, Artificial Sequence
  Synthetic construct
WSIYTQF

SEQ ID NO: 32465 - protein, 7 aa, Artificial Sequence
  Synthetic construct
WSIYTQY

SEQ ID NO: 32466 - protein, 7 aa, Artificial Sequence
  Synthetic construct
WSIYTDF

SEQ ID NO: 32467 - protein, 7 aa, Artificial Sequence
  Synthetic construct
WSIYTDY

SEQ ID NO: 32468 - protein, 7 aa, Artificial Sequence
  Synthetic construct
WSIYTVF

SEQ ID NO: 32469 - protein, 7 aa, Artificial Sequence
  Synthetic construct
WSIYTVY

SEQ ID NO: 32470 - protein, 7 aa, Artificial Sequence
  Synthetic construct
WSIYGFF

SEQ ID NO: 32471 - protein, 7 aa, Artificial Sequence
  Synthetic construct
WSIYGFY

SEQ ID NO: 32472 - protein, 7 aa, Artificial Sequence
  Synthetic construct
WSIYGRF

SEQ ID NO: 32473 - protein, 7 aa, Artificial Sequence
  Synthetic construct
WSIYGRY

SEQ ID NO: 32474 - protein, 7 aa, Artificial Sequence
  Synthetic construct
WSIYGCF

SEQ ID NO: 32475 - protein, 7 aa, Artificial Sequence
  Synthetic construct
WSIYGCY

SEQ ID NO: 32476 - protein, 7 aa, Artificial Sequence
  Synthetic construct
WSIYGLF

SEQ ID NO: 32477 - protein, 7 aa, Artificial Sequence
  Synthetic construct
WSIYGLY

SEQ ID NO: 32478 - protein, 7 aa, Artificial Sequence
  Synthetic construct
WSIYGAF

SEQ ID NO: 32479 - protein, 7 aa, Artificial Sequence
  Synthetic construct
WSIYGAY

SEQ ID NO: 32480 - protein, 7 aa, Artificial Sequence
  Synthetic construct
WSIYGQF

SEQ ID NO: 32481 - protein, 7 aa, Artificial Sequence
  Synthetic construct
WSIYGQY

SEQ ID NO: 32482 - protein, 7 aa, Artificial Sequence
  Synthetic construct
WSIYGDF

SEQ ID NO: 32483 - protein, 7 aa, Artificial Sequence
  Synthetic construct
WSIYGDY

SEQ ID NO: 32484 - protein, 7 aa, Artificial Sequence
  Synthetic construct
WSIYGVF

SEQ ID NO: 32485 - protein, 7 aa, Artificial Sequence
  Synthetic construct
WSIYGVY

SEQ ID NO: 32486 - protein, 7 aa, Artificial Sequence
  Synthetic construct
WSIYAFF

SEQ ID NO: 32487 - protein, 7 aa, Artificial Sequence
  Synthetic construct
WSIYAFY

SEQ ID NO: 32488 - protein, 7 aa, Artificial Sequence
  Synthetic construct
WSIYARF

SEQ ID NO: 32489 - protein, 7 aa, Artificial Sequence
  Synthetic construct
WSIYARY

SEQ ID NO: 32490 - protein, 7 aa, Artificial Sequence
  Synthetic construct
WSIYACF

SEQ ID NO: 32491 - protein, 7 aa, Artificial Sequence
  Synthetic construct
WSIYACY

SEQ ID NO: 32492 - protein, 7 aa, Artificial Sequence
  Synthetic construct
WSIYALF

SEQ ID NO: 32493 - protein, 7 aa, Artificial Sequence
  Synthetic construct
WSIYALY

SEQ ID NO: 32494 - protein, 7 aa, Artificial Sequence
  Synthetic construct
WSIYAAF

SEQ ID NO: 32495 - protein, 7 aa, Artificial Sequence
  Synthetic construct
WSIYAAY

SEQ ID NO: 32496 - protein, 7 aa, Artificial Sequence
  Synthetic construct
WSIYAQF

SEQ ID NO: 32497 - protein, 7 aa, Artificial Sequence
  Synthetic construct
WSIYAQY

SEQ ID NO: 32498 - protein, 7 aa, Artificial Sequence
  Synthetic construct
WSIYADF

SEQ ID NO: 32499 - protein, 7 aa, Artificial Sequence
  Synthetic construct
WSIYADY

SEQ ID NO: 32500 - protein, 7 aa, Artificial Sequence
  Synthetic construct
WSIYAVF

SEQ ID NO: 32501 - protein, 7 aa, Artificial Sequence
  Synthetic construct
WSIYAVY

SEQ ID NO: 32502 - protein, 7 aa, Artificial Sequence
  Synthetic construct
WSIYQFF

SEQ ID NO: 32503 - protein, 7 aa, Artificial Sequence
  Synthetic construct
WSIYQFY

SEQ ID NO: 32504 - protein, 7 aa, Artificial Sequence
  Synthetic construct
WSIYQRF

SEQ ID NO: 32505 - protein, 7 aa, Artificial Sequence
  Synthetic construct
WSIYQRY

SEQ ID NO: 32506 - protein, 7 aa, Artificial Sequence
  Synthetic construct
WSIYQCF

SEQ ID NO: 32507 - protein, 7 aa, Artificial Sequence
  Synthetic construct
WSIYQCY

SEQ ID NO: 32508 - protein, 7 aa, Artificial Sequence
  Synthetic construct
WSIYQLF

SEQ ID NO: 32509 - protein, 7 aa, Artificial Sequence
  Synthetic construct
WSIYQLY

SEQ ID NO: 32510 - protein, 7 aa, Artificial Sequence
  Synthetic construct
WSIYQAF

SEQ ID NO: 32511 - protein, 7 aa, Artificial Sequence
  Synthetic construct
WSIYQAY

SEQ ID NO: 32512 - protein, 7 aa, Artificial Sequence
  Synthetic construct
WSIYQQF

SEQ ID NO: 32513 - protein, 7 aa, Artificial Sequence
  Synthetic construct
WSIYQQY

SEQ ID NO: 32514 - protein, 7 aa, Artificial Sequence
  Synthetic construct
WSIYQDF

SEQ ID NO: 32515 - protein, 7 aa, Artificial Sequence
  Synthetic construct
WSIYQDY

SEQ ID NO: 32516 - protein, 7 aa, Artificial Sequence
  Synthetic construct
WSIYQVF

SEQ ID NO: 32517 - protein, 7 aa, Artificial Sequence
  Synthetic construct
WSIYQVY

SEQ ID NO: 32518 - protein, 7 aa, Artificial Sequence
  Synthetic construct
WSIPIFF

SEQ ID NO: 32519 - protein, 7 aa, Artificial Sequence
  Synthetic construct
WSIPIFY

SEQ ID NO: 32520 - protein, 7 aa, Artificial Sequence
  Synthetic construct
WSIPIRF

SEQ ID NO: 32521 - protein, 7 aa, Artificial Sequence
  Synthetic construct
WSIPIRY

SEQ ID NO: 32522 - protein, 7 aa, Artificial Sequence
  Synthetic construct
WSIPICF

SEQ ID NO: 32523 - protein, 7 aa, Artificial Sequence
  Synthetic construct
WSIPICY

SEQ ID NO: 32524 - protein, 7 aa, Artificial Sequence
  Synthetic construct
WSIPILF

SEQ ID NO: 32525 - protein, 7 aa, Artificial Sequence
  Synthetic construct
WSIPILY

SEQ ID NO: 32526 - protein, 7 aa, Artificial Sequence
  Synthetic construct
WSIPIAF

SEQ ID NO: 32527 - protein, 7 aa, Artificial Sequence
  Synthetic construct
WSIPIAY

SEQ ID NO: 32528 - protein, 7 aa, Artificial Sequence
  Synthetic construct
WSIPIQF

SEQ ID NO: 32529 - protein, 7 aa, Artificial Sequence
  Synthetic construct
WSIPIQY

SEQ ID NO: 32530 - protein, 7 aa, Artificial Sequence
  Synthetic construct
WSIPIDF

SEQ ID NO: 32531 - protein, 7 aa, Artificial Sequence
  Synthetic construct
WSIPIDY

SEQ ID NO: 32532 - protein, 7 aa, Artificial Sequence
  Synthetic construct
WSIPIVF

SEQ ID NO: 32533 - protein, 7 aa, Artificial Sequence
  Synthetic construct
WSIPIVY

SEQ ID NO: 32534 - protein, 7 aa, Artificial Sequence
  Synthetic construct
WSIPDFF

SEQ ID NO: 32535 - protein, 7 aa, Artificial Sequence
  Synthetic construct
WSIPDFY

SEQ ID NO: 32536 - protein, 7 aa, Artificial Sequence
  Synthetic construct
WSIPDRF

SEQ ID NO: 32537 - protein, 7 aa, Artificial Sequence
  Synthetic construct
WSIPDRY

SEQ ID NO: 32538 - protein, 7 aa, Artificial Sequence
  Synthetic construct
WSIPDCF

SEQ ID NO: 32539 - protein, 7 aa, Artificial Sequence
  Synthetic construct
WSIPDCY

SEQ ID NO: 32540 - protein, 7 aa, Artificial Sequence
  Synthetic construct
WSIPDLF

SEQ ID NO: 32541 - protein, 7 aa, Artificial Sequence
  Synthetic construct
WSIPDLY

SEQ ID NO: 32542 - protein, 7 aa, Artificial Sequence
  Synthetic construct
WSIPDAF

SEQ ID NO: 32543 - protein, 7 aa, Artificial Sequence
  Synthetic construct
WSIPDAY

SEQ ID NO: 32544 - protein, 7 aa, Artificial Sequence
  Synthetic construct
WSIPDQF

SEQ ID NO: 32545 - protein, 7 aa, Artificial Sequence
  Synthetic construct
WSIPDQY

SEQ ID NO: 32546 - protein, 7 aa, Artificial Sequence
  Synthetic construct
WSIPDDF

SEQ ID NO: 32547 - protein, 7 aa, Artificial Sequence
  Synthetic construct
WSIPDDY

SEQ ID NO: 32548 - protein, 7 aa, Artificial Sequence
  Synthetic construct
WSIPDVF

SEQ ID NO: 32549 - protein, 7 aa, Artificial Sequence
  Synthetic construct
WSIPDVY

SEQ ID NO: 32550 - protein, 7 aa, Artificial Sequence
  Synthetic construct
WSIPYFF

SEQ ID NO: 32551 - protein, 7 aa, Artificial Sequence
  Synthetic construct
WSIPYFY

SEQ ID NO: 32552 - protein, 7 aa, Artificial Sequence
  Synthetic construct
WSIPYRF

SEQ ID NO: 32553 - protein, 7 aa, Artificial Sequence
  Synthetic construct
WSIPYRY

SEQ ID NO: 32554 - protein, 7 aa, Artificial Sequence
  Synthetic construct
WSIPYCF

SEQ ID NO: 32555 - protein, 7 aa, Artificial Sequence
  Synthetic construct
WSIPYCY

SEQ ID NO: 32556 - protein, 7 aa, Artificial Sequence
  Synthetic construct
WSIPYLF

SEQ ID NO: 32557 - protein, 7 aa, Artificial Sequence
  Synthetic construct
WSIPYLY

SEQ ID NO: 32558 - protein, 7 aa, Artificial Sequence
  Synthetic construct
WSIPYAF

SEQ ID NO: 32559 - protein, 7 aa, Artificial Sequence
  Synthetic construct
WSIPYAY

SEQ ID NO: 32560 - protein, 7 aa, Artificial Sequence
  Synthetic construct
WSIPYQF

SEQ ID NO: 32561 - protein, 7 aa, Artificial Sequence
  Synthetic construct
WSIPYQY

SEQ ID NO: 32562 - protein, 7 aa, Artificial Sequence
  Synthetic construct
WSIPYDF

SEQ ID NO: 32563 - protein, 7 aa, Artificial Sequence
  Synthetic construct
WSIPYDY

SEQ ID NO: 32564 - protein, 7 aa, Artificial Sequence
  Synthetic construct
WSIPYVF

SEQ ID NO: 32565 - protein, 7 aa, Artificial Sequence
  Synthetic construct
WSIPYVY

SEQ ID NO: 32566 - protein, 7 aa, Artificial Sequence
  Synthetic construct
WSIPFFF

SEQ ID NO: 32567 - protein, 7 aa, Artificial Sequence
  Synthetic construct
WSIPFFY

SEQ ID NO: 32568 - protein, 7 aa, Artificial Sequence
  Synthetic construct
WSIPFRF

SEQ ID NO: 32569 - protein, 7 aa, Artificial Sequence
  Synthetic construct
WSIPFRY

SEQ ID NO: 32570 - protein, 7 aa, Artificial Sequence
  Synthetic construct
WSIPFCF

SEQ ID NO: 32571 - protein, 7 aa, Artificial Sequence
  Synthetic construct
WSIPFCY

SEQ ID NO: 32572 - protein, 7 aa, Artificial Sequence
  Synthetic construct
WSIPFLF

SEQ ID NO: 32573 - protein, 7 aa, Artificial Sequence
  Synthetic construct
WSIPFLY

SEQ ID NO: 32574 - protein, 7 aa, Artificial Sequence
  Synthetic construct
WSIPFAF

SEQ ID NO: 32575 - protein, 7 aa, Artificial Sequence
  Synthetic construct
WSIPFAY

SEQ ID NO: 32576 - protein, 7 aa, Artificial Sequence
  Synthetic construct
WSIPFQF

SEQ ID NO: 32577 - protein, 7 aa, Artificial Sequence
  Synthetic construct
WSIPFQY

SEQ ID NO: 32578 - protein, 7 aa, Artificial Sequence
  Synthetic construct
WSIPFDF

SEQ ID NO: 32579 - protein, 7 aa, Artificial Sequence
  Synthetic construct
WSIPFDY

SEQ ID NO: 32580 - protein, 7 aa, Artificial Sequence
  Synthetic construct
WSIPFVF

SEQ ID NO: 32581 - protein, 7 aa, Artificial Sequence
  Synthetic construct
WSIPFVY

SEQ ID NO: 32582 - protein, 7 aa, Artificial Sequence
  Synthetic construct
WSIPVFF

SEQ ID NO: 32583 - protein, 7 aa, Artificial Sequence
  Synthetic construct
WSIPVFY

SEQ ID NO: 32584 - protein, 7 aa, Artificial Sequence
  Synthetic construct
WSIPVRF

SEQ ID NO: 32585 - protein, 7 aa, Artificial Sequence
  Synthetic construct
WSIPVRY

SEQ ID NO: 32586 - protein, 7 aa, Artificial Sequence
  Synthetic construct
WSIPVCF

SEQ ID NO: 32587 - protein, 7 aa, Artificial Sequence
  Synthetic construct
WSIPVCY

SEQ ID NO: 32588 - protein, 7 aa, Artificial Sequence
  Synthetic construct
WSIPVLF

SEQ ID NO: 32589 - protein, 7 aa, Artificial Sequence
  Synthetic construct
WSIPVLY

SEQ ID NO: 32590 - protein, 7 aa, Artificial Sequence
  Synthetic construct
WSIPVAF

SEQ ID NO: 32591 - protein, 7 aa, Artificial Sequence
  Synthetic construct
WSIPVAY

SEQ ID NO: 32592 - protein, 7 aa, Artificial Sequence
  Synthetic construct
WSIPVQF

SEQ ID NO: 32593 - protein, 7 aa, Artificial Sequence
  Synthetic construct
WSIPVQY

SEQ ID NO: 32594 - protein, 7 aa, Artificial Sequence
  Synthetic construct
WSIPVDF

SEQ ID NO: 32595 - protein, 7 aa, Artificial Sequence
  Synthetic construct
WSIPVDY

SEQ ID NO: 32596 - protein, 7 aa, Artificial Sequence
  Synthetic construct
WSIPVVF

SEQ ID NO: 32597 - protein, 7 aa, Artificial Sequence
  Synthetic construct
WSIPVVY

SEQ ID NO: 32598 - protein, 7 aa, Artificial Sequence
  Synthetic construct
WSIPTFF

SEQ ID NO: 32599 - protein, 7 aa, Artificial Sequence
  Synthetic construct
WSIPTFY

SEQ ID NO: 32600 - protein, 7 aa, Artificial Sequence
  Synthetic construct
WSIPTRF

SEQ ID NO: 32601 - protein, 7 aa, Artificial Sequence
  Synthetic construct
WSIPTRY

SEQ ID NO: 32602 - protein, 7 aa, Artificial Sequence
  Synthetic construct
WSIPTCF

SEQ ID NO: 32603 - protein, 7 aa, Artificial Sequence
  Synthetic construct
WSIPTCY

SEQ ID NO: 32604 - protein, 7 aa, Artificial Sequence
  Synthetic construct
WSIPTLF

SEQ ID NO: 32605 - protein, 7 aa, Artificial Sequence
  Synthetic construct
WSIPTLY

SEQ ID NO: 32606 - protein, 7 aa, Artificial Sequence
  Synthetic construct
WSIPTAF

SEQ ID NO: 32607 - protein, 7 aa, Artificial Sequence
  Synthetic construct
WSIPTAY

SEQ ID NO: 32608 - protein, 7 aa, Artificial Sequence
  Synthetic construct
WSIPTQF

SEQ ID NO: 32609 - protein, 7 aa, Artificial Sequence
  Synthetic construct
WSIPTQY

SEQ ID NO: 32610 - protein, 7 aa, Artificial Sequence
  Synthetic construct
WSIPTDF

SEQ ID NO: 32611 - protein, 7 aa, Artificial Sequence
  Synthetic construct
WSIPTDY

SEQ ID NO: 32612 - protein, 7 aa, Artificial Sequence
  Synthetic construct
WSIPTVF

SEQ ID NO: 32613 - protein, 7 aa, Artificial Sequence
  Synthetic construct
WSIPTVY

SEQ ID NO: 32614 - protein, 7 aa, Artificial Sequence
  Synthetic construct
WSIPGFF

SEQ ID NO: 32615 - protein, 7 aa, Artificial Sequence
  Synthetic construct
WSIPGFY

SEQ ID NO: 32616 - protein, 7 aa, Artificial Sequence
  Synthetic construct
WSIPGRF

SEQ ID NO: 32617 - protein, 7 aa, Artificial Sequence
  Synthetic construct
WSIPGRY

SEQ ID NO: 32618 - protein, 7 aa, Artificial Sequence
  Synthetic construct
WSIPGCF

SEQ ID NO: 32619 - protein, 7 aa, Artificial Sequence
  Synthetic construct
WSIPGCY

SEQ ID NO: 32620 - protein, 7 aa, Artificial Sequence
  Synthetic construct
WSIPGLF

SEQ ID NO: 32621 - protein, 7 aa, Artificial Sequence
  Synthetic construct
WSIPGLY

SEQ ID NO: 32622 - protein, 7 aa, Artificial Sequence
  Synthetic construct
WSIPGAF

SEQ ID NO: 32623 - protein, 7 aa, Artificial Sequence
  Synthetic construct
WSIPGAY

SEQ ID NO: 32624 - protein, 7 aa, Artificial Sequence
  Synthetic construct
WSIPGQF

SEQ ID NO: 32625 - protein, 7 aa, Artificial Sequence
  Synthetic construct
WSIPGQY

SEQ ID NO: 32626 - protein, 7 aa, Artificial Sequence
  Synthetic construct
WSIPGDF

SEQ ID NO: 32627 - protein, 7 aa, Artificial Sequence
  Synthetic construct
WSIPGDY

SEQ ID NO: 32628 - protein, 7 aa, Artificial Sequence
  Synthetic construct
WSIPGVF

SEQ ID NO: 32629 - protein, 7 aa, Artificial Sequence
  Synthetic construct
WSIPGVY

SEQ ID NO: 32630 - protein, 7 aa, Artificial Sequence
  Synthetic construct
WSIPAFF

SEQ ID NO: 32631 - protein, 7 aa, Artificial Sequence
  Synthetic construct
WSIPAFY

SEQ ID NO: 32632 - protein, 7 aa, Artificial Sequence
  Synthetic construct
WSIPARF

SEQ ID NO: 32633 - protein, 7 aa, Artificial Sequence
  Synthetic construct
WSIPARY

SEQ ID NO: 32634 - protein, 7 aa, Artificial Sequence
  Synthetic construct
WSIPACF

SEQ ID NO: 32635 - protein, 7 aa, Artificial Sequence
  Synthetic construct
WSIPACY

SEQ ID NO: 32636 - protein, 7 aa, Artificial Sequence
  Synthetic construct
WSIPALF

SEQ ID NO: 32637 - protein, 7 aa, Artificial Sequence
  Synthetic construct
WSIPALY

SEQ ID NO: 32638 - protein, 7 aa, Artificial Sequence
  Synthetic construct
WSIPAAF

SEQ ID NO: 32639 - protein, 7 aa, Artificial Sequence
  Synthetic construct
WSIPAAY

SEQ ID NO: 32640 - protein, 7 aa, Artificial Sequence
  Synthetic construct
WSIPAQF

SEQ ID NO: 32641 - protein, 7 aa, Artificial Sequence
  Synthetic construct
WSIPAQY

SEQ ID NO: 32642 - protein, 7 aa, Artificial Sequence
  Synthetic construct
WSIPADF

SEQ ID NO: 32643 - protein, 7 aa, Artificial Sequence
  Synthetic construct
WSIPADY

SEQ ID NO: 32644 - protein, 7 aa, Artificial Sequence
  Synthetic construct
WSIPAVF

SEQ ID NO: 32645 - protein, 7 aa, Artificial Sequence
  Synthetic construct
WSIPAVY

SEQ ID NO: 32646 - protein, 7 aa, Artificial Sequence
  Synthetic construct
WSIPQFF

SEQ ID NO: 32647 - protein, 7 aa, Artificial Sequence
  Synthetic construct
WSIPQFY

SEQ ID NO: 32648 - protein, 7 aa, Artificial Sequence
  Synthetic construct
WSIPQRF

SEQ ID NO: 32649 - protein, 7 aa, Artificial Sequence
  Synthetic construct
WSIPQRY

SEQ ID NO: 32650 - protein, 7 aa, Artificial Sequence
  Synthetic construct
WSIPQCF

SEQ ID NO: 32651 - protein, 7 aa, Artificial Sequence
  Synthetic construct
WSIPQCY

SEQ ID NO: 32652 - protein, 7 aa, Artificial Sequence
  Synthetic construct
WSIPQLF

SEQ ID NO: 32653 - protein, 7 aa, Artificial Sequence
  Synthetic construct
WSIPQLY

SEQ ID NO: 32654 - protein, 7 aa, Artificial Sequence
  Synthetic construct
WSIPQAF

SEQ ID NO: 32655 - protein, 7 aa, Artificial Sequence
  Synthetic construct
WSIPQAY

SEQ ID NO: 32656 - protein, 7 aa, Artificial Sequence
  Synthetic construct
WSIPQQF

SEQ ID NO: 32657 - protein, 7 aa, Artificial Sequence
  Synthetic construct
WSIPQQY

SEQ ID NO: 32658 - protein, 7 aa, Artificial Sequence
  Synthetic construct
WSIPQDF

SEQ ID NO: 32659 - protein, 7 aa, Artificial Sequence
  Synthetic construct
WSIPQDY

SEQ ID NO: 32660 - protein, 7 aa, Artificial Sequence
  Synthetic construct
WSIPQVF

SEQ ID NO: 32661 - protein, 7 aa, Artificial Sequence
  Synthetic construct
WSIPQVY

SEQ ID NO: 32662 - protein, 7 aa, Artificial Sequence
  Synthetic construct
WSIHIFF

SEQ ID NO: 32663 - protein, 7 aa, Artificial Sequence
  Synthetic construct
WSIHIFY

SEQ ID NO: 32664 - protein, 7 aa, Artificial Sequence
  Synthetic construct
WSIHIRF

SEQ ID NO: 32665 - protein, 7 aa, Artificial Sequence
  Synthetic construct
WSIHIRY

SEQ ID NO: 32666 - protein, 7 aa, Artificial Sequence
  Synthetic construct
WSIHICF

SEQ ID NO: 32667 - protein, 7 aa, Artificial Sequence
  Synthetic construct
WSIHICY

SEQ ID NO: 32668 - protein, 7 aa, Artificial Sequence
  Synthetic construct
WSIHILF

SEQ ID NO: 32669 - protein, 7 aa, Artificial Sequence
  Synthetic construct
WSIHILY

SEQ ID NO: 32670 - protein, 7 aa, Artificial Sequence
  Synthetic construct
WSIHIAF

SEQ ID NO: 32671 - protein, 7 aa, Artificial Sequence
  Synthetic construct
WSIHIAY

SEQ ID NO: 32672 - protein, 7 aa, Artificial Sequence
  Synthetic construct
WSIHIQF

SEQ ID NO: 32673 - protein, 7 aa, Artificial Sequence
  Synthetic construct
WSIHIQY

SEQ ID NO: 32674 - protein, 7 aa, Artificial Sequence
  Synthetic construct
WSIHIDF

SEQ ID NO: 32675 - protein, 7 aa, Artificial Sequence
  Synthetic construct
WSIHIDY

SEQ ID NO: 32676 - protein, 7 aa, Artificial Sequence
  Synthetic construct
WSIHIVF

SEQ ID NO: 32677 - protein, 7 aa, Artificial Sequence
  Synthetic construct
WSIHIVY

SEQ ID NO: 32678 - protein, 7 aa, Artificial Sequence
  Synthetic construct
WSIHDFF

SEQ ID NO: 32679 - protein, 7 aa, Artificial Sequence
  Synthetic construct
WSIHDFY

SEQ ID NO: 32680 - protein, 7 aa, Artificial Sequence
  Synthetic construct
WSIHDRF

SEQ ID NO: 32681 - protein, 7 aa, Artificial Sequence
  Synthetic construct
WSIHDRY

SEQ ID NO: 32682 - protein, 7 aa, Artificial Sequence
  Synthetic construct
WSIHDCF

SEQ ID NO: 32683 - protein, 7 aa, Artificial Sequence
  Synthetic construct
WSIHDCY

SEQ ID NO: 32684 - protein, 7 aa, Artificial Sequence
  Synthetic construct
WSIHDLF

SEQ ID NO: 32685 - protein, 7 aa, Artificial Sequence
  Synthetic construct
WSIHDLY

SEQ ID NO: 32686 - protein, 7 aa, Artificial Sequence
  Synthetic construct
WSIHDAF

SEQ ID NO: 32687 - protein, 7 aa, Artificial Sequence
  Synthetic construct
WSIHDAY

SEQ ID NO: 32688 - protein, 7 aa, Artificial Sequence
  Synthetic construct
WSIHDQF

SEQ ID NO: 32689 - protein, 7 aa, Artificial Sequence
  Synthetic construct
WSIHDQY

SEQ ID NO: 32690 - protein, 7 aa, Artificial Sequence
  Synthetic construct
WSIHDDF

SEQ ID NO: 32691 - protein, 7 aa, Artificial Sequence
  Synthetic construct
WSIHDDY

SEQ ID NO: 32692 - protein, 7 aa, Artificial Sequence
  Synthetic construct
WSIHDVF

SEQ ID NO: 32693 - protein, 7 aa, Artificial Sequence
  Synthetic construct
WSIHDVY

SEQ ID NO: 32694 - protein, 7 aa, Artificial Sequence
  Synthetic construct
WSIHYFF

SEQ ID NO: 32695 - protein, 7 aa, Artificial Sequence
  Synthetic construct
WSIHYFY

SEQ ID NO: 32696 - protein, 7 aa, Artificial Sequence
  Synthetic construct
WSIHYRF

SEQ ID NO: 32697 - protein, 7 aa, Artificial Sequence
  Synthetic construct
WSIHYRY

SEQ ID NO: 32698 - protein, 7 aa, Artificial Sequence
  Synthetic construct
WSIHYCF

SEQ ID NO: 32699 - protein, 7 aa, Artificial Sequence
  Synthetic construct
WSIHYCY

SEQ ID NO: 32700 - protein, 7 aa, Artificial Sequence
  Synthetic construct
WSIHYLF

SEQ ID NO: 32701 - protein, 7 aa, Artificial Sequence
  Synthetic construct
WSIHYLY

SEQ ID NO: 32702 - protein, 7 aa, Artificial Sequence
  Synthetic construct
WSIHYAF

SEQ ID NO: 32703 - protein, 7 aa, Artificial Sequence
  Synthetic construct
WSIHYAY

SEQ ID NO: 32704 - protein, 7 aa, Artificial Sequence
  Synthetic construct
WSIHYQF

SEQ ID NO: 32705 - protein, 7 aa, Artificial Sequence
  Synthetic construct
WSIHYQY

SEQ ID NO: 32706 - protein, 7 aa, Artificial Sequence
  Synthetic construct
WSIHYDF

SEQ ID NO: 32707 - protein, 7 aa, Artificial Sequence
  Synthetic construct
WSIHYDY

SEQ ID NO: 32708 - protein, 7 aa, Artificial Sequence
  Synthetic construct
WSIHYVF

SEQ ID NO: 32709 - protein, 7 aa, Artificial Sequence
  Synthetic construct
WSIHYVY

SEQ ID NO: 32710 - protein, 7 aa, Artificial Sequence
  Synthetic construct
WSIHFFF

SEQ ID NO: 32711 - protein, 7 aa, Artificial Sequence
  Synthetic construct
WSIHFFY

SEQ ID NO: 32712 - protein, 7 aa, Artificial Sequence
  Synthetic construct
WSIHFRF

SEQ ID NO: 32713 - protein, 7 aa, Artificial Sequence
  Synthetic construct
WSIHFRY

SEQ ID NO: 32714 - protein, 7 aa, Artificial Sequence
  Synthetic construct
WSIHFCF

SEQ ID NO: 32715 - protein, 7 aa, Artificial Sequence
  Synthetic construct
WSIHFCY

SEQ ID NO: 32716 - protein, 7 aa, Artificial Sequence
  Synthetic construct
WSIHFLF

SEQ ID NO: 32717 - protein, 7 aa, Artificial Sequence
  Synthetic construct
WSIHFLY

SEQ ID NO: 32718 - protein, 7 aa, Artificial Sequence
  Synthetic construct
WSIHFAF

SEQ ID NO: 32719 - protein, 7 aa, Artificial Sequence
  Synthetic construct
WSIHFAY

SEQ ID NO: 32720 - protein, 7 aa, Artificial Sequence
  Synthetic construct
WSIHFQF

SEQ ID NO: 32721 - protein, 7 aa, Artificial Sequence
  Synthetic construct
WSIHFQY

SEQ ID NO: 32722 - protein, 7 aa, Artificial Sequence
  Synthetic construct
WSIHFDF

SEQ ID NO: 32723 - protein, 7 aa, Artificial Sequence
  Synthetic construct
WSIHFDY

SEQ ID NO: 32724 - protein, 7 aa, Artificial Sequence
  Synthetic construct
WSIHFVF

SEQ ID NO: 32725 - protein, 7 aa, Artificial Sequence
  Synthetic construct
WSIHFVY

SEQ ID NO: 32726 - protein, 7 aa, Artificial Sequence
  Synthetic construct
WSIHVFF

SEQ ID NO: 32727 - protein, 7 aa, Artificial Sequence
  Synthetic construct
WSIHVFY

SEQ ID NO: 32728 - protein, 7 aa, Artificial Sequence
  Synthetic construct
WSIHVRF

SEQ ID NO: 32729 - protein, 7 aa, Artificial Sequence
  Synthetic construct
WSIHVRY

SEQ ID NO: 32730 - protein, 7 aa, Artificial Sequence
  Synthetic construct
WSIHVCF

SEQ ID NO: 32731 - protein, 7 aa, Artificial Sequence
  Synthetic construct
WSIHVCY

SEQ ID NO: 32732 - protein, 7 aa, Artificial Sequence
  Synthetic construct
WSIHVLF

SEQ ID NO: 32733 - protein, 7 aa, Artificial Sequence
  Synthetic construct
WSIHVLY

SEQ ID NO: 32734 - protein, 7 aa, Artificial Sequence
  Synthetic construct
WSIHVAF

SEQ ID NO: 32735 - protein, 7 aa, Artificial Sequence
  Synthetic construct
WSIHVAY

SEQ ID NO: 32736 - protein, 7 aa, Artificial Sequence
  Synthetic construct
WSIHVQF

SEQ ID NO: 32737 - protein, 7 aa, Artificial Sequence
  Synthetic construct
WSIHVQY

SEQ ID NO: 32738 - protein, 7 aa, Artificial Sequence
  Synthetic construct
WSIHVDF

SEQ ID NO: 32739 - protein, 7 aa, Artificial Sequence
  Synthetic construct
WSIHVDY

SEQ ID NO: 32740 - protein, 7 aa, Artificial Sequence
  Synthetic construct
WSIHVVF

SEQ ID NO: 32741 - protein, 7 aa, Artificial Sequence
  Synthetic construct
WSIHVVY

SEQ ID NO: 32742 - protein, 7 aa, Artificial Sequence
  Synthetic construct
WSIHTFF

SEQ ID NO: 32743 - protein, 7 aa, Artificial Sequence
  Synthetic construct
WSIHTFY

SEQ ID NO: 32744 - protein, 7 aa, Artificial Sequence
  Synthetic construct
WSIHTRF

SEQ ID NO: 32745 - protein, 7 aa, Artificial Sequence
  Synthetic construct
WSIHTRY

SEQ ID NO: 32746 - protein, 7 aa, Artificial Sequence
  Synthetic construct
WSIHTCF

SEQ ID NO: 32747 - protein, 7 aa, Artificial Sequence
  Synthetic construct
WSIHTCY

SEQ ID NO: 32748 - protein, 7 aa, Artificial Sequence
  Synthetic construct
WSIHTLF

SEQ ID NO: 32749 - protein, 7 aa, Artificial Sequence
  Synthetic construct
WSIHTLY

SEQ ID NO: 32750 - protein, 7 aa, Artificial Sequence
  Synthetic construct
WSIHTAF

SEQ ID NO: 32751 - protein, 7 aa, Artificial Sequence
  Synthetic construct
WSIHTAY

SEQ ID NO: 32752 - protein, 7 aa, Artificial Sequence
  Synthetic construct
WSIHTQF

SEQ ID NO: 32753 - protein, 7 aa, Artificial Sequence
  Synthetic construct
WSIHTQY

SEQ ID NO: 32754 - protein, 7 aa, Artificial Sequence
  Synthetic construct
WSIHTDF

SEQ ID NO: 32755 - protein, 7 aa, Artificial Sequence
  Synthetic construct
WSIHTDY

SEQ ID NO: 32756 - protein, 7 aa, Artificial Sequence
  Synthetic construct
WSIHTVF

SEQ ID NO: 32757 - protein, 7 aa, Artificial Sequence
  Synthetic construct
WSIHTVY

SEQ ID NO: 32758 - protein, 7 aa, Artificial Sequence
  Synthetic construct
WSIHGFF

SEQ ID NO: 32759 - protein, 7 aa, Artificial Sequence
  Synthetic construct
WSIHGFY

SEQ ID NO: 32760 - protein, 7 aa, Artificial Sequence
  Synthetic construct
WSIHGRF

SEQ ID NO: 32761 - protein, 7 aa, Artificial Sequence
  Synthetic construct
WSIHGRY

SEQ ID NO: 32762 - protein, 7 aa, Artificial Sequence
  Synthetic construct
WSIHGCF

SEQ ID NO: 32763 - protein, 7 aa, Artificial Sequence
  Synthetic construct
WSIHGCY

SEQ ID NO: 32764 - protein, 7 aa, Artificial Sequence
  Synthetic construct
WSIHGLF

SEQ ID NO: 32765 - protein, 7 aa, Artificial Sequence
  Synthetic construct
WSIHGLY

SEQ ID NO: 32766 - protein, 7 aa, Artificial Sequence
  Synthetic construct
WSIHGAF

SEQ ID NO: 32767 - protein, 7 aa, Artificial Sequence
  Synthetic construct
WSIHGAY

SEQ ID NO: 32768 - protein, 7 aa, Artificial Sequence
  Synthetic construct
WSIHGQF

SEQ ID NO: 32769 - protein, 7 aa, Artificial Sequence
  Synthetic construct
WSIHGQY

SEQ ID NO: 32770 - protein, 7 aa, Artificial Sequence
  Synthetic construct
WSIHGDF

SEQ ID NO: 32771 - protein, 7 aa, Artificial Sequence
  Synthetic construct
WSIHGDY

SEQ ID NO: 32772 - protein, 7 aa, Artificial Sequence
  Synthetic construct
WSIHGVF

SEQ ID NO: 32773 - protein, 7 aa, Artificial Sequence
  Synthetic construct
WSIHGVY

SEQ ID NO: 32774 - protein, 7 aa, Artificial Sequence
  Synthetic construct
WSIHAFF

SEQ ID NO: 32775 - protein, 7 aa, Artificial Sequence
  Synthetic construct
WSIHAFY

SEQ ID NO: 32776 - protein, 7 aa, Artificial Sequence
  Synthetic construct
WSIHARF

SEQ ID NO: 32777 - protein, 7 aa, Artificial Sequence
  Synthetic construct
WSIHARY

SEQ ID NO: 32778 - protein, 7 aa, Artificial Sequence
  Synthetic construct
WSIHACF

SEQ ID NO: 32779 - protein, 7 aa, Artificial Sequence
  Synthetic construct
WSIHACY

SEQ ID NO: 32780 - protein, 7 aa, Artificial Sequence
  Synthetic construct
WSIHALF

SEQ ID NO: 32781 - protein, 7 aa, Artificial Sequence
  Synthetic construct
WSIHALY

SEQ ID NO: 32782 - protein, 7 aa, Artificial Sequence
  Synthetic construct
WSIHAAF

SEQ ID NO: 32783 - protein, 7 aa, Artificial Sequence
  Synthetic construct
WSIHAAY

SEQ ID NO: 32784 - protein, 7 aa, Artificial Sequence
  Synthetic construct
WSIHAQF

SEQ ID NO: 32785 - protein, 7 aa, Artificial Sequence
  Synthetic construct
WSIHAQY

SEQ ID NO: 32786 - protein, 7 aa, Artificial Sequence
  Synthetic construct
WSIHADF

SEQ ID NO: 32787 - protein, 7 aa, Artificial Sequence
  Synthetic construct
WSIHADY

SEQ ID NO: 32788 - protein, 7 aa, Artificial Sequence
  Synthetic construct
WSIHAVF

SEQ ID NO: 32789 - protein, 7 aa, Artificial Sequence
  Synthetic construct
WSIHAVY

SEQ ID NO: 32790 - protein, 7 aa, Artificial Sequence
  Synthetic construct
WSIHQFF

SEQ ID NO: 32791 - protein, 7 aa, Artificial Sequence
  Synthetic construct
WSIHQFY

SEQ ID NO: 32792 - protein, 7 aa, Artificial Sequence
  Synthetic construct
WSIHQRF

SEQ ID NO: 32793 - protein, 7 aa, Artificial Sequence
  Synthetic construct
WSIHQRY

SEQ ID NO: 32794 - protein, 7 aa, Artificial Sequence
  Synthetic construct
WSIHQCF

SEQ ID NO: 32795 - protein, 7 aa, Artificial Sequence
  Synthetic construct
WSIHQCY

SEQ ID NO: 32796 - protein, 7 aa, Artificial Sequence
  Synthetic construct
WSIHQLF

SEQ ID NO: 32797 - protein, 7 aa, Artificial Sequence
  Synthetic construct
WSIHQLY

SEQ ID NO: 32798 - protein, 7 aa, Artificial Sequence
  Synthetic construct
WSIHQAF

SEQ ID NO: 32799 - protein, 7 aa, Artificial Sequence
  Synthetic construct
WSIHQAY

SEQ ID NO: 32800 - protein, 7 aa, Artificial Sequence
  Synthetic construct
WSIHQQF

SEQ ID NO: 32801 - protein, 7 aa, Artificial Sequence
  Synthetic construct
WSIHQQY

SEQ ID NO: 32802 - protein, 7 aa, Artificial Sequence
  Synthetic construct
WSIHQDF

SEQ ID NO: 32803 - protein, 7 aa, Artificial Sequence
  Synthetic construct
WSIHQDY

SEQ ID NO: 32804 - protein, 7 aa, Artificial Sequence
  Synthetic construct
WSIHQVF

SEQ ID NO: 32805 - protein, 7 aa, Artificial Sequence
  Synthetic construct
WSIHQVY

SEQ ID NO: 32806 - protein, 7 aa, Artificial Sequence
  Synthetic construct
WSILIFF

SEQ ID NO: 32807 - protein, 7 aa, Artificial Sequence
  Synthetic construct
WSILIFY

SEQ ID NO: 32808 - protein, 7 aa, Artificial Sequence
  Synthetic construct
WSILIRF

SEQ ID NO: 32809 - protein, 7 aa, Artificial Sequence
  Synthetic construct
WSILIRY

SEQ ID NO: 32810 - protein, 7 aa, Artificial Sequence
  Synthetic construct
WSILICF

SEQ ID NO: 32811 - protein, 7 aa, Artificial Sequence
  Synthetic construct
WSILICY

SEQ ID NO: 32812 - protein, 7 aa, Artificial Sequence
  Synthetic construct
WSILILF

SEQ ID NO: 32813 - protein, 7 aa, Artificial Sequence
  Synthetic construct
WSILILY

SEQ ID NO: 32814 - protein, 7 aa, Artificial Sequence
  Synthetic construct
WSILIAF

SEQ ID NO: 32815 - protein, 7 aa, Artificial Sequence
  Synthetic construct
WSILIAY

SEQ ID NO: 32816 - protein, 7 aa, Artificial Sequence
  Synthetic construct
WSILIQF

SEQ ID NO: 32817 - protein, 7 aa, Artificial Sequence
  Synthetic construct
WSILIQY

SEQ ID NO: 32818 - protein, 7 aa, Artificial Sequence
  Synthetic construct
WSILIDF

SEQ ID NO: 32819 - protein, 7 aa, Artificial Sequence
  Synthetic construct
WSILIDY

SEQ ID NO: 32820 - protein, 7 aa, Artificial Sequence
  Synthetic construct
WSILIVF

SEQ ID NO: 32821 - protein, 7 aa, Artificial Sequence
  Synthetic construct
WSILIVY

SEQ ID NO: 32822 - protein, 7 aa, Artificial Sequence
  Synthetic construct
WSILDFF

SEQ ID NO: 32823 - protein, 7 aa, Artificial Sequence
  Synthetic construct
WSILDFY

SEQ ID NO: 32824 - protein, 7 aa, Artificial Sequence
  Synthetic construct
WSILDRF

SEQ ID NO: 32825 - protein, 7 aa, Artificial Sequence
  Synthetic construct
WSILDRY

SEQ ID NO: 32826 - protein, 7 aa, Artificial Sequence
  Synthetic construct
WSILDCF

SEQ ID NO: 32827 - protein, 7 aa, Artificial Sequence
  Synthetic construct
WSILDCY

SEQ ID NO: 32828 - protein, 7 aa, Artificial Sequence
  Synthetic construct
WSILDLF

SEQ ID NO: 32829 - protein, 7 aa, Artificial Sequence
  Synthetic construct
WSILDLY

SEQ ID NO: 32830 - protein, 7 aa, Artificial Sequence
  Synthetic construct
WSILDAF

SEQ ID NO: 32831 - protein, 7 aa, Artificial Sequence
  Synthetic construct
WSILDAY

SEQ ID NO: 32832 - protein, 7 aa, Artificial Sequence
  Synthetic construct
WSILDQF

SEQ ID NO: 32833 - protein, 7 aa, Artificial Sequence
  Synthetic construct
WSILDQY

SEQ ID NO: 32834 - protein, 7 aa, Artificial Sequence
  Synthetic construct
WSILDDF

SEQ ID NO: 32835 - protein, 7 aa, Artificial Sequence
  Synthetic construct
WSILDDY

SEQ ID NO: 32836 - protein, 7 aa, Artificial Sequence
  Synthetic construct
WSILDVF

SEQ ID NO: 32837 - protein, 7 aa, Artificial Sequence
  Synthetic construct
WSILDVY

SEQ ID NO: 32838 - protein, 7 aa, Artificial Sequence
  Synthetic construct
WSILYFF

SEQ ID NO: 32839 - protein, 7 aa, Artificial Sequence
  Synthetic construct
WSILYFY

SEQ ID NO: 32840 - protein, 7 aa, Artificial Sequence
  Synthetic construct
WSILYRF

SEQ ID NO: 32841 - protein, 7 aa, Artificial Sequence
  Synthetic construct
WSILYRY

SEQ ID NO: 32842 - protein, 7 aa, Artificial Sequence
  Synthetic construct
WSILYCF

SEQ ID NO: 32843 - protein, 7 aa, Artificial Sequence
  Synthetic construct
WSILYCY

SEQ ID NO: 32844 - protein, 7 aa, Artificial Sequence
  Synthetic construct
WSILYLF

SEQ ID NO: 32845 - protein, 7 aa, Artificial Sequence
  Synthetic construct
WSILYLY

SEQ ID NO: 32846 - protein, 7 aa, Artificial Sequence
  Synthetic construct
WSILYAF

SEQ ID NO: 32847 - protein, 7 aa, Artificial Sequence
  Synthetic construct
WSILYAY

SEQ ID NO: 32848 - protein, 7 aa, Artificial Sequence
  Synthetic construct
WSILYQF

SEQ ID NO: 32849 - protein, 7 aa, Artificial Sequence
  Synthetic construct
WSILYQY

SEQ ID NO: 32850 - protein, 7 aa, Artificial Sequence
  Synthetic construct
WSILYDF

SEQ ID NO: 32851 - protein, 7 aa, Artificial Sequence
  Synthetic construct
WSILYDY

SEQ ID NO: 32852 - protein, 7 aa, Artificial Sequence
  Synthetic construct
WSILYVF

SEQ ID NO: 32853 - protein, 7 aa, Artificial Sequence
  Synthetic construct
WSILYVY

SEQ ID NO: 32854 - protein, 7 aa, Artificial Sequence
  Synthetic construct
WSILFFF

SEQ ID NO: 32855 - protein, 7 aa, Artificial Sequence
  Synthetic construct
WSILFFY

SEQ ID NO: 32856 - protein, 7 aa, Artificial Sequence
  Synthetic construct
WSILFRF

SEQ ID NO: 32857 - protein, 7 aa, Artificial Sequence
  Synthetic construct
WSILFRY

SEQ ID NO: 32858 - protein, 7 aa, Artificial Sequence
  Synthetic construct
WSILFCF

SEQ ID NO: 32859 - protein, 7 aa, Artificial Sequence
  Synthetic construct
WSILFCY

SEQ ID NO: 32860 - protein, 7 aa, Artificial Sequence
  Synthetic construct
WSILFLF

SEQ ID NO: 32861 - protein, 7 aa, Artificial Sequence
  Synthetic construct
WSILFLY

SEQ ID NO: 32862 - protein, 7 aa, Artificial Sequence
  Synthetic construct
WSILFAF

SEQ ID NO: 32863 - protein, 7 aa, Artificial Sequence
  Synthetic construct
WSILFAY

SEQ ID NO: 32864 - protein, 7 aa, Artificial Sequence
  Synthetic construct
WSILFQF

SEQ ID NO: 32865 - protein, 7 aa, Artificial Sequence
  Synthetic construct
WSILFQY

SEQ ID NO: 32866 - protein, 7 aa, Artificial Sequence
  Synthetic construct
WSILFDF

SEQ ID NO: 32867 - protein, 7 aa, Artificial Sequence
  Synthetic construct
WSILFDY

SEQ ID NO: 32868 - protein, 7 aa, Artificial Sequence
  Synthetic construct
WSILFVF

SEQ ID NO: 32869 - protein, 7 aa, Artificial Sequence
  Synthetic construct
WSILFVY

SEQ ID NO: 32870 - protein, 7 aa, Artificial Sequence
  Synthetic construct
WSILVFF

SEQ ID NO: 32871 - protein, 7 aa, Artificial Sequence
  Synthetic construct
WSILVFY

SEQ ID NO: 32872 - protein, 7 aa, Artificial Sequence
  Synthetic construct
WSILVRF

SEQ ID NO: 32873 - protein, 7 aa, Artificial Sequence
  Synthetic construct
WSILVRY

SEQ ID NO: 32874 - protein, 7 aa, Artificial Sequence
  Synthetic construct
WSILVCF

SEQ ID NO: 32875 - protein, 7 aa, Artificial Sequence
  Synthetic construct
WSILVCY

SEQ ID NO: 32876 - protein, 7 aa, Artificial Sequence
  Synthetic construct
WSILVLF

SEQ ID NO: 32877 - protein, 7 aa, Artificial Sequence
  Synthetic construct
WSILVLY

SEQ ID NO: 32878 - protein, 7 aa, Artificial Sequence
  Synthetic construct
WSILVAF

SEQ ID NO: 32879 - protein, 7 aa, Artificial Sequence
  Synthetic construct
WSILVAY

SEQ ID NO: 32880 - protein, 7 aa, Artificial Sequence
  Synthetic construct
WSILVQF

SEQ ID NO: 32881 - protein, 7 aa, Artificial Sequence
  Synthetic construct
WSILVQY

SEQ ID NO: 32882 - protein, 7 aa, Artificial Sequence
  Synthetic construct
WSILVDF

SEQ ID NO: 32883 - protein, 7 aa, Artificial Sequence
  Synthetic construct
WSILVDY

SEQ ID NO: 32884 - protein, 7 aa, Artificial Sequence
  Synthetic construct
WSILVVF

SEQ ID NO: 32885 - protein, 7 aa, Artificial Sequence
  Synthetic construct
WSILVVY

SEQ ID NO: 32886 - protein, 7 aa, Artificial Sequence
  Synthetic construct
WSILTFF

SEQ ID NO: 32887 - protein, 7 aa, Artificial Sequence
  Synthetic construct
WSILTFY

SEQ ID NO: 32888 - protein, 7 aa, Artificial Sequence
  Synthetic construct
WSILTRF

SEQ ID NO: 32889 - protein, 7 aa, Artificial Sequence
  Synthetic construct
WSILTRY

SEQ ID NO: 32890 - protein, 7 aa, Artificial Sequence
  Synthetic construct
WSILTCF

SEQ ID NO: 32891 - protein, 7 aa, Artificial Sequence
  Synthetic construct
WSILTCY

SEQ ID NO: 32892 - protein, 7 aa, Artificial Sequence
  Synthetic construct
WSILTLF

SEQ ID NO: 32893 - protein, 7 aa, Artificial Sequence
  Synthetic construct
WSILTLY

SEQ ID NO: 32894 - protein, 7 aa, Artificial Sequence
  Synthetic construct
WSILTAF

SEQ ID NO: 32895 - protein, 7 aa, Artificial Sequence
  Synthetic construct
WSILTAY

SEQ ID NO: 32896 - protein, 7 aa, Artificial Sequence
  Synthetic construct
WSILTQF

SEQ ID NO: 32897 - protein, 7 aa, Artificial Sequence
  Synthetic construct
WSILTQY

SEQ ID NO: 32898 - protein, 7 aa, Artificial Sequence
  Synthetic construct
WSILTDF

SEQ ID NO: 32899 - protein, 7 aa, Artificial Sequence
  Synthetic construct
WSILTDY

SEQ ID NO: 32900 - protein, 7 aa, Artificial Sequence
  Synthetic construct
WSILTVF

SEQ ID NO: 32901 - protein, 7 aa, Artificial Sequence
  Synthetic construct
WSILTVY

SEQ ID NO: 32902 - protein, 7 aa, Artificial Sequence
  Synthetic construct
WSILGFF

SEQ ID NO: 32903 - protein, 7 aa, Artificial Sequence
  Synthetic construct
WSILGFY

SEQ ID NO: 32904 - protein, 7 aa, Artificial Sequence
  Synthetic construct
WSILGRF

SEQ ID NO: 32905 - protein, 7 aa, Artificial Sequence
  Synthetic construct
WSILGRY

SEQ ID NO: 32906 - protein, 7 aa, Artificial Sequence
  Synthetic construct
WSILGCF

SEQ ID NO: 32907 - protein, 7 aa, Artificial Sequence
  Synthetic construct
WSILGCY

SEQ ID NO: 32908 - protein, 7 aa, Artificial Sequence
  Synthetic construct
WSILGLF

SEQ ID NO: 32909 - protein, 7 aa, Artificial Sequence
  Synthetic construct
WSILGLY

SEQ ID NO: 32910 - protein, 7 aa, Artificial Sequence
  Synthetic construct
WSILGAF

SEQ ID NO: 32911 - protein, 7 aa, Artificial Sequence
  Synthetic construct
WSILGAY

SEQ ID NO: 32912 - protein, 7 aa, Artificial Sequence
  Synthetic construct
WSILGQF

SEQ ID NO: 32913 - protein, 7 aa, Artificial Sequence
  Synthetic construct
WSILGQY

SEQ ID NO: 32914 - protein, 7 aa, Artificial Sequence
  Synthetic construct
WSILGDF

SEQ ID NO: 32915 - protein, 7 aa, Artificial Sequence
  Synthetic construct
WSILGDY

SEQ ID NO: 32916 - protein, 7 aa, Artificial Sequence
  Synthetic construct
WSILGVF

SEQ ID NO: 32917 - protein, 7 aa, Artificial Sequence
  Synthetic construct
WSILGVY

SEQ ID NO: 32918 - protein, 7 aa, Artificial Sequence
  Synthetic construct
WSILAFF

SEQ ID NO: 32919 - protein, 7 aa, Artificial Sequence
  Synthetic construct
WSILAFY

SEQ ID NO: 32920 - protein, 7 aa, Artificial Sequence
  Synthetic construct
WSILARF

SEQ ID NO: 32921 - protein, 7 aa, Artificial Sequence
  Synthetic construct
WSILARY

SEQ ID NO: 32922 - protein, 7 aa, Artificial Sequence
  Synthetic construct
WSILACF

SEQ ID NO: 32923 - protein, 7 aa, Artificial Sequence
  Synthetic construct
WSILACY

SEQ ID NO: 32924 - protein, 7 aa, Artificial Sequence
  Synthetic construct
WSILALF

SEQ ID NO: 32925 - protein, 7 aa, Artificial Sequence
  Synthetic construct
WSILALY

SEQ ID NO: 32926 - protein, 7 aa, Artificial Sequence
  Synthetic construct
WSILAAF

SEQ ID NO: 32927 - protein, 7 aa, Artificial Sequence
  Synthetic construct
WSILAAY

SEQ ID NO: 32928 - protein, 7 aa, Artificial Sequence
  Synthetic construct
WSILAQF

SEQ ID NO: 32929 - protein, 7 aa, Artificial Sequence
  Synthetic construct
WSILAQY

SEQ ID NO: 32930 - protein, 7 aa, Artificial Sequence
  Synthetic construct
WSILADF

SEQ ID NO: 32931 - protein, 7 aa, Artificial Sequence
  Synthetic construct
WSILADY

SEQ ID NO: 32932 - protein, 7 aa, Artificial Sequence
  Synthetic construct
WSILAVF

SEQ ID NO: 32933 - protein, 7 aa, Artificial Sequence
  Synthetic construct
WSILAVY

SEQ ID NO: 32934 - protein, 7 aa, Artificial Sequence
  Synthetic construct
WSILQFF

SEQ ID NO: 32935 - protein, 7 aa, Artificial Sequence
  Synthetic construct
WSILQFY

SEQ ID NO: 32936 - protein, 7 aa, Artificial Sequence
  Synthetic construct
WSILQRF

SEQ ID NO: 32937 - protein, 7 aa, Artificial Sequence
  Synthetic construct
WSILQRY

SEQ ID NO: 32938 - protein, 7 aa, Artificial Sequence
  Synthetic construct
WSILQCF

SEQ ID NO: 32939 - protein, 7 aa, Artificial Sequence
  Synthetic construct
WSILQCY

SEQ ID NO: 32940 - protein, 7 aa, Artificial Sequence
  Synthetic construct
WSILQLF

SEQ ID NO: 32941 - protein, 7 aa, Artificial Sequence
  Synthetic construct
WSILQLY

SEQ ID NO: 32942 - protein, 7 aa, Artificial Sequence
  Synthetic construct
WSILQAF

SEQ ID NO: 32943 - protein, 7 aa, Artificial Sequence
  Synthetic construct
WSILQAY

SEQ ID NO: 32944 - protein, 7 aa, Artificial Sequence
  Synthetic construct
WSILQQF

SEQ ID NO: 32945 - protein, 7 aa, Artificial Sequence
  Synthetic construct
WSILQQY

SEQ ID NO: 32946 - protein, 7 aa, Artificial Sequence
  Synthetic construct
WSILQDF

SEQ ID NO: 32947 - protein, 7 aa, Artificial Sequence
  Synthetic construct
WSILQDY

SEQ ID NO: 32948 - protein, 7 aa, Artificial Sequence
  Synthetic construct
WSILQVF

SEQ ID NO: 32949 - protein, 7 aa, Artificial Sequence
  Synthetic construct
WSILQVY

SEQ ID NO: 32950 - protein, 7 aa, Artificial Sequence
  Synthetic construct
WSIFIFF

SEQ ID NO: 32951 - protein, 7 aa, Artificial Sequence
  Synthetic construct
WSIFIFY

SEQ ID NO: 32952 - protein, 7 aa, Artificial Sequence
  Synthetic construct
WSIFIRF

SEQ ID NO: 32953 - protein, 7 aa, Artificial Sequence
  Synthetic construct
WSIFIRY

SEQ ID NO: 32954 - protein, 7 aa, Artificial Sequence
  Synthetic construct
WSIFICF

SEQ ID NO: 32955 - protein, 7 aa, Artificial Sequence
  Synthetic construct
WSIFICY

SEQ ID NO: 32956 - protein, 7 aa, Artificial Sequence
  Synthetic construct
WSIFILF

SEQ ID NO: 32957 - protein, 7 aa, Artificial Sequence
  Synthetic construct
WSIFILY

SEQ ID NO: 32958 - protein, 7 aa, Artificial Sequence
  Synthetic construct
WSIFIAF

SEQ ID NO: 32959 - protein, 7 aa, Artificial Sequence
  Synthetic construct
WSIFIAY

SEQ ID NO: 32960 - protein, 7 aa, Artificial Sequence
  Synthetic construct
WSIFIQF

SEQ ID NO: 32961 - protein, 7 aa, Artificial Sequence
  Synthetic construct
WSIFIQY

SEQ ID NO: 32962 - protein, 7 aa, Artificial Sequence
  Synthetic construct
WSIFIDF

SEQ ID NO: 32963 - protein, 7 aa, Artificial Sequence
  Synthetic construct
WSIFIDY

SEQ ID NO: 32964 - protein, 7 aa, Artificial Sequence
  Synthetic construct
WSIFIVF

SEQ ID NO: 32965 - protein, 7 aa, Artificial Sequence
  Synthetic construct
WSIFIVY

SEQ ID NO: 32966 - protein, 7 aa, Artificial Sequence
  Synthetic construct
WSIFDFF

SEQ ID NO: 32967 - protein, 7 aa, Artificial Sequence
  Synthetic construct
WSIFDFY

SEQ ID NO: 32968 - protein, 7 aa, Artificial Sequence
  Synthetic construct
WSIFDRF

SEQ ID NO: 32969 - protein, 7 aa, Artificial Sequence
  Synthetic construct
WSIFDRY

SEQ ID NO: 32970 - protein, 7 aa, Artificial Sequence
  Synthetic construct
WSIFDCF

SEQ ID NO: 32971 - protein, 7 aa, Artificial Sequence
  Synthetic construct
WSIFDCY

SEQ ID NO: 32972 - protein, 7 aa, Artificial Sequence
  Synthetic construct
WSIFDLF

SEQ ID NO: 32973 - protein, 7 aa, Artificial Sequence
  Synthetic construct
WSIFDLY

SEQ ID NO: 32974 - protein, 7 aa, Artificial Sequence
  Synthetic construct
WSIFDAF

SEQ ID NO: 32975 - protein, 7 aa, Artificial Sequence
  Synthetic construct
WSIFDAY

SEQ ID NO: 32976 - protein, 7 aa, Artificial Sequence
  Synthetic construct
WSIFDQF

SEQ ID NO: 32977 - protein, 7 aa, Artificial Sequence
  Synthetic construct
WSIFDQY

SEQ ID NO: 32978 - protein, 7 aa, Artificial Sequence
  Synthetic construct
WSIFDDF

SEQ ID NO: 32979 - protein, 7 aa, Artificial Sequence
  Synthetic construct
WSIFDDY

SEQ ID NO: 32980 - protein, 7 aa, Artificial Sequence
  Synthetic construct
WSIFDVF

SEQ ID NO: 32981 - protein, 7 aa, Artificial Sequence
  Synthetic construct
WSIFDVY

SEQ ID NO: 32982 - protein, 7 aa, Artificial Sequence
  Synthetic construct
WSIFYFF

SEQ ID NO: 32983 - protein, 7 aa, Artificial Sequence
  Synthetic construct
WSIFYFY

SEQ ID NO: 32984 - protein, 7 aa, Artificial Sequence
  Synthetic construct
WSIFYRF

SEQ ID NO: 32985 - protein, 7 aa, Artificial Sequence
  Synthetic construct
WSIFYRY

SEQ ID NO: 32986 - protein, 7 aa, Artificial Sequence
  Synthetic construct
WSIFYCF

SEQ ID NO: 32987 - protein, 7 aa, Artificial Sequence
  Synthetic construct
WSIFYCY

SEQ ID NO: 32988 - protein, 7 aa, Artificial Sequence
  Synthetic construct
WSIFYLF

SEQ ID NO: 32989 - protein, 7 aa, Artificial Sequence
  Synthetic construct
WSIFYLY

SEQ ID NO: 32990 - protein, 7 aa, Artificial Sequence
  Synthetic construct
WSIFYAF

SEQ ID NO: 32991 - protein, 7 aa, Artificial Sequence
  Synthetic construct
WSIFYAY

SEQ ID NO: 32992 - protein, 7 aa, Artificial Sequence
  Synthetic construct
WSIFYQF

SEQ ID NO: 32993 - protein, 7 aa, Artificial Sequence
  Synthetic construct
WSIFYQY

SEQ ID NO: 32994 - protein, 7 aa, Artificial Sequence
  Synthetic construct
WSIFYDF

SEQ ID NO: 32995 - protein, 7 aa, Artificial Sequence
  Synthetic construct
WSIFYDY

SEQ ID NO: 32996 - protein, 7 aa, Artificial Sequence
  Synthetic construct
WSIFYVF

SEQ ID NO: 32997 - protein, 7 aa, Artificial Sequence
  Synthetic construct
WSIFYVY

SEQ ID NO: 32998 - protein, 7 aa, Artificial Sequence
  Synthetic construct
WSIFFFF

SEQ ID NO: 32999 - protein, 7 aa, Artificial Sequence
  Synthetic construct
WSIFFFY

SEQ ID NO: 33000 - protein, 7 aa, Artificial Sequence
  Synthetic construct
WSIFFRF

SEQ ID NO: 33001 - protein, 7 aa, Artificial Sequence
  Synthetic construct
WSIFFRY

SEQ ID NO: 33002 - protein, 7 aa, Artificial Sequence
  Synthetic construct
WSIFFCF

SEQ ID NO: 33003 - protein, 7 aa, Artificial Sequence
  Synthetic construct
WSIFFCY

SEQ ID NO: 33004 - protein, 7 aa, Artificial Sequence
  Synthetic construct
WSIFFLF

SEQ ID NO: 33005 - protein, 7 aa, Artificial Sequence
  Synthetic construct
WSIFFLY

SEQ ID NO: 33006 - protein, 7 aa, Artificial Sequence
  Synthetic construct
WSIFFAF

SEQ ID NO: 33007 - protein, 7 aa, Artificial Sequence
  Synthetic construct
WSIFFAY

SEQ ID NO: 33008 - protein, 7 aa, Artificial Sequence
  Synthetic construct
WSIFFQF

SEQ ID NO: 33009 - protein, 7 aa, Artificial Sequence
  Synthetic construct
WSIFFQY

SEQ ID NO: 33010 - protein, 7 aa, Artificial Sequence
  Synthetic construct
WSIFFDF

SEQ ID NO: 33011 - protein, 7 aa, Artificial Sequence
  Synthetic construct
WSIFFDY

SEQ ID NO: 33012 - protein, 7 aa, Artificial Sequence
  Synthetic construct
WSIFFVF

SEQ ID NO: 33013 - protein, 7 aa, Artificial Sequence
  Synthetic construct
WSIFFVY

SEQ ID NO: 33014 - protein, 7 aa, Artificial Sequence
  Synthetic construct
WSIFVFF

SEQ ID NO: 33015 - protein, 7 aa, Artificial Sequence
  Synthetic construct
WSIFVFY

SEQ ID NO: 33016 - protein, 7 aa, Artificial Sequence
  Synthetic construct
WSIFVRF

SEQ ID NO: 33017 - protein, 7 aa, Artificial Sequence
  Synthetic construct
WSIFVRY

SEQ ID NO: 33018 - protein, 7 aa, Artificial Sequence
  Synthetic construct
WSIFVCF

SEQ ID NO: 33019 - protein, 7 aa, Artificial Sequence
  Synthetic construct
WSIFVCY

SEQ ID NO: 33020 - protein, 7 aa, Artificial Sequence
  Synthetic construct
WSIFVLF

SEQ ID NO: 33021 - protein, 7 aa, Artificial Sequence
  Synthetic construct
WSIFVLY

SEQ ID NO: 33022 - protein, 7 aa, Artificial Sequence
  Synthetic construct
WSIFVAF

SEQ ID NO: 33023 - protein, 7 aa, Artificial Sequence
  Synthetic construct
WSIFVAY

SEQ ID NO: 33024 - protein, 7 aa, Artificial Sequence
  Synthetic construct
WSIFVQF

SEQ ID NO: 33025 - protein, 7 aa, Artificial Sequence
  Synthetic construct
WSIFVQY

SEQ ID NO: 33026 - protein, 7 aa, Artificial Sequence
  Synthetic construct
WSIFVDF

SEQ ID NO: 33027 - protein, 7 aa, Artificial Sequence
  Synthetic construct
WSIFVDY

SEQ ID NO: 33028 - protein, 7 aa, Artificial Sequence
  Synthetic construct
WSIFVVF

SEQ ID NO: 33029 - protein, 7 aa, Artificial Sequence
  Synthetic construct
WSIFVVY

SEQ ID NO: 33030 - protein, 7 aa, Artificial Sequence
  Synthetic construct
WSIFTFF

SEQ ID NO: 33031 - protein, 7 aa, Artificial Sequence
  Synthetic construct
WSIFTFY

SEQ ID NO: 33032 - protein, 7 aa, Artificial Sequence
  Synthetic construct
WSIFTRF

SEQ ID NO: 33033 - protein, 7 aa, Artificial Sequence
  Synthetic construct
WSIFTRY

SEQ ID NO: 33034 - protein, 7 aa, Artificial Sequence
  Synthetic construct
WSIFTCF

SEQ ID NO: 33035 - protein, 7 aa, Artificial Sequence
  Synthetic construct
WSIFTCY

SEQ ID NO: 33036 - protein, 7 aa, Artificial Sequence
  Synthetic construct
WSIFTLF

SEQ ID NO: 33037 - protein, 7 aa, Artificial Sequence
  Synthetic construct
WSIFTLY

SEQ ID NO: 33038 - protein, 7 aa, Artificial Sequence
  Synthetic construct
WSIFTAF

SEQ ID NO: 33039 - protein, 7 aa, Artificial Sequence
  Synthetic construct
WSIFTAY

SEQ ID NO: 33040 - protein, 7 aa, Artificial Sequence
  Synthetic construct
WSIFTQF

SEQ ID NO: 33041 - protein, 7 aa, Artificial Sequence
  Synthetic construct
WSIFTQY

SEQ ID NO: 33042 - protein, 7 aa, Artificial Sequence
  Synthetic construct
WSIFTDF

SEQ ID NO: 33043 - protein, 7 aa, Artificial Sequence
  Synthetic construct
WSIFTDY

SEQ ID NO: 33044 - protein, 7 aa, Artificial Sequence
  Synthetic construct
WSIFTVF

SEQ ID NO: 33045 - protein, 7 aa, Artificial Sequence
  Synthetic construct
WSIFTVY

SEQ ID NO: 33046 - protein, 7 aa, Artificial Sequence
  Synthetic construct
WSIFGFF

SEQ ID NO: 33047 - protein, 7 aa, Artificial Sequence
  Synthetic construct
WSIFGFY

SEQ ID NO: 33048 - protein, 7 aa, Artificial Sequence
  Synthetic construct
WSIFGRF

SEQ ID NO: 33049 - protein, 7 aa, Artificial Sequence
  Synthetic construct
WSIFGRY

SEQ ID NO: 33050 - protein, 7 aa, Artificial Sequence
  Synthetic construct
WSIFGCF

SEQ ID NO: 33051 - protein, 7 aa, Artificial Sequence
  Synthetic construct
WSIFGCY

SEQ ID NO: 33052 - protein, 7 aa, Artificial Sequence
  Synthetic construct
WSIFGLF

SEQ ID NO: 33053 - protein, 7 aa, Artificial Sequence
  Synthetic construct
WSIFGLY

SEQ ID NO: 33054 - protein, 7 aa, Artificial Sequence
  Synthetic construct
WSIFGAF

SEQ ID NO: 33055 - protein, 7 aa, Artificial Sequence
  Synthetic construct
WSIFGAY

SEQ ID NO: 33056 - protein, 7 aa, Artificial Sequence
  Synthetic construct
WSIFGQF

SEQ ID NO: 33057 - protein, 7 aa, Artificial Sequence
  Synthetic construct
WSIFGQY

SEQ ID NO: 33058 - protein, 7 aa, Artificial Sequence
  Synthetic construct
WSIFGDF

SEQ ID NO: 33059 - protein, 7 aa, Artificial Sequence
  Synthetic construct
WSIFGDY

SEQ ID NO: 33060 - protein, 7 aa, Artificial Sequence
  Synthetic construct
WSIFGVF

SEQ ID NO: 33061 - protein, 7 aa, Artificial Sequence
  Synthetic construct
WSIFGVY

SEQ ID NO: 33062 - protein, 7 aa, Artificial Sequence
  Synthetic construct
WSIFAFF

SEQ ID NO: 33063 - protein, 7 aa, Artificial Sequence
  Synthetic construct
WSIFAFY

SEQ ID NO: 33064 - protein, 7 aa, Artificial Sequence
  Synthetic construct
WSIFARF

SEQ ID NO: 33065 - protein, 7 aa, Artificial Sequence
  Synthetic construct
WSIFARY

SEQ ID NO: 33066 - protein, 7 aa, Artificial Sequence
  Synthetic construct
WSIFACF

SEQ ID NO: 33067 - protein, 7 aa, Artificial Sequence
  Synthetic construct
WSIFACY

SEQ ID NO: 33068 - protein, 7 aa, Artificial Sequence
  Synthetic construct
WSIFALF

SEQ ID NO: 33069 - protein, 7 aa, Artificial Sequence
  Synthetic construct
WSIFALY

SEQ ID NO: 33070 - protein, 7 aa, Artificial Sequence
  Synthetic construct
WSIFAAF

SEQ ID NO: 33071 - protein, 7 aa, Artificial Sequence
  Synthetic construct
WSIFAAY

SEQ ID NO: 33072 - protein, 7 aa, Artificial Sequence
  Synthetic construct
WSIFAQF

SEQ ID NO: 33073 - protein, 7 aa, Artificial Sequence
  Synthetic construct
WSIFAQY

SEQ ID NO: 33074 - protein, 7 aa, Artificial Sequence
  Synthetic construct
WSIFADF

SEQ ID NO: 33075 - protein, 7 aa, Artificial Sequence
  Synthetic construct
WSIFADY

SEQ ID NO: 33076 - protein, 7 aa, Artificial Sequence
  Synthetic construct
WSIFAVF

SEQ ID NO: 33077 - protein, 7 aa, Artificial Sequence
  Synthetic construct
WSIFAVY

SEQ ID NO: 33078 - protein, 7 aa, Artificial Sequence
  Synthetic construct
WSIFQFF

SEQ ID NO: 33079 - protein, 7 aa, Artificial Sequence
  Synthetic construct
WSIFQFY

SEQ ID NO: 33080 - protein, 7 aa, Artificial Sequence
  Synthetic construct
WSIFQRF

SEQ ID NO: 33081 - protein, 7 aa, Artificial Sequence
  Synthetic construct
WSIFQRY

SEQ ID NO: 33082 - protein, 7 aa, Artificial Sequence
  Synthetic construct
WSIFQCF

SEQ ID NO: 33083 - protein, 7 aa, Artificial Sequence
  Synthetic construct
WSIFQCY

SEQ ID NO: 33084 - protein, 7 aa, Artificial Sequence
  Synthetic construct
WSIFQLF

SEQ ID NO: 33085 - protein, 7 aa, Artificial Sequence
  Synthetic construct
WSIFQLY

SEQ ID NO: 33086 - protein, 7 aa, Artificial Sequence
  Synthetic construct
WSIFQAF

SEQ ID NO: 33087 - protein, 7 aa, Artificial Sequence
  Synthetic construct
WSIFQAY

SEQ ID NO: 33088 - protein, 7 aa, Artificial Sequence
  Synthetic construct
WSIFQQF

SEQ ID NO: 33089 - protein, 7 aa, Artificial Sequence
  Synthetic construct
WSIFQQY

SEQ ID NO: 33090 - protein, 7 aa, Artificial Sequence
  Synthetic construct
WSIFQDF

SEQ ID NO: 33091 - protein, 7 aa, Artificial Sequence
  Synthetic construct
WSIFQDY

SEQ ID NO: 33092 - protein, 7 aa, Artificial Sequence
  Synthetic construct
WSIFQVF

SEQ ID NO: 33093 - protein, 7 aa, Artificial Sequence
  Synthetic construct
WSIFQVY

SEQ ID NO: 33094 - protein, 7 aa, Artificial Sequence
  Synthetic construct
WSGYIFF

SEQ ID NO: 33095 - protein, 7 aa, Artificial Sequence
  Synthetic construct
WSGYIFY

SEQ ID NO: 33096 - protein, 7 aa, Artificial Sequence
  Synthetic construct
WSGYIRF

SEQ ID NO: 33097 - protein, 7 aa, Artificial Sequence
  Synthetic construct
WSGYIRY

SEQ ID NO: 33098 - protein, 7 aa, Artificial Sequence
  Synthetic construct
WSGYICF

SEQ ID NO: 33099 - protein, 7 aa, Artificial Sequence
  Synthetic construct
WSGYICY

SEQ ID NO: 33100 - protein, 7 aa, Artificial Sequence
  Synthetic construct
WSGYILF

SEQ ID NO: 33101 - protein, 7 aa, Artificial Sequence
  Synthetic construct
WSGYILY

SEQ ID NO: 33102 - protein, 7 aa, Artificial Sequence
  Synthetic construct
WSGYIAF

SEQ ID NO: 33103 - protein, 7 aa, Artificial Sequence
  Synthetic construct
WSGYIAY

SEQ ID NO: 33104 - protein, 7 aa, Artificial Sequence
  Synthetic construct
WSGYIQF

SEQ ID NO: 33105 - protein, 7 aa, Artificial Sequence
  Synthetic construct
WSGYIQY

SEQ ID NO: 33106 - protein, 7 aa, Artificial Sequence
  Synthetic construct
WSGYIDF

SEQ ID NO: 33107 - protein, 7 aa, Artificial Sequence
  Synthetic construct
WSGYIDY

SEQ ID NO: 33108 - protein, 7 aa, Artificial Sequence
  Synthetic construct
WSGYIVF

SEQ ID NO: 33109 - protein, 7 aa, Artificial Sequence
  Synthetic construct
WSGYIVY

SEQ ID NO: 33110 - protein, 7 aa, Artificial Sequence
  Synthetic construct
WSGYDFF

SEQ ID NO: 33111 - protein, 7 aa, Artificial Sequence
  Synthetic construct
WSGYDFY

SEQ ID NO: 33112 - protein, 7 aa, Artificial Sequence
  Synthetic construct
WSGYDRF

SEQ ID NO: 33113 - protein, 7 aa, Artificial Sequence
  Synthetic construct
WSGYDRY

SEQ ID NO: 33114 - protein, 7 aa, Artificial Sequence
  Synthetic construct
WSGYDCF

SEQ ID NO: 33115 - protein, 7 aa, Artificial Sequence
  Synthetic construct
WSGYDCY

SEQ ID NO: 33116 - protein, 7 aa, Artificial Sequence
  Synthetic construct
WSGYDLF

SEQ ID NO: 33117 - protein, 7 aa, Artificial Sequence
  Synthetic construct
WSGYDLY

SEQ ID NO: 33118 - protein, 7 aa, Artificial Sequence
  Synthetic construct
WSGYDAF

SEQ ID NO: 33119 - protein, 7 aa, Artificial Sequence
  Synthetic construct
WSGYDAY

SEQ ID NO: 33120 - protein, 7 aa, Artificial Sequence
  Synthetic construct
WSGYDQF

SEQ ID NO: 33121 - protein, 7 aa, Artificial Sequence
  Synthetic construct
WSGYDQY

SEQ ID NO: 33122 - protein, 7 aa, Artificial Sequence
  Synthetic construct
WSGYDDF

SEQ ID NO: 33123 - protein, 7 aa, Artificial Sequence
  Synthetic construct
WSGYDDY

SEQ ID NO: 33124 - protein, 7 aa, Artificial Sequence
  Synthetic construct
WSGYDVF

SEQ ID NO: 33125 - protein, 7 aa, Artificial Sequence
  Synthetic construct
WSGYDVY

SEQ ID NO: 33126 - protein, 7 aa, Artificial Sequence
  Synthetic construct
WSGYYFF

SEQ ID NO: 33127 - protein, 7 aa, Artificial Sequence
  Synthetic construct
WSGYYFY

SEQ ID NO: 33128 - protein, 7 aa, Artificial Sequence
  Synthetic construct
WSGYYRF

SEQ ID NO: 33129 - protein, 7 aa, Artificial Sequence
  Synthetic construct
WSGYYRY

SEQ ID NO: 33130 - protein, 7 aa, Artificial Sequence
  Synthetic construct
WSGYYCF

SEQ ID NO: 33131 - protein, 7 aa, Artificial Sequence
  Synthetic construct
WSGYYCY

SEQ ID NO: 33132 - protein, 7 aa, Artificial Sequence
  Synthetic construct
WSGYYLF

SEQ ID NO: 33133 - protein, 7 aa, Artificial Sequence
  Synthetic construct
WSGYYLY

SEQ ID NO: 33134 - protein, 7 aa, Artificial Sequence
  Synthetic construct
WSGYYAF

SEQ ID NO: 33135 - protein, 7 aa, Artificial Sequence
  Synthetic construct
WSGYYAY

SEQ ID NO: 33136 - protein, 7 aa, Artificial Sequence
  Synthetic construct
WSGYYQF

SEQ ID NO: 33137 - protein, 7 aa, Artificial Sequence
  Synthetic construct
WSGYYQY

SEQ ID NO: 33138 - protein, 7 aa, Artificial Sequence
  Synthetic construct
WSGYYDF

SEQ ID NO: 33139 - protein, 7 aa, Artificial Sequence
  Synthetic construct
WSGYYDY

SEQ ID NO: 33140 - protein, 7 aa, Artificial Sequence
  Synthetic construct
WSGYYVF

SEQ ID NO: 33141 - protein, 7 aa, Artificial Sequence
  Synthetic construct
WSGYYVY

SEQ ID NO: 33142 - protein, 7 aa, Artificial Sequence
  Synthetic construct
WSGYFFF

SEQ ID NO: 33143 - protein, 7 aa, Artificial Sequence
  Synthetic construct
WSGYFFY

SEQ ID NO: 33144 - protein, 7 aa, Artificial Sequence
  Synthetic construct
WSGYFRF

SEQ ID NO: 33145 - protein, 7 aa, Artificial Sequence
  Synthetic construct
WSGYFRY

SEQ ID NO: 33146 - protein, 7 aa, Artificial Sequence
  Synthetic construct
WSGYFCF

SEQ ID NO: 33147 - protein, 7 aa, Artificial Sequence
  Synthetic construct
WSGYFCY

SEQ ID NO: 33148 - protein, 7 aa, Artificial Sequence
  Synthetic construct
WSGYFLF

SEQ ID NO: 33149 - protein, 7 aa, Artificial Sequence
  Synthetic construct
WSGYFLY

SEQ ID NO: 33150 - protein, 7 aa, Artificial Sequence
  Synthetic construct
WSGYFAF

SEQ ID NO: 33151 - protein, 7 aa, Artificial Sequence
  Synthetic construct
WSGYFAY

SEQ ID NO: 33152 - protein, 7 aa, Artificial Sequence
  Synthetic construct
WSGYFQF

SEQ ID NO: 33153 - protein, 7 aa, Artificial Sequence
  Synthetic construct
WSGYFQY

SEQ ID NO: 33154 - protein, 7 aa, Artificial Sequence
  Synthetic construct
WSGYFDF

SEQ ID NO: 33155 - protein, 7 aa, Artificial Sequence
  Synthetic construct
WSGYFDY

SEQ ID NO: 33156 - protein, 7 aa, Artificial Sequence
  Synthetic construct
WSGYFVF

SEQ ID NO: 33157 - protein, 7 aa, Artificial Sequence
  Synthetic construct
WSGYFVY

SEQ ID NO: 33158 - protein, 7 aa, Artificial Sequence
  Synthetic construct
WSGYVFF

SEQ ID NO: 33159 - protein, 7 aa, Artificial Sequence
  Synthetic construct
WSGYVFY

SEQ ID NO: 33160 - protein, 7 aa, Artificial Sequence
  Synthetic construct
WSGYVRF

SEQ ID NO: 33161 - protein, 7 aa, Artificial Sequence
  Synthetic construct
WSGYVRY

SEQ ID NO: 33162 - protein, 7 aa, Artificial Sequence
  Synthetic construct
WSGYVCF

SEQ ID NO: 33163 - protein, 7 aa, Artificial Sequence
  Synthetic construct
WSGYVCY

SEQ ID NO: 33164 - protein, 7 aa, Artificial Sequence
  Synthetic construct
WSGYVLF

SEQ ID NO: 33165 - protein, 7 aa, Artificial Sequence
  Synthetic construct
WSGYVLY

SEQ ID NO: 33166 - protein, 7 aa, Artificial Sequence
  Synthetic construct
WSGYVAF

SEQ ID NO: 33167 - protein, 7 aa, Artificial Sequence
  Synthetic construct
WSGYVAY

SEQ ID NO: 33168 - protein, 7 aa, Artificial Sequence
  Synthetic construct
WSGYVQF

SEQ ID NO: 33169 - protein, 7 aa, Artificial Sequence
  Synthetic construct
WSGYVQY

SEQ ID NO: 33170 - protein, 7 aa, Artificial Sequence
  Synthetic construct
WSGYVDF

SEQ ID NO: 33171 - protein, 7 aa, Artificial Sequence
  Synthetic construct
WSGYVDY

SEQ ID NO: 33172 - protein, 7 aa, Artificial Sequence
  Synthetic construct
WSGYVVF

SEQ ID NO: 33173 - protein, 7 aa, Artificial Sequence
  Synthetic construct
WSGYVVY

SEQ ID NO: 33174 - protein, 7 aa, Artificial Sequence
  Synthetic construct
WSGYTFF

SEQ ID NO: 33175 - protein, 7 aa, Artificial Sequence
  Synthetic construct
WSGYTFY

SEQ ID NO: 33176 - protein, 7 aa, Artificial Sequence
  Synthetic construct
WSGYTRF

SEQ ID NO: 33177 - protein, 7 aa, Artificial Sequence
  Synthetic construct
WSGYTRY

SEQ ID NO: 33178 - protein, 7 aa, Artificial Sequence
  Synthetic construct
WSGYTCF

SEQ ID NO: 33179 - protein, 7 aa, Artificial Sequence
  Synthetic construct
WSGYTCY

SEQ ID NO: 33180 - protein, 7 aa, Artificial Sequence
  Synthetic construct
WSGYTLF

SEQ ID NO: 33181 - protein, 7 aa, Artificial Sequence
  Synthetic construct
WSGYTLY

SEQ ID NO: 33182 - protein, 7 aa, Artificial Sequence
  Synthetic construct
WSGYTAF

SEQ ID NO: 33183 - protein, 7 aa, Artificial Sequence
  Synthetic construct
WSGYTAY

SEQ ID NO: 33184 - protein, 7 aa, Artificial Sequence
  Synthetic construct
WSGYTQF

SEQ ID NO: 33185 - protein, 7 aa, Artificial Sequence
  Synthetic construct
WSGYTQY

SEQ ID NO: 33186 - protein, 7 aa, Artificial Sequence
  Synthetic construct
WSGYTDF

SEQ ID NO: 33187 - protein, 7 aa, Artificial Sequence
  Synthetic construct
WSGYTDY

SEQ ID NO: 33188 - protein, 7 aa, Artificial Sequence
  Synthetic construct
WSGYTVF

SEQ ID NO: 33189 - protein, 7 aa, Artificial Sequence
  Synthetic construct
WSGYTVY

SEQ ID NO: 33190 - protein, 7 aa, Artificial Sequence
  Synthetic construct
WSGYGFF

SEQ ID NO: 33191 - protein, 7 aa, Artificial Sequence
  Synthetic construct
WSGYGFY

SEQ ID NO: 33192 - protein, 7 aa, Artificial Sequence
  Synthetic construct
WSGYGRF

SEQ ID NO: 33193 - protein, 7 aa, Artificial Sequence
  Synthetic construct
WSGYGRY

SEQ ID NO: 33194 - protein, 7 aa, Artificial Sequence
  Synthetic construct
WSGYGCF

SEQ ID NO: 33195 - protein, 7 aa, Artificial Sequence
  Synthetic construct
WSGYGCY

SEQ ID NO: 33196 - protein, 7 aa, Artificial Sequence
  Synthetic construct
WSGYGLF

SEQ ID NO: 33197 - protein, 7 aa, Artificial Sequence
  Synthetic construct
WSGYGLY

SEQ ID NO: 33198 - protein, 7 aa, Artificial Sequence
  Synthetic construct
WSGYGAF

SEQ ID NO: 33199 - protein, 7 aa, Artificial Sequence
  Synthetic construct
WSGYGAY

SEQ ID NO: 33200 - protein, 7 aa, Artificial Sequence
  Synthetic construct
WSGYGQF

SEQ ID NO: 33201 - protein, 7 aa, Artificial Sequence
  Synthetic construct
WSGYGQY

SEQ ID NO: 33202 - protein, 7 aa, Artificial Sequence
  Synthetic construct
WSGYGDF

SEQ ID NO: 33203 - protein, 7 aa, Artificial Sequence
  Synthetic construct
WSGYGDY

SEQ ID NO: 33204 - protein, 7 aa, Artificial Sequence
  Synthetic construct
WSGYGVF

SEQ ID NO: 33205 - protein, 7 aa, Artificial Sequence
  Synthetic construct
WSGYGVY

SEQ ID NO: 33206 - protein, 7 aa, Artificial Sequence
  Synthetic construct
WSGYAFF

SEQ ID NO: 33207 - protein, 7 aa, Artificial Sequence
  Synthetic construct
WSGYAFY

SEQ ID NO: 33208 - protein, 7 aa, Artificial Sequence
  Synthetic construct
WSGYARF

SEQ ID NO: 33209 - protein, 7 aa, Artificial Sequence
  Synthetic construct
WSGYARY

SEQ ID NO: 33210 - protein, 7 aa, Artificial Sequence
  Synthetic construct
WSGYACF

SEQ ID NO: 33211 - protein, 7 aa, Artificial Sequence
  Synthetic construct
WSGYACY

SEQ ID NO: 33212 - protein, 7 aa, Artificial Sequence
  Synthetic construct
WSGYALF

SEQ ID NO: 33213 - protein, 7 aa, Artificial Sequence
  Synthetic construct
WSGYALY

SEQ ID NO: 33214 - protein, 7 aa, Artificial Sequence
  Synthetic construct
WSGYAAF

SEQ ID NO: 33215 - protein, 7 aa, Artificial Sequence
  Synthetic construct
WSGYAAY

SEQ ID NO: 33216 - protein, 7 aa, Artificial Sequence
  Synthetic construct
WSGYAQF

SEQ ID NO: 33217 - protein, 7 aa, Artificial Sequence
  Synthetic construct
WSGYAQY

SEQ ID NO: 33218 - protein, 7 aa, Artificial Sequence
  Synthetic construct
WSGYADF

SEQ ID NO: 33219 - protein, 7 aa, Artificial Sequence
  Synthetic construct
WSGYADY

SEQ ID NO: 33220 - protein, 7 aa, Artificial Sequence
  Synthetic construct
WSGYAVF

SEQ ID NO: 33221 - protein, 7 aa, Artificial Sequence
  Synthetic construct
WSGYAVY

SEQ ID NO: 33222 - protein, 7 aa, Artificial Sequence
  Synthetic construct
WSGYQFF

SEQ ID NO: 33223 - protein, 7 aa, Artificial Sequence
  Synthetic construct
WSGYQFY

SEQ ID NO: 33224 - protein, 7 aa, Artificial Sequence
  Synthetic construct
WSGYQRF

SEQ ID NO: 33225 - protein, 7 aa, Artificial Sequence
  Synthetic construct
WSGYQRY

SEQ ID NO: 33226 - protein, 7 aa, Artificial Sequence
  Synthetic construct
WSGYQCF

SEQ ID NO: 33227 - protein, 7 aa, Artificial Sequence
  Synthetic construct
WSGYQCY

SEQ ID NO: 33228 - protein, 7 aa, Artificial Sequence
  Synthetic construct
WSGYQLF

SEQ ID NO: 33229 - protein, 7 aa, Artificial Sequence
  Synthetic construct
WSGYQLY

SEQ ID NO: 33230 - protein, 7 aa, Artificial Sequence
  Synthetic construct
WSGYQAF

SEQ ID NO: 33231 - protein, 7 aa, Artificial Sequence
  Synthetic construct
WSGYQAY

SEQ ID NO: 33232 - protein, 7 aa, Artificial Sequence
  Synthetic construct
WSGYQQF

SEQ ID NO: 33233 - protein, 7 aa, Artificial Sequence
  Synthetic construct
WSGYQQY

SEQ ID NO: 33234 - protein, 7 aa, Artificial Sequence
  Synthetic construct
WSGYQDF

SEQ ID NO: 33235 - protein, 7 aa, Artificial Sequence
  Synthetic construct
WSGYQDY

SEQ ID NO: 33236 - protein, 7 aa, Artificial Sequence
  Synthetic construct
WSGYQVF

SEQ ID NO: 33237 - protein, 7 aa, Artificial Sequence
  Synthetic construct
WSGYQVY

SEQ ID NO: 33238 - protein, 7 aa, Artificial Sequence
  Synthetic construct
WSGPIFF

SEQ ID NO: 33239 - protein, 7 aa, Artificial Sequence
  Synthetic construct
WSGPIFY

SEQ ID NO: 33240 - protein, 7 aa, Artificial Sequence
  Synthetic construct
WSGPIRF

SEQ ID NO: 33241 - protein, 7 aa, Artificial Sequence
  Synthetic construct
WSGPIRY

SEQ ID NO: 33242 - protein, 7 aa, Artificial Sequence
  Synthetic construct
WSGPICF

SEQ ID NO: 33243 - protein, 7 aa, Artificial Sequence
  Synthetic construct
WSGPICY

SEQ ID NO: 33244 - protein, 7 aa, Artificial Sequence
  Synthetic construct
WSGPILF

SEQ ID NO: 33245 - protein, 7 aa, Artificial Sequence
  Synthetic construct
WSGPILY

SEQ ID NO: 33246 - protein, 7 aa, Artificial Sequence
  Synthetic construct
WSGPIAF

SEQ ID NO: 33247 - protein, 7 aa, Artificial Sequence
  Synthetic construct
WSGPIAY

SEQ ID NO: 33248 - protein, 7 aa, Artificial Sequence
  Synthetic construct
WSGPIQF

SEQ ID NO: 33249 - protein, 7 aa, Artificial Sequence
  Synthetic construct
WSGPIQY

SEQ ID NO: 33250 - protein, 7 aa, Artificial Sequence
  Synthetic construct
WSGPIDF

SEQ ID NO: 33251 - protein, 7 aa, Artificial Sequence
  Synthetic construct
WSGPIDY

SEQ ID NO: 33252 - protein, 7 aa, Artificial Sequence
  Synthetic construct
WSGPIVF

SEQ ID NO: 33253 - protein, 7 aa, Artificial Sequence
  Synthetic construct
WSGPIVY

SEQ ID NO: 33254 - protein, 7 aa, Artificial Sequence
  Synthetic construct
WSGPDFF

SEQ ID NO: 33255 - protein, 7 aa, Artificial Sequence
  Synthetic construct
WSGPDFY

SEQ ID NO: 33256 - protein, 7 aa, Artificial Sequence
  Synthetic construct
WSGPDRF

SEQ ID NO: 33257 - protein, 7 aa, Artificial Sequence
  Synthetic construct
WSGPDRY

SEQ ID NO: 33258 - protein, 7 aa, Artificial Sequence
  Synthetic construct
WSGPDCF

SEQ ID NO: 33259 - protein, 7 aa, Artificial Sequence
  Synthetic construct
WSGPDCY

SEQ ID NO: 33260 - protein, 7 aa, Artificial Sequence
  Synthetic construct
WSGPDLF

SEQ ID NO: 33261 - protein, 7 aa, Artificial Sequence
  Synthetic construct
WSGPDLY

SEQ ID NO: 33262 - protein, 7 aa, Artificial Sequence
  Synthetic construct
WSGPDAF

SEQ ID NO: 33263 - protein, 7 aa, Artificial Sequence
  Synthetic construct
WSGPDAY

SEQ ID NO: 33264 - protein, 7 aa, Artificial Sequence
  Synthetic construct
WSGPDQF

SEQ ID NO: 33265 - protein, 7 aa, Artificial Sequence
  Synthetic construct
WSGPDQY

SEQ ID NO: 33266 - protein, 7 aa, Artificial Sequence
  Synthetic construct
WSGPDDF

SEQ ID NO: 33267 - protein, 7 aa, Artificial Sequence
  Synthetic construct
WSGPDDY

SEQ ID NO: 33268 - protein, 7 aa, Artificial Sequence
  Synthetic construct
WSGPDVF

SEQ ID NO: 33269 - protein, 7 aa, Artificial Sequence
  Synthetic construct
WSGPDVY

SEQ ID NO: 33270 - protein, 7 aa, Artificial Sequence
  Synthetic construct
WSGPYFF

SEQ ID NO: 33271 - protein, 7 aa, Artificial Sequence
  Synthetic construct
WSGPYFY

SEQ ID NO: 33272 - protein, 7 aa, Artificial Sequence
  Synthetic construct
WSGPYRF

SEQ ID NO: 33273 - protein, 7 aa, Artificial Sequence
  Synthetic construct
WSGPYRY

SEQ ID NO: 33274 - protein, 7 aa, Artificial Sequence
  Synthetic construct
WSGPYCF

SEQ ID NO: 33275 - protein, 7 aa, Artificial Sequence
  Synthetic construct
WSGPYCY

SEQ ID NO: 33276 - protein, 7 aa, Artificial Sequence
  Synthetic construct
WSGPYLF

SEQ ID NO: 33277 - protein, 7 aa, Artificial Sequence
  Synthetic construct
WSGPYLY

SEQ ID NO: 33278 - protein, 7 aa, Artificial Sequence
  Synthetic construct
WSGPYAF

SEQ ID NO: 33279 - protein, 7 aa, Artificial Sequence
  Synthetic construct
WSGPYAY

SEQ ID NO: 33280 - protein, 7 aa, Artificial Sequence
  Synthetic construct
WSGPYQF

SEQ ID NO: 33281 - protein, 7 aa, Artificial Sequence
  Synthetic construct
WSGPYQY

SEQ ID NO: 33282 - protein, 7 aa, Artificial Sequence
  Synthetic construct
WSGPYDF

SEQ ID NO: 33283 - protein, 7 aa, Artificial Sequence
  Synthetic construct
WSGPYDY

SEQ ID NO: 33284 - protein, 7 aa, Artificial Sequence
  Synthetic construct
WSGPYVF

SEQ ID NO: 33285 - protein, 7 aa, Artificial Sequence
  Synthetic construct
WSGPYVY

SEQ ID NO: 33286 - protein, 7 aa, Artificial Sequence
  Synthetic construct
WSGPFFF

SEQ ID NO: 33287 - protein, 7 aa, Artificial Sequence
  Synthetic construct
WSGPFFY

SEQ ID NO: 33288 - protein, 7 aa, Artificial Sequence
  Synthetic construct
WSGPFRF

SEQ ID NO: 33289 - protein, 7 aa, Artificial Sequence
  Synthetic construct
WSGPFRY

SEQ ID NO: 33290 - protein, 7 aa, Artificial Sequence
  Synthetic construct
WSGPFCF

SEQ ID NO: 33291 - protein, 7 aa, Artificial Sequence
  Synthetic construct
WSGPFCY

SEQ ID NO: 33292 - protein, 7 aa, Artificial Sequence
  Synthetic construct
WSGPFLF

SEQ ID NO: 33293 - protein, 7 aa, Artificial Sequence
  Synthetic construct
WSGPFLY

SEQ ID NO: 33294 - protein, 7 aa, Artificial Sequence
  Synthetic construct
WSGPFAF

SEQ ID NO: 33295 - protein, 7 aa, Artificial Sequence
  Synthetic construct
WSGPFAY

SEQ ID NO: 33296 - protein, 7 aa, Artificial Sequence
  Synthetic construct
WSGPFQF

SEQ ID NO: 33297 - protein, 7 aa, Artificial Sequence
  Synthetic construct
WSGPFQY

SEQ ID NO: 33298 - protein, 7 aa, Artificial Sequence
  Synthetic construct
WSGPFDF

SEQ ID NO: 33299 - protein, 7 aa, Artificial Sequence
  Synthetic construct
WSGPFDY

SEQ ID NO: 33300 - protein, 7 aa, Artificial Sequence
  Synthetic construct
WSGPFVF

SEQ ID NO: 33301 - protein, 7 aa, Artificial Sequence
  Synthetic construct
WSGPFVY

SEQ ID NO: 33302 - protein, 7 aa, Artificial Sequence
  Synthetic construct
WSGPVFF

SEQ ID NO: 33303 - protein, 7 aa, Artificial Sequence
  Synthetic construct
WSGPVFY

SEQ ID NO: 33304 - protein, 7 aa, Artificial Sequence
  Synthetic construct
WSGPVRF

SEQ ID NO: 33305 - protein, 7 aa, Artificial Sequence
  Synthetic construct
WSGPVRY

SEQ ID NO: 33306 - protein, 7 aa, Artificial Sequence
  Synthetic construct
WSGPVCF

SEQ ID NO: 33307 - protein, 7 aa, Artificial Sequence
  Synthetic construct
WSGPVCY

SEQ ID NO: 33308 - protein, 7 aa, Artificial Sequence
  Synthetic construct
WSGPVLF

SEQ ID NO: 33309 - protein, 7 aa, Artificial Sequence
  Synthetic construct
WSGPVLY

SEQ ID NO: 33310 - protein, 7 aa, Artificial Sequence
  Synthetic construct
WSGPVAF

SEQ ID NO: 33311 - protein, 7 aa, Artificial Sequence
  Synthetic construct
WSGPVAY

SEQ ID NO: 33312 - protein, 7 aa, Artificial Sequence
  Synthetic construct
WSGPVQF

SEQ ID NO: 33313 - protein, 7 aa, Artificial Sequence
  Synthetic construct
WSGPVQY

SEQ ID NO: 33314 - protein, 7 aa, Artificial Sequence
  Synthetic construct
WSGPVDF

SEQ ID NO: 33315 - protein, 7 aa, Artificial Sequence
  Synthetic construct
WSGPVDY

SEQ ID NO: 33316 - protein, 7 aa, Artificial Sequence
  Synthetic construct
WSGPVVF

SEQ ID NO: 33317 - protein, 7 aa, Artificial Sequence
  Synthetic construct
WSGPVVY

SEQ ID NO: 33318 - protein, 7 aa, Artificial Sequence
  Synthetic construct
WSGPTFF

SEQ ID NO: 33319 - protein, 7 aa, Artificial Sequence
  Synthetic construct
WSGPTFY

SEQ ID NO: 33320 - protein, 7 aa, Artificial Sequence
  Synthetic construct
WSGPTRF

SEQ ID NO: 33321 - protein, 7 aa, Artificial Sequence
  Synthetic construct
WSGPTRY

SEQ ID NO: 33322 - protein, 7 aa, Artificial Sequence
  Synthetic construct
WSGPTCF

SEQ ID NO: 33323 - protein, 7 aa, Artificial Sequence
  Synthetic construct
WSGPTCY

SEQ ID NO: 33324 - protein, 7 aa, Artificial Sequence
  Synthetic construct
WSGPTLF

SEQ ID NO: 33325 - protein, 7 aa, Artificial Sequence
  Synthetic construct
WSGPTLY

SEQ ID NO: 33326 - protein, 7 aa, Artificial Sequence
  Synthetic construct
WSGPTAF

SEQ ID NO: 33327 - protein, 7 aa, Artificial Sequence
  Synthetic construct
WSGPTAY

SEQ ID NO: 33328 - protein, 7 aa, Artificial Sequence
  Synthetic construct
WSGPTQF

SEQ ID NO: 33329 - protein, 7 aa, Artificial Sequence
  Synthetic construct
WSGPTQY

SEQ ID NO: 33330 - protein, 7 aa, Artificial Sequence
  Synthetic construct
WSGPTDF

SEQ ID NO: 33331 - protein, 7 aa, Artificial Sequence
  Synthetic construct
WSGPTDY

SEQ ID NO: 33332 - protein, 7 aa, Artificial Sequence
  Synthetic construct
WSGPTVF

SEQ ID NO: 33333 - protein, 7 aa, Artificial Sequence
  Synthetic construct
WSGPTVY

SEQ ID NO: 33334 - protein, 7 aa, Artificial Sequence
  Synthetic construct
WSGPGFF

SEQ ID NO: 33335 - protein, 7 aa, Artificial Sequence
  Synthetic construct
WSGPGFY

SEQ ID NO: 33336 - protein, 7 aa, Artificial Sequence
  Synthetic construct
WSGPGRF

SEQ ID NO: 33337 - protein, 7 aa, Artificial Sequence
  Synthetic construct
WSGPGRY

SEQ ID NO: 33338 - protein, 7 aa, Artificial Sequence
  Synthetic construct
WSGPGCF

SEQ ID NO: 33339 - protein, 7 aa, Artificial Sequence
  Synthetic construct
WSGPGCY

SEQ ID NO: 33340 - protein, 7 aa, Artificial Sequence
  Synthetic construct
WSGPGLF

SEQ ID NO: 33341 - protein, 7 aa, Artificial Sequence
  Synthetic construct
WSGPGLY

SEQ ID NO: 33342 - protein, 7 aa, Artificial Sequence
  Synthetic construct
WSGPGAF

SEQ ID NO: 33343 - protein, 7 aa, Artificial Sequence
  Synthetic construct
WSGPGAY

SEQ ID NO: 33344 - protein, 7 aa, Artificial Sequence
  Synthetic construct
WSGPGQF

SEQ ID NO: 33345 - protein, 7 aa, Artificial Sequence
  Synthetic construct
WSGPGQY

SEQ ID NO: 33346 - protein, 7 aa, Artificial Sequence
  Synthetic construct
WSGPGDF

SEQ ID NO: 33347 - protein, 7 aa, Artificial Sequence
  Synthetic construct
WSGPGDY

SEQ ID NO: 33348 - protein, 7 aa, Artificial Sequence
  Synthetic construct
WSGPGVF

SEQ ID NO: 33349 - protein, 7 aa, Artificial Sequence
  Synthetic construct
WSGPGVY

SEQ ID NO: 33350 - protein, 7 aa, Artificial Sequence
  Synthetic construct
WSGPAFF

SEQ ID NO: 33351 - protein, 7 aa, Artificial Sequence
  Synthetic construct
WSGPAFY

SEQ ID NO: 33352 - protein, 7 aa, Artificial Sequence
  Synthetic construct
WSGPARF

SEQ ID NO: 33353 - protein, 7 aa, Artificial Sequence
  Synthetic construct
WSGPARY

SEQ ID NO: 33354 - protein, 7 aa, Artificial Sequence
  Synthetic construct
WSGPACF

SEQ ID NO: 33355 - protein, 7 aa, Artificial Sequence
  Synthetic construct
WSGPACY

SEQ ID NO: 33356 - protein, 7 aa, Artificial Sequence
  Synthetic construct
WSGPALF

SEQ ID NO: 33357 - protein, 7 aa, Artificial Sequence
  Synthetic construct
WSGPALY

SEQ ID NO: 33358 - protein, 7 aa, Artificial Sequence
  Synthetic construct
WSGPAAF

SEQ ID NO: 33359 - protein, 7 aa, Artificial Sequence
  Synthetic construct
WSGPAAY

SEQ ID NO: 33360 - protein, 7 aa, Artificial Sequence
  Synthetic construct
WSGPAQF

SEQ ID NO: 33361 - protein, 7 aa, Artificial Sequence
  Synthetic construct
WSGPAQY

SEQ ID NO: 33362 - protein, 7 aa, Artificial Sequence
  Synthetic construct
WSGPADF

SEQ ID NO: 33363 - protein, 7 aa, Artificial Sequence
  Synthetic construct
WSGPADY

SEQ ID NO: 33364 - protein, 7 aa, Artificial Sequence
  Synthetic construct
WSGPAVF

SEQ ID NO: 33365 - protein, 7 aa, Artificial Sequence
  Synthetic construct
WSGPAVY

SEQ ID NO: 33366 - protein, 7 aa, Artificial Sequence
  Synthetic construct
WSGPQFF

SEQ ID NO: 33367 - protein, 7 aa, Artificial Sequence
  Synthetic construct
WSGPQFY

SEQ ID NO: 33368 - protein, 7 aa, Artificial Sequence
  Synthetic construct
WSGPQRF

SEQ ID NO: 33369 - protein, 7 aa, Artificial Sequence
  Synthetic construct
WSGPQRY

SEQ ID NO: 33370 - protein, 7 aa, Artificial Sequence
  Synthetic construct
WSGPQCF

SEQ ID NO: 33371 - protein, 7 aa, Artificial Sequence
  Synthetic construct
WSGPQCY

SEQ ID NO: 33372 - protein, 7 aa, Artificial Sequence
  Synthetic construct
WSGPQLF

SEQ ID NO: 33373 - protein, 7 aa, Artificial Sequence
  Synthetic construct
WSGPQLY

SEQ ID NO: 33374 - protein, 7 aa, Artificial Sequence
  Synthetic construct
WSGPQAF

SEQ ID NO: 33375 - protein, 7 aa, Artificial Sequence
  Synthetic construct
WSGPQAY

SEQ ID NO: 33376 - protein, 7 aa, Artificial Sequence
  Synthetic construct
WSGPQQF

SEQ ID NO: 33377 - protein, 7 aa, Artificial Sequence
  Synthetic construct
WSGPQQY

SEQ ID NO: 33378 - protein, 7 aa, Artificial Sequence
  Synthetic construct
WSGPQDF

SEQ ID NO: 33379 - protein, 7 aa, Artificial Sequence
  Synthetic construct
WSGPQDY

SEQ ID NO: 33380 - protein, 7 aa, Artificial Sequence
  Synthetic construct
WSGPQVF

SEQ ID NO: 33381 - protein, 7 aa, Artificial Sequence
  Synthetic construct
WSGPQVY

SEQ ID NO: 33382 - protein, 7 aa, Artificial Sequence
  Synthetic construct
WSGHIFF

SEQ ID NO: 33383 - protein, 7 aa, Artificial Sequence
  Synthetic construct
WSGHIFY

SEQ ID NO: 33384 - protein, 7 aa, Artificial Sequence
  Synthetic construct
WSGHIRF

SEQ ID NO: 33385 - protein, 7 aa, Artificial Sequence
  Synthetic construct
WSGHIRY

SEQ ID NO: 33386 - protein, 7 aa, Artificial Sequence
  Synthetic construct
WSGHICF

SEQ ID NO: 33387 - protein, 7 aa, Artificial Sequence
  Synthetic construct
WSGHICY

SEQ ID NO: 33388 - protein, 7 aa, Artificial Sequence
  Synthetic construct
WSGHILF

SEQ ID NO: 33389 - protein, 7 aa, Artificial Sequence
  Synthetic construct
WSGHILY

SEQ ID NO: 33390 - protein, 7 aa, Artificial Sequence
  Synthetic construct
WSGHIAF

SEQ ID NO: 33391 - protein, 7 aa, Artificial Sequence
  Synthetic construct
WSGHIAY

SEQ ID NO: 33392 - protein, 7 aa, Artificial Sequence
  Synthetic construct
WSGHIQF

SEQ ID NO: 33393 - protein, 7 aa, Artificial Sequence
  Synthetic construct
WSGHIQY

SEQ ID NO: 33394 - protein, 7 aa, Artificial Sequence
  Synthetic construct
WSGHIDF

SEQ ID NO: 33395 - protein, 7 aa, Artificial Sequence
  Synthetic construct
WSGHIDY

SEQ ID NO: 33396 - protein, 7 aa, Artificial Sequence
  Synthetic construct
WSGHIVF

SEQ ID NO: 33397 - protein, 7 aa, Artificial Sequence
  Synthetic construct
WSGHIVY

SEQ ID NO: 33398 - protein, 7 aa, Artificial Sequence
  Synthetic construct
WSGHDFF

SEQ ID NO: 33399 - protein, 7 aa, Artificial Sequence
  Synthetic construct
WSGHDFY

SEQ ID NO: 33400 - protein, 7 aa, Artificial Sequence
  Synthetic construct
WSGHDRF

SEQ ID NO: 33401 - protein, 7 aa, Artificial Sequence
  Synthetic construct
WSGHDRY

SEQ ID NO: 33402 - protein, 7 aa, Artificial Sequence
  Synthetic construct
WSGHDCF

SEQ ID NO: 33403 - protein, 7 aa, Artificial Sequence
  Synthetic construct
WSGHDCY

SEQ ID NO: 33404 - protein, 7 aa, Artificial Sequence
  Synthetic construct
WSGHDLF

SEQ ID NO: 33405 - protein, 7 aa, Artificial Sequence
  Synthetic construct
WSGHDLY

SEQ ID NO: 33406 - protein, 7 aa, Artificial Sequence
  Synthetic construct
WSGHDAF

SEQ ID NO: 33407 - protein, 7 aa, Artificial Sequence
  Synthetic construct
WSGHDAY

SEQ ID NO: 33408 - protein, 7 aa, Artificial Sequence
  Synthetic construct
WSGHDQF

SEQ ID NO: 33409 - protein, 7 aa, Artificial Sequence
  Synthetic construct
WSGHDQY

SEQ ID NO: 33410 - protein, 7 aa, Artificial Sequence
  Synthetic construct
WSGHDDF

SEQ ID NO: 33411 - protein, 7 aa, Artificial Sequence
  Synthetic construct
WSGHDDY

SEQ ID NO: 33412 - protein, 7 aa, Artificial Sequence
  Synthetic construct
WSGHDVF

SEQ ID NO: 33413 - protein, 7 aa, Artificial Sequence
  Synthetic construct
WSGHDVY

SEQ ID NO: 33414 - protein, 7 aa, Artificial Sequence
  Synthetic construct
WSGHYFF

SEQ ID NO: 33415 - protein, 7 aa, Artificial Sequence
  Synthetic construct
WSGHYFY

SEQ ID NO: 33416 - protein, 7 aa, Artificial Sequence
  Synthetic construct
WSGHYRF

SEQ ID NO: 33417 - protein, 7 aa, Artificial Sequence
  Synthetic construct
WSGHYRY

SEQ ID NO: 33418 - protein, 7 aa, Artificial Sequence
  Synthetic construct
WSGHYCF

SEQ ID NO: 33419 - protein, 7 aa, Artificial Sequence
  Synthetic construct
WSGHYCY

SEQ ID NO: 33420 - protein, 7 aa, Artificial Sequence
  Synthetic construct
WSGHYLF

SEQ ID NO: 33421 - protein, 7 aa, Artificial Sequence
  Synthetic construct
WSGHYLY

SEQ ID NO: 33422 - protein, 7 aa, Artificial Sequence
  Synthetic construct
WSGHYAF

SEQ ID NO: 33423 - protein, 7 aa, Artificial Sequence
  Synthetic construct
WSGHYAY

SEQ ID NO: 33424 - protein, 7 aa, Artificial Sequence
  Synthetic construct
WSGHYQF

SEQ ID NO: 33425 - protein, 7 aa, Artificial Sequence
  Synthetic construct
WSGHYQY

SEQ ID NO: 33426 - protein, 7 aa, Artificial Sequence
  Synthetic construct
WSGHYDF

SEQ ID NO: 33427 - protein, 7 aa, Artificial Sequence
  Synthetic construct
WSGHYDY

SEQ ID NO: 33428 - protein, 7 aa, Artificial Sequence
  Synthetic construct
WSGHYVF

SEQ ID NO: 33429 - protein, 7 aa, Artificial Sequence
  Synthetic construct
WSGHYVY

SEQ ID NO: 33430 - protein, 7 aa, Artificial Sequence
  Synthetic construct
WSGHFFF

SEQ ID NO: 33431 - protein, 7 aa, Artificial Sequence
  Synthetic construct
WSGHFFY

SEQ ID NO: 33432 - protein, 7 aa, Artificial Sequence
  Synthetic construct
WSGHFRF

SEQ ID NO: 33433 - protein, 7 aa, Artificial Sequence
  Synthetic construct
WSGHFRY

SEQ ID NO: 33434 - protein, 7 aa, Artificial Sequence
  Synthetic construct
WSGHFCF

SEQ ID NO: 33435 - protein, 7 aa, Artificial Sequence
  Synthetic construct
WSGHFCY

SEQ ID NO: 33436 - protein, 7 aa, Artificial Sequence
  Synthetic construct
WSGHFLF

SEQ ID NO: 33437 - protein, 7 aa, Artificial Sequence
  Synthetic construct
WSGHFLY

SEQ ID NO: 33438 - protein, 7 aa, Artificial Sequence
  Synthetic construct
WSGHFAF

SEQ ID NO: 33439 - protein, 7 aa, Artificial Sequence
  Synthetic construct
WSGHFAY

SEQ ID NO: 33440 - protein, 7 aa, Artificial Sequence
  Synthetic construct
WSGHFQF

SEQ ID NO: 33441 - protein, 7 aa, Artificial Sequence
  Synthetic construct
WSGHFQY

SEQ ID NO: 33442 - protein, 7 aa, Artificial Sequence
  Synthetic construct
WSGHFDF

SEQ ID NO: 33443 - protein, 7 aa, Artificial Sequence
  Synthetic construct
WSGHFDY

SEQ ID NO: 33444 - protein, 7 aa, Artificial Sequence
  Synthetic construct
WSGHFVF

SEQ ID NO: 33445 - protein, 7 aa, Artificial Sequence
  Synthetic construct
WSGHFVY

SEQ ID NO: 33446 - protein, 7 aa, Artificial Sequence
  Synthetic construct
WSGHVFF

SEQ ID NO: 33447 - protein, 7 aa, Artificial Sequence
  Synthetic construct
WSGHVFY

SEQ ID NO: 33448 - protein, 7 aa, Artificial Sequence
  Synthetic construct
WSGHVRF

SEQ ID NO: 33449 - protein, 7 aa, Artificial Sequence
  Synthetic construct
WSGHVRY

SEQ ID NO: 33450 - protein, 7 aa, Artificial Sequence
  Synthetic construct
WSGHVCF

SEQ ID NO: 33451 - protein, 7 aa, Artificial Sequence
  Synthetic construct
WSGHVCY

SEQ ID NO: 33452 - protein, 7 aa, Artificial Sequence
  Synthetic construct
WSGHVLF

SEQ ID NO: 33453 - protein, 7 aa, Artificial Sequence
  Synthetic construct
WSGHVLY

SEQ ID NO: 33454 - protein, 7 aa, Artificial Sequence
  Synthetic construct
WSGHVAF

SEQ ID NO: 33455 - protein, 7 aa, Artificial Sequence
  Synthetic construct
WSGHVAY

SEQ ID NO: 33456 - protein, 7 aa, Artificial Sequence
  Synthetic construct
WSGHVQF

SEQ ID NO: 33457 - protein, 7 aa, Artificial Sequence
  Synthetic construct
WSGHVQY

SEQ ID NO: 33458 - protein, 7 aa, Artificial Sequence
  Synthetic construct
WSGHVDF

SEQ ID NO: 33459 - protein, 7 aa, Artificial Sequence
  Synthetic construct
WSGHVDY

SEQ ID NO: 33460 - protein, 7 aa, Artificial Sequence
  Synthetic construct
WSGHVVF

SEQ ID NO: 33461 - protein, 7 aa, Artificial Sequence
  Synthetic construct
WSGHVVY

SEQ ID NO: 33462 - protein, 7 aa, Artificial Sequence
  Synthetic construct
WSGHTFF

SEQ ID NO: 33463 - protein, 7 aa, Artificial Sequence
  Synthetic construct
WSGHTFY

SEQ ID NO: 33464 - protein, 7 aa, Artificial Sequence
  Synthetic construct
WSGHTRF

SEQ ID NO: 33465 - protein, 7 aa, Artificial Sequence
  Synthetic construct
WSGHTRY

SEQ ID NO: 33466 - protein, 7 aa, Artificial Sequence
  Synthetic construct
WSGHTCF

SEQ ID NO: 33467 - protein, 7 aa, Artificial Sequence
  Synthetic construct
WSGHTCY

SEQ ID NO: 33468 - protein, 7 aa, Artificial Sequence
  Synthetic construct
WSGHTLF

SEQ ID NO: 33469 - protein, 7 aa, Artificial Sequence
  Synthetic construct
WSGHTLY

SEQ ID NO: 33470 - protein, 7 aa, Artificial Sequence
  Synthetic construct
WSGHTAF

SEQ ID NO: 33471 - protein, 7 aa, Artificial Sequence
  Synthetic construct
WSGHTAY

SEQ ID NO: 33472 - protein, 7 aa, Artificial Sequence
  Synthetic construct
WSGHTQF

SEQ ID NO: 33473 - protein, 7 aa, Artificial Sequence
  Synthetic construct
WSGHTQY

SEQ ID NO: 33474 - protein, 7 aa, Artificial Sequence
  Synthetic construct
WSGHTDF

SEQ ID NO: 33475 - protein, 7 aa, Artificial Sequence
  Synthetic construct
WSGHTDY

SEQ ID NO: 33476 - protein, 7 aa, Artificial Sequence
  Synthetic construct
WSGHTVF

SEQ ID NO: 33477 - protein, 7 aa, Artificial Sequence
  Synthetic construct
WSGHTVY

SEQ ID NO: 33478 - protein, 7 aa, Artificial Sequence
  Synthetic construct
WSGHGFF

SEQ ID NO: 33479 - protein, 7 aa, Artificial Sequence
  Synthetic construct
WSGHGFY

SEQ ID NO: 33480 - protein, 7 aa, Artificial Sequence
  Synthetic construct
WSGHGRF

SEQ ID NO: 33481 - protein, 7 aa, Artificial Sequence
  Synthetic construct
WSGHGRY

SEQ ID NO: 33482 - protein, 7 aa, Artificial Sequence
  Synthetic construct
WSGHGCF

SEQ ID NO: 33483 - protein, 7 aa, Artificial Sequence
  Synthetic construct
WSGHGCY

SEQ ID NO: 33484 - protein, 7 aa, Artificial Sequence
  Synthetic construct
WSGHGLF

SEQ ID NO: 33485 - protein, 7 aa, Artificial Sequence
  Synthetic construct
WSGHGLY

SEQ ID NO: 33486 - protein, 7 aa, Artificial Sequence
  Synthetic construct
WSGHGAF

SEQ ID NO: 33487 - protein, 7 aa, Artificial Sequence
  Synthetic construct
WSGHGAY

SEQ ID NO: 33488 - protein, 7 aa, Artificial Sequence
  Synthetic construct
WSGHGQF

SEQ ID NO: 33489 - protein, 7 aa, Artificial Sequence
  Synthetic construct
WSGHGQY

SEQ ID NO: 33490 - protein, 7 aa, Artificial Sequence
  Synthetic construct
WSGHGDF

SEQ ID NO: 33491 - protein, 7 aa, Artificial Sequence
  Synthetic construct
WSGHGDY

SEQ ID NO: 33492 - protein, 7 aa, Artificial Sequence
  Synthetic construct
WSGHGVF

SEQ ID NO: 33493 - protein, 7 aa, Artificial Sequence
  Synthetic construct
WSGHGVY

SEQ ID NO: 33494 - protein, 7 aa, Artificial Sequence
  Synthetic construct
WSGHAFF

SEQ ID NO: 33495 - protein, 7 aa, Artificial Sequence
  Synthetic construct
WSGHAFY

SEQ ID NO: 33496 - protein, 7 aa, Artificial Sequence
  Synthetic construct
WSGHARF

SEQ ID NO: 33497 - protein, 7 aa, Artificial Sequence
  Synthetic construct
WSGHARY

SEQ ID NO: 33498 - protein, 7 aa, Artificial Sequence
  Synthetic construct
WSGHACF

SEQ ID NO: 33499 - protein, 7 aa, Artificial Sequence
  Synthetic construct
WSGHACY

SEQ ID NO: 33500 - protein, 7 aa, Artificial Sequence
  Synthetic construct
WSGHALF

SEQ ID NO: 33501 - protein, 7 aa, Artificial Sequence
  Synthetic construct
WSGHALY

SEQ ID NO: 33502 - protein, 7 aa, Artificial Sequence
  Synthetic construct
WSGHAAF

SEQ ID NO: 33503 - protein, 7 aa, Artificial Sequence
  Synthetic construct
WSGHAAY

SEQ ID NO: 33504 - protein, 7 aa, Artificial Sequence
  Synthetic construct
WSGHAQF

SEQ ID NO: 33505 - protein, 7 aa, Artificial Sequence
  Synthetic construct
WSGHAQY

SEQ ID NO: 33506 - protein, 7 aa, Artificial Sequence
  Synthetic construct
WSGHADF

SEQ ID NO: 33507 - protein, 7 aa, Artificial Sequence
  Synthetic construct
WSGHADY

SEQ ID NO: 33508 - protein, 7 aa, Artificial Sequence
  Synthetic construct
WSGHAVF

SEQ ID NO: 33509 - protein, 7 aa, Artificial Sequence
  Synthetic construct
WSGHAVY

SEQ ID NO: 33510 - protein, 7 aa, Artificial Sequence
  Synthetic construct
WSGHQFF

SEQ ID NO: 33511 - protein, 7 aa, Artificial Sequence
  Synthetic construct
WSGHQFY

SEQ ID NO: 33512 - protein, 7 aa, Artificial Sequence
  Synthetic construct
WSGHQRF

SEQ ID NO: 33513 - protein, 7 aa, Artificial Sequence
  Synthetic construct
WSGHQRY

SEQ ID NO: 33514 - protein, 7 aa, Artificial Sequence
  Synthetic construct
WSGHQCF

SEQ ID NO: 33515 - protein, 7 aa, Artificial Sequence
  Synthetic construct
WSGHQCY

SEQ ID NO: 33516 - protein, 7 aa, Artificial Sequence
  Synthetic construct
WSGHQLF

SEQ ID NO: 33517 - protein, 7 aa, Artificial Sequence
  Synthetic construct
WSGHQLY

SEQ ID NO: 33518 - protein, 7 aa, Artificial Sequence
  Synthetic construct
WSGHQAF

SEQ ID NO: 33519 - protein, 7 aa, Artificial Sequence
  Synthetic construct
WSGHQAY

SEQ ID NO: 33520 - protein, 7 aa, Artificial Sequence
  Synthetic construct
WSGHQQF

SEQ ID NO: 33521 - protein, 7 aa, Artificial Sequence
  Synthetic construct
WSGHQQY

SEQ ID NO: 33522 - protein, 7 aa, Artificial Sequence
  Synthetic construct
WSGHQDF

SEQ ID NO: 33523 - protein, 7 aa, Artificial Sequence
  Synthetic construct
WSGHQDY

SEQ ID NO: 33524 - protein, 7 aa, Artificial Sequence
  Synthetic construct
WSGHQVF

SEQ ID NO: 33525 - protein, 7 aa, Artificial Sequence
  Synthetic construct
WSGHQVY

SEQ ID NO: 33526 - protein, 7 aa, Artificial Sequence
  Synthetic construct
WSGLIFF

SEQ ID NO: 33527 - protein, 7 aa, Artificial Sequence
  Synthetic construct
WSGLIFY

SEQ ID NO: 33528 - protein, 7 aa, Artificial Sequence
  Synthetic construct
WSGLIRF

SEQ ID NO: 33529 - protein, 7 aa, Artificial Sequence
  Synthetic construct
WSGLIRY

SEQ ID NO: 33530 - protein, 7 aa, Artificial Sequence
  Synthetic construct
WSGLICF

SEQ ID NO: 33531 - protein, 7 aa, Artificial Sequence
  Synthetic construct
WSGLICY

SEQ ID NO: 33532 - protein, 7 aa, Artificial Sequence
  Synthetic construct
WSGLILF

SEQ ID NO: 33533 - protein, 7 aa, Artificial Sequence
  Synthetic construct
WSGLILY

SEQ ID NO: 33534 - protein, 7 aa, Artificial Sequence
  Synthetic construct
WSGLIAF

SEQ ID NO: 33535 - protein, 7 aa, Artificial Sequence
  Synthetic construct
WSGLIAY

SEQ ID NO: 33536 - protein, 7 aa, Artificial Sequence
  Synthetic construct
WSGLIQF

SEQ ID NO: 33537 - protein, 7 aa, Artificial Sequence
  Synthetic construct
WSGLIQY

SEQ ID NO: 33538 - protein, 7 aa, Artificial Sequence
  Synthetic construct
WSGLIDF

SEQ ID NO: 33539 - protein, 7 aa, Artificial Sequence
  Synthetic construct
WSGLIDY

SEQ ID NO: 33540 - protein, 7 aa, Artificial Sequence
  Synthetic construct
WSGLIVF

SEQ ID NO: 33541 - protein, 7 aa, Artificial Sequence
  Synthetic construct
WSGLIVY

SEQ ID NO: 33542 - protein, 7 aa, Artificial Sequence
  Synthetic construct
WSGLDFF

SEQ ID NO: 33543 - protein, 7 aa, Artificial Sequence
  Synthetic construct
WSGLDFY

SEQ ID NO: 33544 - protein, 7 aa, Artificial Sequence
  Synthetic construct
WSGLDRF

SEQ ID NO: 33545 - protein, 7 aa, Artificial Sequence
  Synthetic construct
WSGLDRY

SEQ ID NO: 33546 - protein, 7 aa, Artificial Sequence
  Synthetic construct
WSGLDCF

SEQ ID NO: 33547 - protein, 7 aa, Artificial Sequence
  Synthetic construct
WSGLDCY

SEQ ID NO: 33548 - protein, 7 aa, Artificial Sequence
  Synthetic construct
WSGLDLF

SEQ ID NO: 33549 - protein, 7 aa, Artificial Sequence
  Synthetic construct
WSGLDLY

SEQ ID NO: 33550 - protein, 7 aa, Artificial Sequence
  Synthetic construct
WSGLDAF

SEQ ID NO: 33551 - protein, 7 aa, Artificial Sequence
  Synthetic construct
WSGLDAY

SEQ ID NO: 33552 - protein, 7 aa, Artificial Sequence
  Synthetic construct
WSGLDQF

SEQ ID NO: 33553 - protein, 7 aa, Artificial Sequence
  Synthetic construct
WSGLDQY

SEQ ID NO: 33554 - protein, 7 aa, Artificial Sequence
  Synthetic construct
WSGLDDF

SEQ ID NO: 33555 - protein, 7 aa, Artificial Sequence
  Synthetic construct
WSGLDDY

SEQ ID NO: 33556 - protein, 7 aa, Artificial Sequence
  Synthetic construct
WSGLDVF

SEQ ID NO: 33557 - protein, 7 aa, Artificial Sequence
  Synthetic construct
WSGLDVY

SEQ ID NO: 33558 - protein, 7 aa, Artificial Sequence
  Synthetic construct
WSGLYFF

SEQ ID NO: 33559 - protein, 7 aa, Artificial Sequence
  Synthetic construct
WSGLYFY

SEQ ID NO: 33560 - protein, 7 aa, Artificial Sequence
  Synthetic construct
WSGLYRF

SEQ ID NO: 33561 - protein, 7 aa, Artificial Sequence
  Synthetic construct
WSGLYRY

SEQ ID NO: 33562 - protein, 7 aa, Artificial Sequence
  Synthetic construct
WSGLYCF

SEQ ID NO: 33563 - protein, 7 aa, Artificial Sequence
  Synthetic construct
WSGLYCY

SEQ ID NO: 33564 - protein, 7 aa, Artificial Sequence
  Synthetic construct
WSGLYLF

SEQ ID NO: 33565 - protein, 7 aa, Artificial Sequence
  Synthetic construct
WSGLYLY

SEQ ID NO: 33566 - protein, 7 aa, Artificial Sequence
  Synthetic construct
WSGLYAF

SEQ ID NO: 33567 - protein, 7 aa, Artificial Sequence
  Synthetic construct
WSGLYAY

SEQ ID NO: 33568 - protein, 7 aa, Artificial Sequence
  Synthetic construct
WSGLYQF

SEQ ID NO: 33569 - protein, 7 aa, Artificial Sequence
  Synthetic construct
WSGLYQY

SEQ ID NO: 33570 - protein, 7 aa, Artificial Sequence
  Synthetic construct
WSGLYDF

SEQ ID NO: 33571 - protein, 7 aa, Artificial Sequence
  Synthetic construct
WSGLYDY

SEQ ID NO: 33572 - protein, 7 aa, Artificial Sequence
  Synthetic construct
WSGLYVF

SEQ ID NO: 33573 - protein, 7 aa, Artificial Sequence
  Synthetic construct
WSGLYVY

SEQ ID NO: 33574 - protein, 7 aa, Artificial Sequence
  Synthetic construct
WSGLFFF

SEQ ID NO: 33575 - protein, 7 aa, Artificial Sequence
  Synthetic construct
WSGLFFY

SEQ ID NO: 33576 - protein, 7 aa, Artificial Sequence
  Synthetic construct
WSGLFRF

SEQ ID NO: 33577 - protein, 7 aa, Artificial Sequence
  Synthetic construct
WSGLFRY

SEQ ID NO: 33578 - protein, 7 aa, Artificial Sequence
  Synthetic construct
WSGLFCF

SEQ ID NO: 33579 - protein, 7 aa, Artificial Sequence
  Synthetic construct
WSGLFCY

SEQ ID NO: 33580 - protein, 7 aa, Artificial Sequence
  Synthetic construct
WSGLFLF

SEQ ID NO: 33581 - protein, 7 aa, Artificial Sequence
  Synthetic construct
WSGLFLY

SEQ ID NO: 33582 - protein, 7 aa, Artificial Sequence
  Synthetic construct
WSGLFAF

SEQ ID NO: 33583 - protein, 7 aa, Artificial Sequence
  Synthetic construct
WSGLFAY

SEQ ID NO: 33584 - protein, 7 aa, Artificial Sequence
  Synthetic construct
WSGLFQF

SEQ ID NO: 33585 - protein, 7 aa, Artificial Sequence
  Synthetic construct
WSGLFQY

SEQ ID NO: 33586 - protein, 7 aa, Artificial Sequence
  Synthetic construct
WSGLFDF

SEQ ID NO: 33587 - protein, 7 aa, Artificial Sequence
  Synthetic construct
WSGLFDY

SEQ ID NO: 33588 - protein, 7 aa, Artificial Sequence
  Synthetic construct
WSGLFVF

SEQ ID NO: 33589 - protein, 7 aa, Artificial Sequence
  Synthetic construct
WSGLFVY

SEQ ID NO: 33590 - protein, 7 aa, Artificial Sequence
  Synthetic construct
WSGLVFF

SEQ ID NO: 33591 - protein, 7 aa, Artificial Sequence
  Synthetic construct
WSGLVFY

SEQ ID NO: 33592 - protein, 7 aa, Artificial Sequence
  Synthetic construct
WSGLVRF

SEQ ID NO: 33593 - protein, 7 aa, Artificial Sequence
  Synthetic construct
WSGLVRY

SEQ ID NO: 33594 - protein, 7 aa, Artificial Sequence
  Synthetic construct
WSGLVCF

SEQ ID NO: 33595 - protein, 7 aa, Artificial Sequence
  Synthetic construct
WSGLVCY

SEQ ID NO: 33596 - protein, 7 aa, Artificial Sequence
  Synthetic construct
WSGLVLF

SEQ ID NO: 33597 - protein, 7 aa, Artificial Sequence
  Synthetic construct
WSGLVLY

SEQ ID NO: 33598 - protein, 7 aa, Artificial Sequence
  Synthetic construct
WSGLVAF

SEQ ID NO: 33599 - protein, 7 aa, Artificial Sequence
  Synthetic construct
WSGLVAY

SEQ ID NO: 33600 - protein, 7 aa, Artificial Sequence
  Synthetic construct
WSGLVQF

SEQ ID NO: 33601 - protein, 7 aa, Artificial Sequence
  Synthetic construct
WSGLVQY

SEQ ID NO: 33602 - protein, 7 aa, Artificial Sequence
  Synthetic construct
WSGLVDF

SEQ ID NO: 33603 - protein, 7 aa, Artificial Sequence
  Synthetic construct
WSGLVDY

SEQ ID NO: 33604 - protein, 7 aa, Artificial Sequence
  Synthetic construct
WSGLVVF

SEQ ID NO: 33605 - protein, 7 aa, Artificial Sequence
  Synthetic construct
WSGLVVY

SEQ ID NO: 33606 - protein, 7 aa, Artificial Sequence
  Synthetic construct
WSGLTFF

SEQ ID NO: 33607 - protein, 7 aa, Artificial Sequence
  Synthetic construct
WSGLTFY

SEQ ID NO: 33608 - protein, 7 aa, Artificial Sequence
  Synthetic construct
WSGLTRF

SEQ ID NO: 33609 - protein, 7 aa, Artificial Sequence
  Synthetic construct
WSGLTRY

SEQ ID NO: 33610 - protein, 7 aa, Artificial Sequence
  Synthetic construct
WSGLTCF

SEQ ID NO: 33611 - protein, 7 aa, Artificial Sequence
  Synthetic construct
WSGLTCY

SEQ ID NO: 33612 - protein, 7 aa, Artificial Sequence
  Synthetic construct
WSGLTLF

SEQ ID NO: 33613 - protein, 7 aa, Artificial Sequence
  Synthetic construct
WSGLTLY

SEQ ID NO: 33614 - protein, 7 aa, Artificial Sequence
  Synthetic construct
WSGLTAF

SEQ ID NO: 33615 - protein, 7 aa, Artificial Sequence
  Synthetic construct
WSGLTAY

SEQ ID NO: 33616 - protein, 7 aa, Artificial Sequence
  Synthetic construct
WSGLTQF

SEQ ID NO: 33617 - protein, 7 aa, Artificial Sequence
  Synthetic construct
WSGLTQY

SEQ ID NO: 33618 - protein, 7 aa, Artificial Sequence
  Synthetic construct
WSGLTDF

SEQ ID NO: 33619 - protein, 7 aa, Artificial Sequence
  Synthetic construct
WSGLTDY

SEQ ID NO: 33620 - protein, 7 aa, Artificial Sequence
  Synthetic construct
WSGLTVF

SEQ ID NO: 33621 - protein, 7 aa, Artificial Sequence
  Synthetic construct
WSGLTVY

SEQ ID NO: 33622 - protein, 7 aa, Artificial Sequence
  Synthetic construct
WSGLGFF

SEQ ID NO: 33623 - protein, 7 aa, Artificial Sequence
  Synthetic construct
WSGLGFY

SEQ ID NO: 33624 - protein, 7 aa, Artificial Sequence
  Synthetic construct
WSGLGRF

SEQ ID NO: 33625 - protein, 7 aa, Artificial Sequence
  Synthetic construct
WSGLGRY

SEQ ID NO: 33626 - protein, 7 aa, Artificial Sequence
  Synthetic construct
WSGLGCF

SEQ ID NO: 33627 - protein, 7 aa, Artificial Sequence
  Synthetic construct
WSGLGCY

SEQ ID NO: 33628 - protein, 7 aa, Artificial Sequence
  Synthetic construct
WSGLGLF

SEQ ID NO: 33629 - protein, 7 aa, Artificial Sequence
  Synthetic construct
WSGLGLY

SEQ ID NO: 33630 - protein, 7 aa, Artificial Sequence
  Synthetic construct
WSGLGAF

SEQ ID NO: 33631 - protein, 7 aa, Artificial Sequence
  Synthetic construct
WSGLGAY

SEQ ID NO: 33632 - protein, 7 aa, Artificial Sequence
  Synthetic construct
WSGLGQF

SEQ ID NO: 33633 - protein, 7 aa, Artificial Sequence
  Synthetic construct
WSGLGQY

SEQ ID NO: 33634 - protein, 7 aa, Artificial Sequence
  Synthetic construct
WSGLGDF

SEQ ID NO: 33635 - protein, 7 aa, Artificial Sequence
  Synthetic construct
WSGLGDY

SEQ ID NO: 33636 - protein, 7 aa, Artificial Sequence
  Synthetic construct
WSGLGVF

SEQ ID NO: 33637 - protein, 7 aa, Artificial Sequence
  Synthetic construct
WSGLGVY

SEQ ID NO: 33638 - protein, 7 aa, Artificial Sequence
  Synthetic construct
WSGLAFF

SEQ ID NO: 33639 - protein, 7 aa, Artificial Sequence
  Synthetic construct
WSGLAFY

SEQ ID NO: 33640 - protein, 7 aa, Artificial Sequence
  Synthetic construct
WSGLARF

SEQ ID NO: 33641 - protein, 7 aa, Artificial Sequence
  Synthetic construct
WSGLARY

SEQ ID NO: 33642 - protein, 7 aa, Artificial Sequence
  Synthetic construct
WSGLACF

SEQ ID NO: 33643 - protein, 7 aa, Artificial Sequence
  Synthetic construct
WSGLACY

SEQ ID NO: 33644 - protein, 7 aa, Artificial Sequence
  Synthetic construct
WSGLALF

SEQ ID NO: 33645 - protein, 7 aa, Artificial Sequence
  Synthetic construct
WSGLALY

SEQ ID NO: 33646 - protein, 7 aa, Artificial Sequence
  Synthetic construct
WSGLAAF

SEQ ID NO: 33647 - protein, 7 aa, Artificial Sequence
  Synthetic construct
WSGLAAY

SEQ ID NO: 33648 - protein, 7 aa, Artificial Sequence
  Synthetic construct
WSGLAQF

SEQ ID NO: 33649 - protein, 7 aa, Artificial Sequence
  Synthetic construct
WSGLAQY

SEQ ID NO: 33650 - protein, 7 aa, Artificial Sequence
  Synthetic construct
WSGLADF

SEQ ID NO: 33651 - protein, 7 aa, Artificial Sequence
  Synthetic construct
WSGLADY

SEQ ID NO: 33652 - protein, 7 aa, Artificial Sequence
  Synthetic construct
WSGLAVF

SEQ ID NO: 33653 - protein, 7 aa, Artificial Sequence
  Synthetic construct
WSGLAVY

SEQ ID NO: 33654 - protein, 7 aa, Artificial Sequence
  Synthetic construct
WSGLQFF

SEQ ID NO: 33655 - protein, 7 aa, Artificial Sequence
  Synthetic construct
WSGLQFY

SEQ ID NO: 33656 - protein, 7 aa, Artificial Sequence
  Synthetic construct
WSGLQRF

SEQ ID NO: 33657 - protein, 7 aa, Artificial Sequence
  Synthetic construct
WSGLQRY

SEQ ID NO: 33658 - protein, 7 aa, Artificial Sequence
  Synthetic construct
WSGLQCF

SEQ ID NO: 33659 - protein, 7 aa, Artificial Sequence
  Synthetic construct
WSGLQCY

SEQ ID NO: 33660 - protein, 7 aa, Artificial Sequence
  Synthetic construct
WSGLQLF

SEQ ID NO: 33661 - protein, 7 aa, Artificial Sequence
  Synthetic construct
WSGLQLY

SEQ ID NO: 33662 - protein, 7 aa, Artificial Sequence
  Synthetic construct
WSGLQAF

SEQ ID NO: 33663 - protein, 7 aa, Artificial Sequence
  Synthetic construct
WSGLQAY

SEQ ID NO: 33664 - protein, 7 aa, Artificial Sequence
  Synthetic construct
WSGLQQF

SEQ ID NO: 33665 - protein, 7 aa, Artificial Sequence
  Synthetic construct
WSGLQQY

SEQ ID NO: 33666 - protein, 7 aa, Artificial Sequence
  Synthetic construct
WSGLQDF

SEQ ID NO: 33667 - protein, 7 aa, Artificial Sequence
  Synthetic construct
WSGLQDY

SEQ ID NO: 33668 - protein, 7 aa, Artificial Sequence
  Synthetic construct
WSGLQVF

SEQ ID NO: 33669 - protein, 7 aa, Artificial Sequence
  Synthetic construct
WSGLQVY

SEQ ID NO: 33670 - protein, 7 aa, Artificial Sequence
  Synthetic construct
WSGFIFF

SEQ ID NO: 33671 - protein, 7 aa, Artificial Sequence
  Synthetic construct
WSGFIFY

SEQ ID NO: 33672 - protein, 7 aa, Artificial Sequence
  Synthetic construct
WSGFIRF

SEQ ID NO: 33673 - protein, 7 aa, Artificial Sequence
  Synthetic construct
WSGFIRY

SEQ ID NO: 33674 - protein, 7 aa, Artificial Sequence
  Synthetic construct
WSGFICF

SEQ ID NO: 33675 - protein, 7 aa, Artificial Sequence
  Synthetic construct
WSGFICY

SEQ ID NO: 33676 - protein, 7 aa, Artificial Sequence
  Synthetic construct
WSGFILF

SEQ ID NO: 33677 - protein, 7 aa, Artificial Sequence
  Synthetic construct
WSGFILY

SEQ ID NO: 33678 - protein, 7 aa, Artificial Sequence
  Synthetic construct
WSGFIAF

SEQ ID NO: 33679 - protein, 7 aa, Artificial Sequence
  Synthetic construct
WSGFIAY

SEQ ID NO: 33680 - protein, 7 aa, Artificial Sequence
  Synthetic construct
WSGFIQF

SEQ ID NO: 33681 - protein, 7 aa, Artificial Sequence
  Synthetic construct
WSGFIQY

SEQ ID NO: 33682 - protein, 7 aa, Artificial Sequence
  Synthetic construct
WSGFIDF

SEQ ID NO: 33683 - protein, 7 aa, Artificial Sequence
  Synthetic construct
WSGFIDY

SEQ ID NO: 33684 - protein, 7 aa, Artificial Sequence
  Synthetic construct
WSGFIVF

SEQ ID NO: 33685 - protein, 7 aa, Artificial Sequence
  Synthetic construct
WSGFIVY

SEQ ID NO: 33686 - protein, 7 aa, Artificial Sequence
  Synthetic construct
WSGFDFF

SEQ ID NO: 33687 - protein, 7 aa, Artificial Sequence
  Synthetic construct
WSGFDFY

SEQ ID NO: 33688 - protein, 7 aa, Artificial Sequence
  Synthetic construct
WSGFDRF

SEQ ID NO: 33689 - protein, 7 aa, Artificial Sequence
  Synthetic construct
WSGFDRY

SEQ ID NO: 33690 - protein, 7 aa, Artificial Sequence
  Synthetic construct
WSGFDCF

SEQ ID NO: 33691 - protein, 7 aa, Artificial Sequence
  Synthetic construct
WSGFDCY

SEQ ID NO: 33692 - protein, 7 aa, Artificial Sequence
  Synthetic construct
WSGFDLF

SEQ ID NO: 33693 - protein, 7 aa, Artificial Sequence
  Synthetic construct
WSGFDLY

SEQ ID NO: 33694 - protein, 7 aa, Artificial Sequence
  Synthetic construct
WSGFDAF

SEQ ID NO: 33695 - protein, 7 aa, Artificial Sequence
  Synthetic construct
WSGFDAY

SEQ ID NO: 33696 - protein, 7 aa, Artificial Sequence
  Synthetic construct
WSGFDQF

SEQ ID NO: 33697 - protein, 7 aa, Artificial Sequence
  Synthetic construct
WSGFDQY

SEQ ID NO: 33698 - protein, 7 aa, Artificial Sequence
  Synthetic construct
WSGFDDF

SEQ ID NO: 33699 - protein, 7 aa, Artificial Sequence
  Synthetic construct
WSGFDDY

SEQ ID NO: 33700 - protein, 7 aa, Artificial Sequence
  Synthetic construct
WSGFDVF

SEQ ID NO: 33701 - protein, 7 aa, Artificial Sequence
  Synthetic construct
WSGFDVY

SEQ ID NO: 33702 - protein, 7 aa, Artificial Sequence
  Synthetic construct
WSGFYFF

SEQ ID NO: 33703 - protein, 7 aa, Artificial Sequence
  Synthetic construct
WSGFYFY

SEQ ID NO: 33704 - protein, 7 aa, Artificial Sequence
  Synthetic construct
WSGFYRF

SEQ ID NO: 33705 - protein, 7 aa, Artificial Sequence
  Synthetic construct
WSGFYRY

SEQ ID NO: 33706 - protein, 7 aa, Artificial Sequence
  Synthetic construct
WSGFYCF

SEQ ID NO: 33707 - protein, 7 aa, Artificial Sequence
  Synthetic construct
WSGFYCY

SEQ ID NO: 33708 - protein, 7 aa, Artificial Sequence
  Synthetic construct
WSGFYLF

SEQ ID NO: 33709 - protein, 7 aa, Artificial Sequence
  Synthetic construct
WSGFYLY

SEQ ID NO: 33710 - protein, 7 aa, Artificial Sequence
  Synthetic construct
WSGFYAF

SEQ ID NO: 33711 - protein, 7 aa, Artificial Sequence
  Synthetic construct
WSGFYAY

SEQ ID NO: 33712 - protein, 7 aa, Artificial Sequence
  Synthetic construct
WSGFYQF

SEQ ID NO: 33713 - protein, 7 aa, Artificial Sequence
  Synthetic construct
WSGFYQY

SEQ ID NO: 33714 - protein, 7 aa, Artificial Sequence
  Synthetic construct
WSGFYDF

SEQ ID NO: 33715 - protein, 7 aa, Artificial Sequence
  Synthetic construct
WSGFYDY

SEQ ID NO: 33716 - protein, 7 aa, Artificial Sequence
  Synthetic construct
WSGFYVF

SEQ ID NO: 33717 - protein, 7 aa, Artificial Sequence
  Synthetic construct
WSGFYVY

SEQ ID NO: 33718 - protein, 7 aa, Artificial Sequence
  Synthetic construct
WSGFFFF

SEQ ID NO: 33719 - protein, 7 aa, Artificial Sequence
  Synthetic construct
WSGFFFY

SEQ ID NO: 33720 - protein, 7 aa, Artificial Sequence
  Synthetic construct
WSGFFRF

SEQ ID NO: 33721 - protein, 7 aa, Artificial Sequence
  Synthetic construct
WSGFFRY

SEQ ID NO: 33722 - protein, 7 aa, Artificial Sequence
  Synthetic construct
WSGFFCF

SEQ ID NO: 33723 - protein, 7 aa, Artificial Sequence
  Synthetic construct
WSGFFCY

SEQ ID NO: 33724 - protein, 7 aa, Artificial Sequence
  Synthetic construct
WSGFFLF

SEQ ID NO: 33725 - protein, 7 aa, Artificial Sequence
  Synthetic construct
WSGFFLY

SEQ ID NO: 33726 - protein, 7 aa, Artificial Sequence
  Synthetic construct
WSGFFAF

SEQ ID NO: 33727 - protein, 7 aa, Artificial Sequence
  Synthetic construct
WSGFFAY

SEQ ID NO: 33728 - protein, 7 aa, Artificial Sequence
  Synthetic construct
WSGFFQF

SEQ ID NO: 33729 - protein, 7 aa, Artificial Sequence
  Synthetic construct
WSGFFQY

SEQ ID NO: 33730 - protein, 7 aa, Artificial Sequence
  Synthetic construct
WSGFFDF

SEQ ID NO: 33731 - protein, 7 aa, Artificial Sequence
  Synthetic construct
WSGFFDY

SEQ ID NO: 33732 - protein, 7 aa, Artificial Sequence
  Synthetic construct
WSGFFVF

SEQ ID NO: 33733 - protein, 7 aa, Artificial Sequence
  Synthetic construct
WSGFFVY

SEQ ID NO: 33734 - protein, 7 aa, Artificial Sequence
  Synthetic construct
WSGFVFF

SEQ ID NO: 33735 - protein, 7 aa, Artificial Sequence
  Synthetic construct
WSGFVFY

SEQ ID NO: 33736 - protein, 7 aa, Artificial Sequence
  Synthetic construct
WSGFVRF

SEQ ID NO: 33737 - protein, 7 aa, Artificial Sequence
  Synthetic construct
WSGFVRY

SEQ ID NO: 33738 - protein, 7 aa, Artificial Sequence
  Synthetic construct
WSGFVCF

SEQ ID NO: 33739 - protein, 7 aa, Artificial Sequence
  Synthetic construct
WSGFVCY

SEQ ID NO: 33740 - protein, 7 aa, Artificial Sequence
  Synthetic construct
WSGFVLF

SEQ ID NO: 33741 - protein, 7 aa, Artificial Sequence
  Synthetic construct
WSGFVLY

SEQ ID NO: 33742 - protein, 7 aa, Artificial Sequence
  Synthetic construct
WSGFVAF

SEQ ID NO: 33743 - protein, 7 aa, Artificial Sequence
  Synthetic construct
WSGFVAY

SEQ ID NO: 33744 - protein, 7 aa, Artificial Sequence
  Synthetic construct
WSGFVQF

SEQ ID NO: 33745 - protein, 7 aa, Artificial Sequence
  Synthetic construct
WSGFVQY

SEQ ID NO: 33746 - protein, 7 aa, Artificial Sequence
  Synthetic construct
WSGFVDF

SEQ ID NO: 33747 - protein, 7 aa, Artificial Sequence
  Synthetic construct
WSGFVDY

SEQ ID NO: 33748 - protein, 7 aa, Artificial Sequence
  Synthetic construct
WSGFVVF

SEQ ID NO: 33749 - protein, 7 aa, Artificial Sequence
  Synthetic construct
WSGFVVY

SEQ ID NO: 33750 - protein, 7 aa, Artificial Sequence
  Synthetic construct
WSGFTFF

SEQ ID NO: 33751 - protein, 7 aa, Artificial Sequence
  Synthetic construct
WSGFTFY

SEQ ID NO: 33752 - protein, 7 aa, Artificial Sequence
  Synthetic construct
WSGFTRF

SEQ ID NO: 33753 - protein, 7 aa, Artificial Sequence
  Synthetic construct
WSGFTRY

SEQ ID NO: 33754 - protein, 7 aa, Artificial Sequence
  Synthetic construct
WSGFTCF

SEQ ID NO: 33755 - protein, 7 aa, Artificial Sequence
  Synthetic construct
WSGFTCY

SEQ ID NO: 33756 - protein, 7 aa, Artificial Sequence
  Synthetic construct
WSGFTLF

SEQ ID NO: 33757 - protein, 7 aa, Artificial Sequence
  Synthetic construct
WSGFTLY

SEQ ID NO: 33758 - protein, 7 aa, Artificial Sequence
  Synthetic construct
WSGFTAF

SEQ ID NO: 33759 - protein, 7 aa, Artificial Sequence
  Synthetic construct
WSGFTAY

SEQ ID NO: 33760 - protein, 7 aa, Artificial Sequence
  Synthetic construct
WSGFTQF

SEQ ID NO: 33761 - protein, 7 aa, Artificial Sequence
  Synthetic construct
WSGFTQY

SEQ ID NO: 33762 - protein, 7 aa, Artificial Sequence
  Synthetic construct
WSGFTDF

SEQ ID NO: 33763 - protein, 7 aa, Artificial Sequence
  Synthetic construct
WSGFTDY

SEQ ID NO: 33764 - protein, 7 aa, Artificial Sequence
  Synthetic construct
WSGFTVF

SEQ ID NO: 33765 - protein, 7 aa, Artificial Sequence
  Synthetic construct
WSGFTVY

SEQ ID NO: 33766 - protein, 7 aa, Artificial Sequence
  Synthetic construct
WSGFGFF

SEQ ID NO: 33767 - protein, 7 aa, Artificial Sequence
  Synthetic construct
WSGFGFY

SEQ ID NO: 33768 - protein, 7 aa, Artificial Sequence
  Synthetic construct
WSGFGRF

SEQ ID NO: 33769 - protein, 7 aa, Artificial Sequence
  Synthetic construct
WSGFGRY

SEQ ID NO: 33770 - protein, 7 aa, Artificial Sequence
  Synthetic construct
WSGFGCF

SEQ ID NO: 33771 - protein, 7 aa, Artificial Sequence
  Synthetic construct
WSGFGCY

SEQ ID NO: 33772 - protein, 7 aa, Artificial Sequence
  Synthetic construct
WSGFGLF

SEQ ID NO: 33773 - protein, 7 aa, Artificial Sequence
  Synthetic construct
WSGFGLY

SEQ ID NO: 33774 - protein, 7 aa, Artificial Sequence
  Synthetic construct
WSGFGAF

SEQ ID NO: 33775 - protein, 7 aa, Artificial Sequence
  Synthetic construct
WSGFGAY

SEQ ID NO: 33776 - protein, 7 aa, Artificial Sequence
  Synthetic construct
WSGFGQF

SEQ ID NO: 33777 - protein, 7 aa, Artificial Sequence
  Synthetic construct
WSGFGQY

SEQ ID NO: 33778 - protein, 7 aa, Artificial Sequence
  Synthetic construct
WSGFGDF

SEQ ID NO: 33779 - protein, 7 aa, Artificial Sequence
  Synthetic construct
WSGFGDY

SEQ ID NO: 33780 - protein, 7 aa, Artificial Sequence
  Synthetic construct
WSGFGVF

SEQ ID NO: 33781 - protein, 7 aa, Artificial Sequence
  Synthetic construct
WSGFGVY

SEQ ID NO: 33782 - protein, 7 aa, Artificial Sequence
  Synthetic construct
WSGFAFF

SEQ ID NO: 33783 - protein, 7 aa, Artificial Sequence
  Synthetic construct
WSGFAFY

SEQ ID NO: 33784 - protein, 7 aa, Artificial Sequence
  Synthetic construct
WSGFARF

SEQ ID NO: 33785 - protein, 7 aa, Artificial Sequence
  Synthetic construct
WSGFARY

SEQ ID NO: 33786 - protein, 7 aa, Artificial Sequence
  Synthetic construct
WSGFACF

SEQ ID NO: 33787 - protein, 7 aa, Artificial Sequence
  Synthetic construct
WSGFACY

SEQ ID NO: 33788 - protein, 7 aa, Artificial Sequence
  Synthetic construct
WSGFALF

SEQ ID NO: 33789 - protein, 7 aa, Artificial Sequence
  Synthetic construct
WSGFALY

SEQ ID NO: 33790 - protein, 7 aa, Artificial Sequence
  Synthetic construct
WSGFAAF

SEQ ID NO: 33791 - protein, 7 aa, Artificial Sequence
  Synthetic construct
WSGFAAY

SEQ ID NO: 33792 - protein, 7 aa, Artificial Sequence
  Synthetic construct
WSGFAQF

SEQ ID NO: 33793 - protein, 7 aa, Artificial Sequence
  Synthetic construct
WSGFAQY

SEQ ID NO: 33794 - protein, 7 aa, Artificial Sequence
  Synthetic construct
WSGFADF

SEQ ID NO: 33795 - protein, 7 aa, Artificial Sequence
  Synthetic construct
WSGFADY

SEQ ID NO: 33796 - protein, 7 aa, Artificial Sequence
  Synthetic construct
WSGFAVF

SEQ ID NO: 33797 - protein, 7 aa, Artificial Sequence
  Synthetic construct
WSGFAVY

SEQ ID NO: 33798 - protein, 7 aa, Artificial Sequence
  Synthetic construct
WSGFQFF

SEQ ID NO: 33799 - protein, 7 aa, Artificial Sequence
  Synthetic construct
WSGFQFY

SEQ ID NO: 33800 - protein, 7 aa, Artificial Sequence
  Synthetic construct
WSGFQRF

SEQ ID NO: 33801 - protein, 7 aa, Artificial Sequence
  Synthetic construct
WSGFQRY

SEQ ID NO: 33802 - protein, 7 aa, Artificial Sequence
  Synthetic construct
WSGFQCF

SEQ ID NO: 33803 - protein, 7 aa, Artificial Sequence
  Synthetic construct
WSGFQCY

SEQ ID NO: 33804 - protein, 7 aa, Artificial Sequence
  Synthetic construct
WSGFQLF

SEQ ID NO: 33805 - protein, 7 aa, Artificial Sequence
  Synthetic construct
WSGFQLY

SEQ ID NO: 33806 - protein, 7 aa, Artificial Sequence
  Synthetic construct
WSGFQAF

SEQ ID NO: 33807 - protein, 7 aa, Artificial Sequence
  Synthetic construct
WSGFQAY

SEQ ID NO: 33808 - protein, 7 aa, Artificial Sequence
  Synthetic construct
WSGFQQF

SEQ ID NO: 33809 - protein, 7 aa, Artificial Sequence
  Synthetic construct
WSGFQQY

SEQ ID NO: 33810 - protein, 7 aa, Artificial Sequence
  Synthetic construct
WSGFQDF

SEQ ID NO: 33811 - protein, 7 aa, Artificial Sequence
  Synthetic construct
WSGFQDY

SEQ ID NO: 33812 - protein, 7 aa, Artificial Sequence
  Synthetic construct
WSGFQVF

SEQ ID NO: 33813 - protein, 7 aa, Artificial Sequence
  Synthetic construct
WSGFQVY

SEQ ID NO: 33814 - protein, 7 aa, Artificial Sequence
  Synthetic construct
WLIYIFF

SEQ ID NO: 33815 - protein, 7 aa, Artificial Sequence
  Synthetic construct
WLIYIFY

SEQ ID NO: 33816 - protein, 7 aa, Artificial Sequence
  Synthetic construct
WLIYIRF

SEQ ID NO: 33817 - protein, 7 aa, Artificial Sequence
  Synthetic construct
WLIYIRY

SEQ ID NO: 33818 - protein, 7 aa, Artificial Sequence
  Synthetic construct
WLIYICF

SEQ ID NO: 33819 - protein, 7 aa, Artificial Sequence
  Synthetic construct
WLIYICY

SEQ ID NO: 33820 - protein, 7 aa, Artificial Sequence
  Synthetic construct
WLIYILF

SEQ ID NO: 33821 - protein, 7 aa, Artificial Sequence
  Synthetic construct
WLIYILY

SEQ ID NO: 33822 - protein, 7 aa, Artificial Sequence
  Synthetic construct
WLIYIAF

SEQ ID NO: 33823 - protein, 7 aa, Artificial Sequence
  Synthetic construct
WLIYIAY

SEQ ID NO: 33824 - protein, 7 aa, Artificial Sequence
  Synthetic construct
WLIYIQF

SEQ ID NO: 33825 - protein, 7 aa, Artificial Sequence
  Synthetic construct
WLIYIQY

SEQ ID NO: 33826 - protein, 7 aa, Artificial Sequence
  Synthetic construct
WLIYIDF

SEQ ID NO: 33827 - protein, 7 aa, Artificial Sequence
  Synthetic construct
WLIYIDY

SEQ ID NO: 33828 - protein, 7 aa, Artificial Sequence
  Synthetic construct
WLIYIVF

SEQ ID NO: 33829 - protein, 7 aa, Artificial Sequence
  Synthetic construct
WLIYIVY

SEQ ID NO: 33830 - protein, 7 aa, Artificial Sequence
  Synthetic construct
WLIYDFF

SEQ ID NO: 33831 - protein, 7 aa, Artificial Sequence
  Synthetic construct
WLIYDFY

SEQ ID NO: 33832 - protein, 7 aa, Artificial Sequence
  Synthetic construct
WLIYDRF

SEQ ID NO: 33833 - protein, 7 aa, Artificial Sequence
  Synthetic construct
WLIYDRY

SEQ ID NO: 33834 - protein, 7 aa, Artificial Sequence
  Synthetic construct
WLIYDCF

SEQ ID NO: 33835 - protein, 7 aa, Artificial Sequence
  Synthetic construct
WLIYDCY

SEQ ID NO: 33836 - protein, 7 aa, Artificial Sequence
  Synthetic construct
WLIYDLF

SEQ ID NO: 33837 - protein, 7 aa, Artificial Sequence
  Synthetic construct
WLIYDLY

SEQ ID NO: 33838 - protein, 7 aa, Artificial Sequence
  Synthetic construct
WLIYDAF

SEQ ID NO: 33839 - protein, 7 aa, Artificial Sequence
  Synthetic construct
WLIYDAY

SEQ ID NO: 33840 - protein, 7 aa, Artificial Sequence
  Synthetic construct
WLIYDQF

SEQ ID NO: 33841 - protein, 7 aa, Artificial Sequence
  Synthetic construct
WLIYDQY

SEQ ID NO: 33842 - protein, 7 aa, Artificial Sequence
  Synthetic construct
WLIYDDF

SEQ ID NO: 33843 - protein, 7 aa, Artificial Sequence
  Synthetic construct
WLIYDDY

SEQ ID NO: 33844 - protein, 7 aa, Artificial Sequence
  Synthetic construct
WLIYDVF

SEQ ID NO: 33845 - protein, 7 aa, Artificial Sequence
  Synthetic construct
WLIYDVY

SEQ ID NO: 33846 - protein, 7 aa, Artificial Sequence
  Synthetic construct
WLIYYFF

SEQ ID NO: 33847 - protein, 7 aa, Artificial Sequence
  Synthetic construct
WLIYYFY

SEQ ID NO: 33848 - protein, 7 aa, Artificial Sequence
  Synthetic construct
WLIYYRF

SEQ ID NO: 33849 - protein, 7 aa, Artificial Sequence
  Synthetic construct
WLIYYRY

SEQ ID NO: 33850 - protein, 7 aa, Artificial Sequence
  Synthetic construct
WLIYYCF

SEQ ID NO: 33851 - protein, 7 aa, Artificial Sequence
  Synthetic construct
WLIYYCY

SEQ ID NO: 33852 - protein, 7 aa, Artificial Sequence
  Synthetic construct
WLIYYLF

SEQ ID NO: 33853 - protein, 7 aa, Artificial Sequence
  Synthetic construct
WLIYYLY

SEQ ID NO: 33854 - protein, 7 aa, Artificial Sequence
  Synthetic construct
WLIYYAF

SEQ ID NO: 33855 - protein, 7 aa, Artificial Sequence
  Synthetic construct
WLIYYAY

SEQ ID NO: 33856 - protein, 7 aa, Artificial Sequence
  Synthetic construct
WLIYYQF

SEQ ID NO: 33857 - protein, 7 aa, Artificial Sequence
  Synthetic construct
WLIYYQY

SEQ ID NO: 33858 - protein, 7 aa, Artificial Sequence
  Synthetic construct
WLIYYDF

SEQ ID NO: 33859 - protein, 7 aa, Artificial Sequence
  Synthetic construct
WLIYYDY

SEQ ID NO: 33860 - protein, 7 aa, Artificial Sequence
  Synthetic construct
WLIYYVF

SEQ ID NO: 33861 - protein, 7 aa, Artificial Sequence
  Synthetic construct
WLIYYVY

SEQ ID NO: 33862 - protein, 7 aa, Artificial Sequence
  Synthetic construct
WLIYFFF

SEQ ID NO: 33863 - protein, 7 aa, Artificial Sequence
  Synthetic construct
WLIYFFY

SEQ ID NO: 33864 - protein, 7 aa, Artificial Sequence
  Synthetic construct
WLIYFRF

SEQ ID NO: 33865 - protein, 7 aa, Artificial Sequence
  Synthetic construct
WLIYFRY

SEQ ID NO: 33866 - protein, 7 aa, Artificial Sequence
  Synthetic construct
WLIYFCF

SEQ ID NO: 33867 - protein, 7 aa, Artificial Sequence
  Synthetic construct
WLIYFCY

SEQ ID NO: 33868 - protein, 7 aa, Artificial Sequence
  Synthetic construct
WLIYFLF

SEQ ID NO: 33869 - protein, 7 aa, Artificial Sequence
  Synthetic construct
WLIYFLY

SEQ ID NO: 33870 - protein, 7 aa, Artificial Sequence
  Synthetic construct
WLIYFAF

SEQ ID NO: 33871 - protein, 7 aa, Artificial Sequence
  Synthetic construct
WLIYFAY

SEQ ID NO: 33872 - protein, 7 aa, Artificial Sequence
  Synthetic construct
WLIYFQF

SEQ ID NO: 33873 - protein, 7 aa, Artificial Sequence
  Synthetic construct
WLIYFQY

SEQ ID NO: 33874 - protein, 7 aa, Artificial Sequence
  Synthetic construct
WLIYFDF

SEQ ID NO: 33875 - protein, 7 aa, Artificial Sequence
  Synthetic construct
WLIYFDY

SEQ ID NO: 33876 - protein, 7 aa, Artificial Sequence
  Synthetic construct
WLIYFVF

SEQ ID NO: 33877 - protein, 7 aa, Artificial Sequence
  Synthetic construct
WLIYFVY

SEQ ID NO: 33878 - protein, 7 aa, Artificial Sequence
  Synthetic construct
WLIYVFF

SEQ ID NO: 33879 - protein, 7 aa, Artificial Sequence
  Synthetic construct
WLIYVFY

SEQ ID NO: 33880 - protein, 7 aa, Artificial Sequence
  Synthetic construct
WLIYVRF

SEQ ID NO: 33881 - protein, 7 aa, Artificial Sequence
  Synthetic construct
WLIYVRY

SEQ ID NO: 33882 - protein, 7 aa, Artificial Sequence
  Synthetic construct
WLIYVCF

SEQ ID NO: 33883 - protein, 7 aa, Artificial Sequence
  Synthetic construct
WLIYVCY

SEQ ID NO: 33884 - protein, 7 aa, Artificial Sequence
  Synthetic construct
WLIYVLF

SEQ ID NO: 33885 - protein, 7 aa, Artificial Sequence
  Synthetic construct
WLIYVLY

SEQ ID NO: 33886 - protein, 7 aa, Artificial Sequence
  Synthetic construct
WLIYVAF

SEQ ID NO: 33887 - protein, 7 aa, Artificial Sequence
  Synthetic construct
WLIYVAY

SEQ ID NO: 33888 - protein, 7 aa, Artificial Sequence
  Synthetic construct
WLIYVQF

SEQ ID NO: 33889 - protein, 7 aa, Artificial Sequence
  Synthetic construct
WLIYVQY

SEQ ID NO: 33890 - protein, 7 aa, Artificial Sequence
  Synthetic construct
WLIYVDF

SEQ ID NO: 33891 - protein, 7 aa, Artificial Sequence
  Synthetic construct
WLIYVDY

SEQ ID NO: 33892 - protein, 7 aa, Artificial Sequence
  Synthetic construct
WLIYVVF

SEQ ID NO: 33893 - protein, 7 aa, Artificial Sequence
  Synthetic construct
WLIYVVY

SEQ ID NO: 33894 - protein, 7 aa, Artificial Sequence
  Synthetic construct
WLIYTFF

SEQ ID NO: 33895 - protein, 7 aa, Artificial Sequence
  Synthetic construct
WLIYTFY

SEQ ID NO: 33896 - protein, 7 aa, Artificial Sequence
  Synthetic construct
WLIYTRF

SEQ ID NO: 33897 - protein, 7 aa, Artificial Sequence
  Synthetic construct
WLIYTRY

SEQ ID NO: 33898 - protein, 7 aa, Artificial Sequence
  Synthetic construct
WLIYTCF

SEQ ID NO: 33899 - protein, 7 aa, Artificial Sequence
  Synthetic construct
WLIYTCY

SEQ ID NO: 33900 - protein, 7 aa, Artificial Sequence
  Synthetic construct
WLIYTLF

SEQ ID NO: 33901 - protein, 7 aa, Artificial Sequence
  Synthetic construct
WLIYTLY

SEQ ID NO: 33902 - protein, 7 aa, Artificial Sequence
  Synthetic construct
WLIYTAF

SEQ ID NO: 33903 - protein, 7 aa, Artificial Sequence
  Synthetic construct
WLIYTAY

SEQ ID NO: 33904 - protein, 7 aa, Artificial Sequence
  Synthetic construct
WLIYTQF

SEQ ID NO: 33905 - protein, 7 aa, Artificial Sequence
  Synthetic construct
WLIYTQY

SEQ ID NO: 33906 - protein, 7 aa, Artificial Sequence
  Synthetic construct
WLIYTDF

SEQ ID NO: 33907 - protein, 7 aa, Artificial Sequence
  Synthetic construct
WLIYTDY

SEQ ID NO: 33908 - protein, 7 aa, Artificial Sequence
  Synthetic construct
WLIYTVF

SEQ ID NO: 33909 - protein, 7 aa, Artificial Sequence
  Synthetic construct
WLIYTVY

SEQ ID NO: 33910 - protein, 7 aa, Artificial Sequence
  Synthetic construct
WLIYGFF

SEQ ID NO: 33911 - protein, 7 aa, Artificial Sequence
  Synthetic construct
WLIYGFY

SEQ ID NO: 33912 - protein, 7 aa, Artificial Sequence
  Synthetic construct
WLIYGRF

SEQ ID NO: 33913 - protein, 7 aa, Artificial Sequence
  Synthetic construct
WLIYGRY

SEQ ID NO: 33914 - protein, 7 aa, Artificial Sequence
  Synthetic construct
WLIYGCF

SEQ ID NO: 33915 - protein, 7 aa, Artificial Sequence
  Synthetic construct
WLIYGCY

SEQ ID NO: 33916 - protein, 7 aa, Artificial Sequence
  Synthetic construct
WLIYGLF

SEQ ID NO: 33917 - protein, 7 aa, Artificial Sequence
  Synthetic construct
WLIYGLY

SEQ ID NO: 33918 - protein, 7 aa, Artificial Sequence
  Synthetic construct
WLIYGAF

SEQ ID NO: 33919 - protein, 7 aa, Artificial Sequence
  Synthetic construct
WLIYGAY

SEQ ID NO: 33920 - protein, 7 aa, Artificial Sequence
  Synthetic construct
WLIYGQF

SEQ ID NO: 33921 - protein, 7 aa, Artificial Sequence
  Synthetic construct
WLIYGQY

SEQ ID NO: 33922 - protein, 7 aa, Artificial Sequence
  Synthetic construct
WLIYGDF

SEQ ID NO: 33923 - protein, 7 aa, Artificial Sequence
  Synthetic construct
WLIYGDY

SEQ ID NO: 33924 - protein, 7 aa, Artificial Sequence
  Synthetic construct
WLIYGVF

SEQ ID NO: 33925 - protein, 7 aa, Artificial Sequence
  Synthetic construct
WLIYGVY

SEQ ID NO: 33926 - protein, 7 aa, Artificial Sequence
  Synthetic construct
WLIYAFF

SEQ ID NO: 33927 - protein, 7 aa, Artificial Sequence
  Synthetic construct
WLIYAFY

SEQ ID NO: 33928 - protein, 7 aa, Artificial Sequence
  Synthetic construct
WLIYARF

SEQ ID NO: 33929 - protein, 7 aa, Artificial Sequence
  Synthetic construct
WLIYARY

SEQ ID NO: 33930 - protein, 7 aa, Artificial Sequence
  Synthetic construct
WLIYACF

SEQ ID NO: 33931 - protein, 7 aa, Artificial Sequence
  Synthetic construct
WLIYACY

SEQ ID NO: 33932 - protein, 7 aa, Artificial Sequence
  Synthetic construct
WLIYALF

SEQ ID NO: 33933 - protein, 7 aa, Artificial Sequence
  Synthetic construct
WLIYALY

SEQ ID NO: 33934 - protein, 7 aa, Artificial Sequence
  Synthetic construct
WLIYAAF

SEQ ID NO: 33935 - protein, 7 aa, Artificial Sequence
  Synthetic construct
WLIYAAY

SEQ ID NO: 33936 - protein, 7 aa, Artificial Sequence
  Synthetic construct
WLIYAQF

SEQ ID NO: 33937 - protein, 7 aa, Artificial Sequence
  Synthetic construct
WLIYAQY

SEQ ID NO: 33938 - protein, 7 aa, Artificial Sequence
  Synthetic construct
WLIYADF

SEQ ID NO: 33939 - protein, 7 aa, Artificial Sequence
  Synthetic construct
WLIYADY

SEQ ID NO: 33940 - protein, 7 aa, Artificial Sequence
  Synthetic construct
WLIYAVF

SEQ ID NO: 33941 - protein, 7 aa, Artificial Sequence
  Synthetic construct
WLIYAVY

SEQ ID NO: 33942 - protein, 7 aa, Artificial Sequence
  Synthetic construct
WLIYQFF

SEQ ID NO: 33943 - protein, 7 aa, Artificial Sequence
  Synthetic construct
WLIYQFY

SEQ ID NO: 33944 - protein, 7 aa, Artificial Sequence
  Synthetic construct
WLIYQRF

SEQ ID NO: 33945 - protein, 7 aa, Artificial Sequence
  Synthetic construct
WLIYQRY

SEQ ID NO: 33946 - protein, 7 aa, Artificial Sequence
  Synthetic construct
WLIYQCF

SEQ ID NO: 33947 - protein, 7 aa, Artificial Sequence
  Synthetic construct
WLIYQCY

SEQ ID NO: 33948 - protein, 7 aa, Artificial Sequence
  Synthetic construct
WLIYQLF

SEQ ID NO: 33949 - protein, 7 aa, Artificial Sequence
  Synthetic construct
WLIYQLY

SEQ ID NO: 33950 - protein, 7 aa, Artificial Sequence
  Synthetic construct
WLIYQAF

SEQ ID NO: 33951 - protein, 7 aa, Artificial Sequence
  Synthetic construct
WLIYQAY

SEQ ID NO: 33952 - protein, 7 aa, Artificial Sequence
  Synthetic construct
WLIYQQF

SEQ ID NO: 33953 - protein, 7 aa, Artificial Sequence
  Synthetic construct
WLIYQQY

SEQ ID NO: 33954 - protein, 7 aa, Artificial Sequence
  Synthetic construct
WLIYQDF

SEQ ID NO: 33955 - protein, 7 aa, Artificial Sequence
  Synthetic construct
WLIYQDY

SEQ ID NO: 33956 - protein, 7 aa, Artificial Sequence
  Synthetic construct
WLIYQVF

SEQ ID NO: 33957 - protein, 7 aa, Artificial Sequence
  Synthetic construct
WLIYQVY

SEQ ID NO: 33958 - protein, 7 aa, Artificial Sequence
  Synthetic construct
WLIPIFF

SEQ ID NO: 33959 - protein, 7 aa, Artificial Sequence
  Synthetic construct
WLIPIFY

SEQ ID NO: 33960 - protein, 7 aa, Artificial Sequence
  Synthetic construct
WLIPIRF

SEQ ID NO: 33961 - protein, 7 aa, Artificial Sequence
  Synthetic construct
WLIPIRY

SEQ ID NO: 33962 - protein, 7 aa, Artificial Sequence
  Synthetic construct
WLIPICF

SEQ ID NO: 33963 - protein, 7 aa, Artificial Sequence
  Synthetic construct
WLIPICY

SEQ ID NO: 33964 - protein, 7 aa, Artificial Sequence
  Synthetic construct
WLIPILF

SEQ ID NO: 33965 - protein, 7 aa, Artificial Sequence
  Synthetic construct
WLIPILY

SEQ ID NO: 33966 - protein, 7 aa, Artificial Sequence
  Synthetic construct
WLIPIAF

SEQ ID NO: 33967 - protein, 7 aa, Artificial Sequence
  Synthetic construct
WLIPIAY

SEQ ID NO: 33968 - protein, 7 aa, Artificial Sequence
  Synthetic construct
WLIPIQF

SEQ ID NO: 33969 - protein, 7 aa, Artificial Sequence
  Synthetic construct
WLIPIQY

SEQ ID NO: 33970 - protein, 7 aa, Artificial Sequence
  Synthetic construct
WLIPIDF

SEQ ID NO: 33971 - protein, 7 aa, Artificial Sequence
  Synthetic construct
WLIPIDY

SEQ ID NO: 33972 - protein, 7 aa, Artificial Sequence
  Synthetic construct
WLIPIVF

SEQ ID NO: 33973 - protein, 7 aa, Artificial Sequence
  Synthetic construct
WLIPIVY

SEQ ID NO: 33974 - protein, 7 aa, Artificial Sequence
  Synthetic construct
WLIPDFF

SEQ ID NO: 33975 - protein, 7 aa, Artificial Sequence
  Synthetic construct
WLIPDFY

SEQ ID NO: 33976 - protein, 7 aa, Artificial Sequence
  Synthetic construct
WLIPDRF

SEQ ID NO: 33977 - protein, 7 aa, Artificial Sequence
  Synthetic construct
WLIPDRY

SEQ ID NO: 33978 - protein, 7 aa, Artificial Sequence
  Synthetic construct
WLIPDCF

SEQ ID NO: 33979 - protein, 7 aa, Artificial Sequence
  Synthetic construct
WLIPDCY

SEQ ID NO: 33980 - protein, 7 aa, Artificial Sequence
  Synthetic construct
WLIPDLF

SEQ ID NO: 33981 - protein, 7 aa, Artificial Sequence
  Synthetic construct
WLIPDLY

SEQ ID NO: 33982 - protein, 7 aa, Artificial Sequence
  Synthetic construct
WLIPDAF

SEQ ID NO: 33983 - protein, 7 aa, Artificial Sequence
  Synthetic construct
WLIPDAY

SEQ ID NO: 33984 - protein, 7 aa, Artificial Sequence
  Synthetic construct
WLIPDQF

SEQ ID NO: 33985 - protein, 7 aa, Artificial Sequence
  Synthetic construct
WLIPDQY

SEQ ID NO: 33986 - protein, 7 aa, Artificial Sequence
  Synthetic construct
WLIPDDF

SEQ ID NO: 33987 - protein, 7 aa, Artificial Sequence
  Synthetic construct
WLIPDDY

SEQ ID NO: 33988 - protein, 7 aa, Artificial Sequence
  Synthetic construct
WLIPDVF

SEQ ID NO: 33989 - protein, 7 aa, Artificial Sequence
  Synthetic construct
WLIPDVY

SEQ ID NO: 33990 - protein, 7 aa, Artificial Sequence
  Synthetic construct
WLIPYFF

SEQ ID NO: 33991 - protein, 7 aa, Artificial Sequence
  Synthetic construct
WLIPYFY

SEQ ID NO: 33992 - protein, 7 aa, Artificial Sequence
  Synthetic construct
WLIPYRF

SEQ ID NO: 33993 - protein, 7 aa, Artificial Sequence
  Synthetic construct
WLIPYRY

SEQ ID NO: 33994 - protein, 7 aa, Artificial Sequence
  Synthetic construct
WLIPYCF

SEQ ID NO: 33995 - protein, 7 aa, Artificial Sequence
  Synthetic construct
WLIPYCY

SEQ ID NO: 33996 - protein, 7 aa, Artificial Sequence
  Synthetic construct
WLIPYLF

SEQ ID NO: 33997 - protein, 7 aa, Artificial Sequence
  Synthetic construct
WLIPYLY

SEQ ID NO: 33998 - protein, 7 aa, Artificial Sequence
  Synthetic construct
WLIPYAF

SEQ ID NO: 33999 - protein, 7 aa, Artificial Sequence
  Synthetic construct
WLIPYAY

SEQ ID NO: 34000 - protein, 7 aa, Artificial Sequence
  Synthetic construct
WLIPYQF

SEQ ID NO: 34001 - protein, 7 aa, Artificial Sequence
  Synthetic construct
WLIPYQY

SEQ ID NO: 34002 - protein, 7 aa, Artificial Sequence
  Synthetic construct
WLIPYDF

SEQ ID NO: 34003 - protein, 7 aa, Artificial Sequence
  Synthetic construct
WLIPYDY

SEQ ID NO: 34004 - protein, 7 aa, Artificial Sequence
  Synthetic construct
WLIPYVF

SEQ ID NO: 34005 - protein, 7 aa, Artificial Sequence
  Synthetic construct
WLIPYVY

SEQ ID NO: 34006 - protein, 7 aa, Artificial Sequence
  Synthetic construct
WLIPFFF

SEQ ID NO: 34007 - protein, 7 aa, Artificial Sequence
  Synthetic construct
WLIPFFY

SEQ ID NO: 34008 - protein, 7 aa, Artificial Sequence
  Synthetic construct
WLIPFRF

SEQ ID NO: 34009 - protein, 7 aa, Artificial Sequence
  Synthetic construct
WLIPFRY

SEQ ID NO: 34010 - protein, 7 aa, Artificial Sequence
  Synthetic construct
WLIPFCF

SEQ ID NO: 34011 - protein, 7 aa, Artificial Sequence
  Synthetic construct
WLIPFCY

SEQ ID NO: 34012 - protein, 7 aa, Artificial Sequence
  Synthetic construct
WLIPFLF

SEQ ID NO: 34013 - protein, 7 aa, Artificial Sequence
  Synthetic construct
WLIPFLY

SEQ ID NO: 34014 - protein, 7 aa, Artificial Sequence
  Synthetic construct
WLIPFAF

SEQ ID NO: 34015 - protein, 7 aa, Artificial Sequence
  Synthetic construct
WLIPFAY

SEQ ID NO: 34016 - protein, 7 aa, Artificial Sequence
  Synthetic construct
WLIPFQF

SEQ ID NO: 34017 - protein, 7 aa, Artificial Sequence
  Synthetic construct
WLIPFQY

SEQ ID NO: 34018 - protein, 7 aa, Artificial Sequence
  Synthetic construct
WLIPFDF

SEQ ID NO: 34019 - protein, 7 aa, Artificial Sequence
  Synthetic construct
WLIPFDY

SEQ ID NO: 34020 - protein, 7 aa, Artificial Sequence
  Synthetic construct
WLIPFVF

SEQ ID NO: 34021 - protein, 7 aa, Artificial Sequence
  Synthetic construct
WLIPFVY

SEQ ID NO: 34022 - protein, 7 aa, Artificial Sequence
  Synthetic construct
WLIPVFF

SEQ ID NO: 34023 - protein, 7 aa, Artificial Sequence
  Synthetic construct
WLIPVFY

SEQ ID NO: 34024 - protein, 7 aa, Artificial Sequence
  Synthetic construct
WLIPVRF

SEQ ID NO: 34025 - protein, 7 aa, Artificial Sequence
  Synthetic construct
WLIPVRY

SEQ ID NO: 34026 - protein, 7 aa, Artificial Sequence
  Synthetic construct
WLIPVCF

SEQ ID NO: 34027 - protein, 7 aa, Artificial Sequence
  Synthetic construct
WLIPVCY

SEQ ID NO: 34028 - protein, 7 aa, Artificial Sequence
  Synthetic construct
WLIPVLF

SEQ ID NO: 34029 - protein, 7 aa, Artificial Sequence
  Synthetic construct
WLIPVLY

SEQ ID NO: 34030 - protein, 7 aa, Artificial Sequence
  Synthetic construct
WLIPVAF

SEQ ID NO: 34031 - protein, 7 aa, Artificial Sequence
  Synthetic construct
WLIPVAY

SEQ ID NO: 34032 - protein, 7 aa, Artificial Sequence
  Synthetic construct
WLIPVQF

SEQ ID NO: 34033 - protein, 7 aa, Artificial Sequence
  Synthetic construct
WLIPVQY

SEQ ID NO: 34034 - protein, 7 aa, Artificial Sequence
  Synthetic construct
WLIPVDF

SEQ ID NO: 34035 - protein, 7 aa, Artificial Sequence
  Synthetic construct
WLIPVDY

SEQ ID NO: 34036 - protein, 7 aa, Artificial Sequence
  Synthetic construct
WLIPVVF

SEQ ID NO: 34037 - protein, 7 aa, Artificial Sequence
  Synthetic construct
WLIPVVY

SEQ ID NO: 34038 - protein, 7 aa, Artificial Sequence
  Synthetic construct
WLIPTFF

SEQ ID NO: 34039 - protein, 7 aa, Artificial Sequence
  Synthetic construct
WLIPTFY

SEQ ID NO: 34040 - protein, 7 aa, Artificial Sequence
  Synthetic construct
WLIPTRF

SEQ ID NO: 34041 - protein, 7 aa, Artificial Sequence
  Synthetic construct
WLIPTRY

SEQ ID NO: 34042 - protein, 7 aa, Artificial Sequence
  Synthetic construct
WLIPTCF

SEQ ID NO: 34043 - protein, 7 aa, Artificial Sequence
  Synthetic construct
WLIPTCY

SEQ ID NO: 34044 - protein, 7 aa, Artificial Sequence
  Synthetic construct
WLIPTLF

SEQ ID NO: 34045 - protein, 7 aa, Artificial Sequence
  Synthetic construct
WLIPTLY

SEQ ID NO: 34046 - protein, 7 aa, Artificial Sequence
  Synthetic construct
WLIPTAF

SEQ ID NO: 34047 - protein, 7 aa, Artificial Sequence
  Synthetic construct
WLIPTAY

SEQ ID NO: 34048 - protein, 7 aa, Artificial Sequence
  Synthetic construct
WLIPTQF

SEQ ID NO: 34049 - protein, 7 aa, Artificial Sequence
  Synthetic construct
WLIPTQY

SEQ ID NO: 34050 - protein, 7 aa, Artificial Sequence
  Synthetic construct
WLIPTDF

SEQ ID NO: 34051 - protein, 7 aa, Artificial Sequence
  Synthetic construct
WLIPTDY

SEQ ID NO: 34052 - protein, 7 aa, Artificial Sequence
  Synthetic construct
WLIPTVF

SEQ ID NO: 34053 - protein, 7 aa, Artificial Sequence
  Synthetic construct
WLIPTVY

SEQ ID NO: 34054 - protein, 7 aa, Artificial Sequence
  Synthetic construct
WLIPGFF

SEQ ID NO: 34055 - protein, 7 aa, Artificial Sequence
  Synthetic construct
WLIPGFY

SEQ ID NO: 34056 - protein, 7 aa, Artificial Sequence
  Synthetic construct
WLIPGRF

SEQ ID NO: 34057 - protein, 7 aa, Artificial Sequence
  Synthetic construct
WLIPGRY

SEQ ID NO: 34058 - protein, 7 aa, Artificial Sequence
  Synthetic construct
WLIPGCF

SEQ ID NO: 34059 - protein, 7 aa, Artificial Sequence
  Synthetic construct
WLIPGCY

SEQ ID NO: 34060 - protein, 7 aa, Artificial Sequence
  Synthetic construct
WLIPGLF

SEQ ID NO: 34061 - protein, 7 aa, Artificial Sequence
  Synthetic construct
WLIPGLY

SEQ ID NO: 34062 - protein, 7 aa, Artificial Sequence
  Synthetic construct
WLIPGAF

SEQ ID NO: 34063 - protein, 7 aa, Artificial Sequence
  Synthetic construct
WLIPGAY

SEQ ID NO: 34064 - protein, 7 aa, Artificial Sequence
  Synthetic construct
WLIPGQF

SEQ ID NO: 34065 - protein, 7 aa, Artificial Sequence
  Synthetic construct
WLIPGQY

SEQ ID NO: 34066 - protein, 7 aa, Artificial Sequence
  Synthetic construct
WLIPGDF

SEQ ID NO: 34067 - protein, 7 aa, Artificial Sequence
  Synthetic construct
WLIPGDY

SEQ ID NO: 34068 - protein, 7 aa, Artificial Sequence
  Synthetic construct
WLIPGVF

SEQ ID NO: 34069 - protein, 7 aa, Artificial Sequence
  Synthetic construct
WLIPGVY

SEQ ID NO: 34070 - protein, 7 aa, Artificial Sequence
  Synthetic construct
WLIPAFF

SEQ ID NO: 34071 - protein, 7 aa, Artificial Sequence
  Synthetic construct
WLIPAFY

SEQ ID NO: 34072 - protein, 7 aa, Artificial Sequence
  Synthetic construct
WLIPARF

SEQ ID NO: 34073 - protein, 7 aa, Artificial Sequence
  Synthetic construct
WLIPARY

SEQ ID NO: 34074 - protein, 7 aa, Artificial Sequence
  Synthetic construct
WLIPACF

SEQ ID NO: 34075 - protein, 7 aa, Artificial Sequence
  Synthetic construct
WLIPACY

SEQ ID NO: 34076 - protein, 7 aa, Artificial Sequence
  Synthetic construct
WLIPALF

SEQ ID NO: 34077 - protein, 7 aa, Artificial Sequence
  Synthetic construct
WLIPALY

SEQ ID NO: 34078 - protein, 7 aa, Artificial Sequence
  Synthetic construct
WLIPAAF

SEQ ID NO: 34079 - protein, 7 aa, Artificial Sequence
  Synthetic construct
WLIPAAY

SEQ ID NO: 34080 - protein, 7 aa, Artificial Sequence
  Synthetic construct
WLIPAQF

SEQ ID NO: 34081 - protein, 7 aa, Artificial Sequence
  Synthetic construct
WLIPAQY

SEQ ID NO: 34082 - protein, 7 aa, Artificial Sequence
  Synthetic construct
WLIPADF

SEQ ID NO: 34083 - protein, 7 aa, Artificial Sequence
  Synthetic construct
WLIPADY

SEQ ID NO: 34084 - protein, 7 aa, Artificial Sequence
  Synthetic construct
WLIPAVF

SEQ ID NO: 34085 - protein, 7 aa, Artificial Sequence
  Synthetic construct
WLIPAVY

SEQ ID NO: 34086 - protein, 7 aa, Artificial Sequence
  Synthetic construct
WLIPQFF

SEQ ID NO: 34087 - protein, 7 aa, Artificial Sequence
  Synthetic construct
WLIPQFY

SEQ ID NO: 34088 - protein, 7 aa, Artificial Sequence
  Synthetic construct
WLIPQRF

SEQ ID NO: 34089 - protein, 7 aa, Artificial Sequence
  Synthetic construct
WLIPQRY

SEQ ID NO: 34090 - protein, 7 aa, Artificial Sequence
  Synthetic construct
WLIPQCF

SEQ ID NO: 34091 - protein, 7 aa, Artificial Sequence
  Synthetic construct
WLIPQCY

SEQ ID NO: 34092 - protein, 7 aa, Artificial Sequence
  Synthetic construct
WLIPQLF

SEQ ID NO: 34093 - protein, 7 aa, Artificial Sequence
  Synthetic construct
WLIPQLY

SEQ ID NO: 34094 - protein, 7 aa, Artificial Sequence
  Synthetic construct
WLIPQAF

SEQ ID NO: 34095 - protein, 7 aa, Artificial Sequence
  Synthetic construct
WLIPQAY

SEQ ID NO: 34096 - protein, 7 aa, Artificial Sequence
  Synthetic construct
WLIPQQF

SEQ ID NO: 34097 - protein, 7 aa, Artificial Sequence
  Synthetic construct
WLIPQQY

SEQ ID NO: 34098 - protein, 7 aa, Artificial Sequence
  Synthetic construct
WLIPQDF

SEQ ID NO: 34099 - protein, 7 aa, Artificial Sequence
  Synthetic construct
WLIPQDY

SEQ ID NO: 34100 - protein, 7 aa, Artificial Sequence
  Synthetic construct
WLIPQVF

SEQ ID NO: 34101 - protein, 7 aa, Artificial Sequence
  Synthetic construct
WLIPQVY

SEQ ID NO: 34102 - protein, 7 aa, Artificial Sequence
  Synthetic construct
WLIHIFF

SEQ ID NO: 34103 - protein, 7 aa, Artificial Sequence
  Synthetic construct
WLIHIFY

SEQ ID NO: 34104 - protein, 7 aa, Artificial Sequence
  Synthetic construct
WLIHIRF

SEQ ID NO: 34105 - protein, 7 aa, Artificial Sequence
  Synthetic construct
WLIHIRY

SEQ ID NO: 34106 - protein, 7 aa, Artificial Sequence
  Synthetic construct
WLIHICF

SEQ ID NO: 34107 - protein, 7 aa, Artificial Sequence
  Synthetic construct
WLIHICY

SEQ ID NO: 34108 - protein, 7 aa, Artificial Sequence
  Synthetic construct
WLIHILF

SEQ ID NO: 34109 - protein, 7 aa, Artificial Sequence
  Synthetic construct
WLIHILY

SEQ ID NO: 34110 - protein, 7 aa, Artificial Sequence
  Synthetic construct
WLIHIAF

SEQ ID NO: 34111 - protein, 7 aa, Artificial Sequence
  Synthetic construct
WLIHIAY

SEQ ID NO: 34112 - protein, 7 aa, Artificial Sequence
  Synthetic construct
WLIHIQF

SEQ ID NO: 34113 - protein, 7 aa, Artificial Sequence
  Synthetic construct
WLIHIQY

SEQ ID NO: 34114 - protein, 7 aa, Artificial Sequence
  Synthetic construct
WLIHIDF

SEQ ID NO: 34115 - protein, 7 aa, Artificial Sequence
  Synthetic construct
WLIHIDY

SEQ ID NO: 34116 - protein, 7 aa, Artificial Sequence
  Synthetic construct
WLIHIVF

SEQ ID NO: 34117 - protein, 7 aa, Artificial Sequence
  Synthetic construct
WLIHIVY

SEQ ID NO: 34118 - protein, 7 aa, Artificial Sequence
  Synthetic construct
WLIHDFF

SEQ ID NO: 34119 - protein, 7 aa, Artificial Sequence
  Synthetic construct
WLIHDFY

SEQ ID NO: 34120 - protein, 7 aa, Artificial Sequence
  Synthetic construct
WLIHDRF

SEQ ID NO: 34121 - protein, 7 aa, Artificial Sequence
  Synthetic construct
WLIHDRY

SEQ ID NO: 34122 - protein, 7 aa, Artificial Sequence
  Synthetic construct
WLIHDCF

SEQ ID NO: 34123 - protein, 7 aa, Artificial Sequence
  Synthetic construct
WLIHDCY

SEQ ID NO: 34124 - protein, 7 aa, Artificial Sequence
  Synthetic construct
WLIHDLF

SEQ ID NO: 34125 - protein, 7 aa, Artificial Sequence
  Synthetic construct
WLIHDLY

SEQ ID NO: 34126 - protein, 7 aa, Artificial Sequence
  Synthetic construct
WLIHDAF

SEQ ID NO: 34127 - protein, 7 aa, Artificial Sequence
  Synthetic construct
WLIHDAY

SEQ ID NO: 34128 - protein, 7 aa, Artificial Sequence
  Synthetic construct
WLIHDQF

SEQ ID NO: 34129 - protein, 7 aa, Artificial Sequence
  Synthetic construct
WLIHDQY

SEQ ID NO: 34130 - protein, 7 aa, Artificial Sequence
  Synthetic construct
WLIHDDF

SEQ ID NO: 34131 - protein, 7 aa, Artificial Sequence
  Synthetic construct
WLIHDDY

SEQ ID NO: 34132 - protein, 7 aa, Artificial Sequence
  Synthetic construct
WLIHDVF

SEQ ID NO: 34133 - protein, 7 aa, Artificial Sequence
  Synthetic construct
WLIHDVY

SEQ ID NO: 34134 - protein, 7 aa, Artificial Sequence
  Synthetic construct
WLIHYFF

SEQ ID NO: 34135 - protein, 7 aa, Artificial Sequence
  Synthetic construct
WLIHYFY

SEQ ID NO: 34136 - protein, 7 aa, Artificial Sequence
  Synthetic construct
WLIHYRF

SEQ ID NO: 34137 - protein, 7 aa, Artificial Sequence
  Synthetic construct
WLIHYRY

SEQ ID NO: 34138 - protein, 7 aa, Artificial Sequence
  Synthetic construct
WLIHYCF

SEQ ID NO: 34139 - protein, 7 aa, Artificial Sequence
  Synthetic construct
WLIHYCY

SEQ ID NO: 34140 - protein, 7 aa, Artificial Sequence
  Synthetic construct
WLIHYLF

SEQ ID NO: 34141 - protein, 7 aa, Artificial Sequence
  Synthetic construct
WLIHYLY

SEQ ID NO: 34142 - protein, 7 aa, Artificial Sequence
  Synthetic construct
WLIHYAF

SEQ ID NO: 34143 - protein, 7 aa, Artificial Sequence
  Synthetic construct
WLIHYAY

SEQ ID NO: 34144 - protein, 7 aa, Artificial Sequence
  Synthetic construct
WLIHYQF

SEQ ID NO: 34145 - protein, 7 aa, Artificial Sequence
  Synthetic construct
WLIHYQY

SEQ ID NO: 34146 - protein, 7 aa, Artificial Sequence
  Synthetic construct
WLIHYDF

SEQ ID NO: 34147 - protein, 7 aa, Artificial Sequence
  Synthetic construct
WLIHYDY

SEQ ID NO: 34148 - protein, 7 aa, Artificial Sequence
  Synthetic construct
WLIHYVF

SEQ ID NO: 34149 - protein, 7 aa, Artificial Sequence
  Synthetic construct
WLIHYVY

SEQ ID NO: 34150 - protein, 7 aa, Artificial Sequence
  Synthetic construct
WLIHFFF

SEQ ID NO: 34151 - protein, 7 aa, Artificial Sequence
  Synthetic construct
WLIHFFY

SEQ ID NO: 34152 - protein, 7 aa, Artificial Sequence
  Synthetic construct
WLIHFRF

SEQ ID NO: 34153 - protein, 7 aa, Artificial Sequence
  Synthetic construct
WLIHFRY

SEQ ID NO: 34154 - protein, 7 aa, Artificial Sequence
  Synthetic construct
WLIHFCF

SEQ ID NO: 34155 - protein, 7 aa, Artificial Sequence
  Synthetic construct
WLIHFCY

SEQ ID NO: 34156 - protein, 7 aa, Artificial Sequence
  Synthetic construct
WLIHFLF

SEQ ID NO: 34157 - protein, 7 aa, Artificial Sequence
  Synthetic construct
WLIHFLY

SEQ ID NO: 34158 - protein, 7 aa, Artificial Sequence
  Synthetic construct
WLIHFAF

SEQ ID NO: 34159 - protein, 7 aa, Artificial Sequence
  Synthetic construct
WLIHFAY

SEQ ID NO: 34160 - protein, 7 aa, Artificial Sequence
  Synthetic construct
WLIHFQF

SEQ ID NO: 34161 - protein, 7 aa, Artificial Sequence
  Synthetic construct
WLIHFQY

SEQ ID NO: 34162 - protein, 7 aa, Artificial Sequence
  Synthetic construct
WLIHFDF

SEQ ID NO: 34163 - protein, 7 aa, Artificial Sequence
  Synthetic construct
WLIHFDY

SEQ ID NO: 34164 - protein, 7 aa, Artificial Sequence
  Synthetic construct
WLIHFVF

SEQ ID NO: 34165 - protein, 7 aa, Artificial Sequence
  Synthetic construct
WLIHFVY

SEQ ID NO: 34166 - protein, 7 aa, Artificial Sequence
  Synthetic construct
WLIHVFF

SEQ ID NO: 34167 - protein, 7 aa, Artificial Sequence
  Synthetic construct
WLIHVFY

SEQ ID NO: 34168 - protein, 7 aa, Artificial Sequence
  Synthetic construct
WLIHVRF

SEQ ID NO: 34169 - protein, 7 aa, Artificial Sequence
  Synthetic construct
WLIHVRY

SEQ ID NO: 34170 - protein, 7 aa, Artificial Sequence
  Synthetic construct
WLIHVCF

SEQ ID NO: 34171 - protein, 7 aa, Artificial Sequence
  Synthetic construct
WLIHVCY

SEQ ID NO: 34172 - protein, 7 aa, Artificial Sequence
  Synthetic construct
WLIHVLF

SEQ ID NO: 34173 - protein, 7 aa, Artificial Sequence
  Synthetic construct
WLIHVLY

SEQ ID NO: 34174 - protein, 7 aa, Artificial Sequence
  Synthetic construct
WLIHVAF

SEQ ID NO: 34175 - protein, 7 aa, Artificial Sequence
  Synthetic construct
WLIHVAY

SEQ ID NO: 34176 - protein, 7 aa, Artificial Sequence
  Synthetic construct
WLIHVQF

SEQ ID NO: 34177 - protein, 7 aa, Artificial Sequence
  Synthetic construct
WLIHVQY

SEQ ID NO: 34178 - protein, 7 aa, Artificial Sequence
  Synthetic construct
WLIHVDF

SEQ ID NO: 34179 - protein, 7 aa, Artificial Sequence
  Synthetic construct
WLIHVDY

SEQ ID NO: 34180 - protein, 7 aa, Artificial Sequence
  Synthetic construct
WLIHVVF

SEQ ID NO: 34181 - protein, 7 aa, Artificial Sequence
  Synthetic construct
WLIHVVY

SEQ ID NO: 34182 - protein, 7 aa, Artificial Sequence
  Synthetic construct
WLIHTFF

SEQ ID NO: 34183 - protein, 7 aa, Artificial Sequence
  Synthetic construct
WLIHTFY

SEQ ID NO: 34184 - protein, 7 aa, Artificial Sequence
  Synthetic construct
WLIHTRF

SEQ ID NO: 34185 - protein, 7 aa, Artificial Sequence
  Synthetic construct
WLIHTRY

SEQ ID NO: 34186 - protein, 7 aa, Artificial Sequence
  Synthetic construct
WLIHTCF

SEQ ID NO: 34187 - protein, 7 aa, Artificial Sequence
  Synthetic construct
WLIHTCY

SEQ ID NO: 34188 - protein, 7 aa, Artificial Sequence
  Synthetic construct
WLIHTLF

SEQ ID NO: 34189 - protein, 7 aa, Artificial Sequence
  Synthetic construct
WLIHTLY

SEQ ID NO: 34190 - protein, 7 aa, Artificial Sequence
  Synthetic construct
WLIHTAF

SEQ ID NO: 34191 - protein, 7 aa, Artificial Sequence
  Synthetic construct
WLIHTAY

SEQ ID NO: 34192 - protein, 7 aa, Artificial Sequence
  Synthetic construct
WLIHTQF

SEQ ID NO: 34193 - protein, 7 aa, Artificial Sequence
  Synthetic construct
WLIHTQY

SEQ ID NO: 34194 - protein, 7 aa, Artificial Sequence
  Synthetic construct
WLIHTDF

SEQ ID NO: 34195 - protein, 7 aa, Artificial Sequence
  Synthetic construct
WLIHTDY

SEQ ID NO: 34196 - protein, 7 aa, Artificial Sequence
  Synthetic construct
WLIHTVF

SEQ ID NO: 34197 - protein, 7 aa, Artificial Sequence
  Synthetic construct
WLIHTVY

SEQ ID NO: 34198 - protein, 7 aa, Artificial Sequence
  Synthetic construct
WLIHGFF

SEQ ID NO: 34199 - protein, 7 aa, Artificial Sequence
  Synthetic construct
WLIHGFY

SEQ ID NO: 34200 - protein, 7 aa, Artificial Sequence
  Synthetic construct
WLIHGRF

SEQ ID NO: 34201 - protein, 7 aa, Artificial Sequence
  Synthetic construct
WLIHGRY

SEQ ID NO: 34202 - protein, 7 aa, Artificial Sequence
  Synthetic construct
WLIHGCF

SEQ ID NO: 34203 - protein, 7 aa, Artificial Sequence
  Synthetic construct
WLIHGCY

SEQ ID NO: 34204 - protein, 7 aa, Artificial Sequence
  Synthetic construct
WLIHGLF

SEQ ID NO: 34205 - protein, 7 aa, Artificial Sequence
  Synthetic construct
WLIHGLY

SEQ ID NO: 34206 - protein, 7 aa, Artificial Sequence
  Synthetic construct
WLIHGAF

SEQ ID NO: 34207 - protein, 7 aa, Artificial Sequence
  Synthetic construct
WLIHGAY

SEQ ID NO: 34208 - protein, 7 aa, Artificial Sequence
  Synthetic construct
WLIHGQF

SEQ ID NO: 34209 - protein, 7 aa, Artificial Sequence
  Synthetic construct
WLIHGQY

SEQ ID NO: 34210 - protein, 7 aa, Artificial Sequence
  Synthetic construct
WLIHGDF

SEQ ID NO: 34211 - protein, 7 aa, Artificial Sequence
  Synthetic construct
WLIHGDY

SEQ ID NO: 34212 - protein, 7 aa, Artificial Sequence
  Synthetic construct
WLIHGVF

SEQ ID NO: 34213 - protein, 7 aa, Artificial Sequence
  Synthetic construct
WLIHGVY

SEQ ID NO: 34214 - protein, 7 aa, Artificial Sequence
  Synthetic construct
WLIHAFF

SEQ ID NO: 34215 - protein, 7 aa, Artificial Sequence
  Synthetic construct
WLIHAFY

SEQ ID NO: 34216 - protein, 7 aa, Artificial Sequence
  Synthetic construct
WLIHARF

SEQ ID NO: 34217 - protein, 7 aa, Artificial Sequence
  Synthetic construct
WLIHARY

SEQ ID NO: 34218 - protein, 7 aa, Artificial Sequence
  Synthetic construct
WLIHACF

SEQ ID NO: 34219 - protein, 7 aa, Artificial Sequence
  Synthetic construct
WLIHACY

SEQ ID NO: 34220 - protein, 7 aa, Artificial Sequence
  Synthetic construct
WLIHALF

SEQ ID NO: 34221 - protein, 7 aa, Artificial Sequence
  Synthetic construct
WLIHALY

SEQ ID NO: 34222 - protein, 7 aa, Artificial Sequence
  Synthetic construct
WLIHAAF

SEQ ID NO: 34223 - protein, 7 aa, Artificial Sequence
  Synthetic construct
WLIHAAY

SEQ ID NO: 34224 - protein, 7 aa, Artificial Sequence
  Synthetic construct
WLIHAQF

SEQ ID NO: 34225 - protein, 7 aa, Artificial Sequence
  Synthetic construct
WLIHAQY

SEQ ID NO: 34226 - protein, 7 aa, Artificial Sequence
  Synthetic construct
WLIHADF

SEQ ID NO: 34227 - protein, 7 aa, Artificial Sequence
  Synthetic construct
WLIHADY

SEQ ID NO: 34228 - protein, 7 aa, Artificial Sequence
  Synthetic construct
WLIHAVF

SEQ ID NO: 34229 - protein, 7 aa, Artificial Sequence
  Synthetic construct
WLIHAVY

SEQ ID NO: 34230 - protein, 7 aa, Artificial Sequence
  Synthetic construct
WLIHQFF

SEQ ID NO: 34231 - protein, 7 aa, Artificial Sequence
  Synthetic construct
WLIHQFY

SEQ ID NO: 34232 - protein, 7 aa, Artificial Sequence
  Synthetic construct
WLIHQRF

SEQ ID NO: 34233 - protein, 7 aa, Artificial Sequence
  Synthetic construct
WLIHQRY

SEQ ID NO: 34234 - protein, 7 aa, Artificial Sequence
  Synthetic construct
WLIHQCF

SEQ ID NO: 34235 - protein, 7 aa, Artificial Sequence
  Synthetic construct
WLIHQCY

SEQ ID NO: 34236 - protein, 7 aa, Artificial Sequence
  Synthetic construct
WLIHQLF

SEQ ID NO: 34237 - protein, 7 aa, Artificial Sequence
  Synthetic construct
WLIHQLY

SEQ ID NO: 34238 - protein, 7 aa, Artificial Sequence
  Synthetic construct
WLIHQAF

SEQ ID NO: 34239 - protein, 7 aa, Artificial Sequence
  Synthetic construct
WLIHQAY

SEQ ID NO: 34240 - protein, 7 aa, Artificial Sequence
  Synthetic construct
WLIHQQF

SEQ ID NO: 34241 - protein, 7 aa, Artificial Sequence
  Synthetic construct
WLIHQQY

SEQ ID NO: 34242 - protein, 7 aa, Artificial Sequence
  Synthetic construct
WLIHQDF

SEQ ID NO: 34243 - protein, 7 aa, Artificial Sequence
  Synthetic construct
WLIHQDY

SEQ ID NO: 34244 - protein, 7 aa, Artificial Sequence
  Synthetic construct
WLIHQVF

SEQ ID NO: 34245 - protein, 7 aa, Artificial Sequence
  Synthetic construct
WLIHQVY

SEQ ID NO: 34246 - protein, 7 aa, Artificial Sequence
  Synthetic construct
WLILIFF

SEQ ID NO: 34247 - protein, 7 aa, Artificial Sequence
  Synthetic construct
WLILIFY

SEQ ID NO: 34248 - protein, 7 aa, Artificial Sequence
  Synthetic construct
WLILIRF

SEQ ID NO: 34249 - protein, 7 aa, Artificial Sequence
  Synthetic construct
WLILIRY

SEQ ID NO: 34250 - protein, 7 aa, Artificial Sequence
  Synthetic construct
WLILICF

SEQ ID NO: 34251 - protein, 7 aa, Artificial Sequence
  Synthetic construct
WLILICY

SEQ ID NO: 34252 - protein, 7 aa, Artificial Sequence
  Synthetic construct
WLILILF

SEQ ID NO: 34253 - protein, 7 aa, Artificial Sequence
  Synthetic construct
WLILILY

SEQ ID NO: 34254 - protein, 7 aa, Artificial Sequence
  Synthetic construct
WLILIAF

SEQ ID NO: 34255 - protein, 7 aa, Artificial Sequence
  Synthetic construct
WLILIAY

SEQ ID NO: 34256 - protein, 7 aa, Artificial Sequence
  Synthetic construct
WLILIQF

SEQ ID NO: 34257 - protein, 7 aa, Artificial Sequence
  Synthetic construct
WLILIQY

SEQ ID NO: 34258 - protein, 7 aa, Artificial Sequence
  Synthetic construct
WLILIDF

SEQ ID NO: 34259 - protein, 7 aa, Artificial Sequence
  Synthetic construct
WLILIDY

SEQ ID NO: 34260 - protein, 7 aa, Artificial Sequence
  Synthetic construct
WLILIVF

SEQ ID NO: 34261 - protein, 7 aa, Artificial Sequence
  Synthetic construct
WLILIVY

SEQ ID NO: 34262 - protein, 7 aa, Artificial Sequence
  Synthetic construct
WLILDFF

SEQ ID NO: 34263 - protein, 7 aa, Artificial Sequence
  Synthetic construct
WLILDFY

SEQ ID NO: 34264 - protein, 7 aa, Artificial Sequence
  Synthetic construct
WLILDRF

SEQ ID NO: 34265 - protein, 7 aa, Artificial Sequence
  Synthetic construct
WLILDRY

SEQ ID NO: 34266 - protein, 7 aa, Artificial Sequence
  Synthetic construct
WLILDCF

SEQ ID NO: 34267 - protein, 7 aa, Artificial Sequence
  Synthetic construct
WLILDCY

SEQ ID NO: 34268 - protein, 7 aa, Artificial Sequence
  Synthetic construct
WLILDLF

SEQ ID NO: 34269 - protein, 7 aa, Artificial Sequence
  Synthetic construct
WLILDLY

SEQ ID NO: 34270 - protein, 7 aa, Artificial Sequence
  Synthetic construct
WLILDAF

SEQ ID NO: 34271 - protein, 7 aa, Artificial Sequence
  Synthetic construct
WLILDAY

SEQ ID NO: 34272 - protein, 7 aa, Artificial Sequence
  Synthetic construct
WLILDQF

SEQ ID NO: 34273 - protein, 7 aa, Artificial Sequence
  Synthetic construct
WLILDQY

SEQ ID NO: 34274 - protein, 7 aa, Artificial Sequence
  Synthetic construct
WLILDDF

SEQ ID NO: 34275 - protein, 7 aa, Artificial Sequence
  Synthetic construct
WLILDDY

SEQ ID NO: 34276 - protein, 7 aa, Artificial Sequence
  Synthetic construct
WLILDVF

SEQ ID NO: 34277 - protein, 7 aa, Artificial Sequence
  Synthetic construct
WLILDVY

SEQ ID NO: 34278 - protein, 7 aa, Artificial Sequence
  Synthetic construct
WLILYFF

SEQ ID NO: 34279 - protein, 7 aa, Artificial Sequence
  Synthetic construct
WLILYFY

SEQ ID NO: 34280 - protein, 7 aa, Artificial Sequence
  Synthetic construct
WLILYRF

SEQ ID NO: 34281 - protein, 7 aa, Artificial Sequence
  Synthetic construct
WLILYRY

SEQ ID NO: 34282 - protein, 7 aa, Artificial Sequence
  Synthetic construct
WLILYCF

SEQ ID NO: 34283 - protein, 7 aa, Artificial Sequence
  Synthetic construct
WLILYCY

SEQ ID NO: 34284 - protein, 7 aa, Artificial Sequence
  Synthetic construct
WLILYLF

SEQ ID NO: 34285 - protein, 7 aa, Artificial Sequence
  Synthetic construct
WLILYLY

SEQ ID NO: 34286 - protein, 7 aa, Artificial Sequence
  Synthetic construct
WLILYAF

SEQ ID NO: 34287 - protein, 7 aa, Artificial Sequence
  Synthetic construct
WLILYAY

SEQ ID NO: 34288 - protein, 7 aa, Artificial Sequence
  Synthetic construct
WLILYQF

SEQ ID NO: 34289 - protein, 7 aa, Artificial Sequence
  Synthetic construct
WLILYQY

SEQ ID NO: 34290 - protein, 7 aa, Artificial Sequence
  Synthetic construct
WLILYDF

SEQ ID NO: 34291 - protein, 7 aa, Artificial Sequence
  Synthetic construct
WLILYDY

SEQ ID NO: 34292 - protein, 7 aa, Artificial Sequence
  Synthetic construct
WLILYVF

SEQ ID NO: 34293 - protein, 7 aa, Artificial Sequence
  Synthetic construct
WLILYVY

SEQ ID NO: 34294 - protein, 7 aa, Artificial Sequence
  Synthetic construct
WLILFFF

SEQ ID NO: 34295 - protein, 7 aa, Artificial Sequence
  Synthetic construct
WLILFFY

SEQ ID NO: 34296 - protein, 7 aa, Artificial Sequence
  Synthetic construct
WLILFRF

SEQ ID NO: 34297 - protein, 7 aa, Artificial Sequence
  Synthetic construct
WLILFRY

SEQ ID NO: 34298 - protein, 7 aa, Artificial Sequence
  Synthetic construct
WLILFCF

SEQ ID NO: 34299 - protein, 7 aa, Artificial Sequence
  Synthetic construct
WLILFCY

SEQ ID NO: 34300 - protein, 7 aa, Artificial Sequence
  Synthetic construct
WLILFLF

SEQ ID NO: 34301 - protein, 7 aa, Artificial Sequence
  Synthetic construct
WLILFLY

SEQ ID NO: 34302 - protein, 7 aa, Artificial Sequence
  Synthetic construct
WLILFAF

SEQ ID NO: 34303 - protein, 7 aa, Artificial Sequence
  Synthetic construct
WLILFAY

SEQ ID NO: 34304 - protein, 7 aa, Artificial Sequence
  Synthetic construct
WLILFQF

SEQ ID NO: 34305 - protein, 7 aa, Artificial Sequence
  Synthetic construct
WLILFQY

SEQ ID NO: 34306 - protein, 7 aa, Artificial Sequence
  Synthetic construct
WLILFDF

SEQ ID NO: 34307 - protein, 7 aa, Artificial Sequence
  Synthetic construct
WLILFDY

SEQ ID NO: 34308 - protein, 7 aa, Artificial Sequence
  Synthetic construct
WLILFVF

SEQ ID NO: 34309 - protein, 7 aa, Artificial Sequence
  Synthetic construct
WLILFVY

SEQ ID NO: 34310 - protein, 7 aa, Artificial Sequence
  Synthetic construct
WLILVFF

SEQ ID NO: 34311 - protein, 7 aa, Artificial Sequence
  Synthetic construct
WLILVFY

SEQ ID NO: 34312 - protein, 7 aa, Artificial Sequence
  Synthetic construct
WLILVRF

SEQ ID NO: 34313 - protein, 7 aa, Artificial Sequence
  Synthetic construct
WLILVRY

SEQ ID NO: 34314 - protein, 7 aa, Artificial Sequence
  Synthetic construct
WLILVCF

SEQ ID NO: 34315 - protein, 7 aa, Artificial Sequence
  Synthetic construct
WLILVCY

SEQ ID NO: 34316 - protein, 7 aa, Artificial Sequence
  Synthetic construct
WLILVLF

SEQ ID NO: 34317 - protein, 7 aa, Artificial Sequence
  Synthetic construct
WLILVLY

SEQ ID NO: 34318 - protein, 7 aa, Artificial Sequence
  Synthetic construct
WLILVAF

SEQ ID NO: 34319 - protein, 7 aa, Artificial Sequence
  Synthetic construct
WLILVAY

SEQ ID NO: 34320 - protein, 7 aa, Artificial Sequence
  Synthetic construct
WLILVQF

SEQ ID NO: 34321 - protein, 7 aa, Artificial Sequence
  Synthetic construct
WLILVQY

SEQ ID NO: 34322 - protein, 7 aa, Artificial Sequence
  Synthetic construct
WLILVDF

SEQ ID NO: 34323 - protein, 7 aa, Artificial Sequence
  Synthetic construct
WLILVDY

SEQ ID NO: 34324 - protein, 7 aa, Artificial Sequence
  Synthetic construct
WLILVVF

SEQ ID NO: 34325 - protein, 7 aa, Artificial Sequence
  Synthetic construct
WLILVVY

SEQ ID NO: 34326 - protein, 7 aa, Artificial Sequence
  Synthetic construct
WLILTFF

SEQ ID NO: 34327 - protein, 7 aa, Artificial Sequence
  Synthetic construct
WLILTFY

SEQ ID NO: 34328 - protein, 7 aa, Artificial Sequence
  Synthetic construct
WLILTRF

SEQ ID NO: 34329 - protein, 7 aa, Artificial Sequence
  Synthetic construct
WLILTRY

SEQ ID NO: 34330 - protein, 7 aa, Artificial Sequence
  Synthetic construct
WLILTCF

SEQ ID NO: 34331 - protein, 7 aa, Artificial Sequence
  Synthetic construct
WLILTCY

SEQ ID NO: 34332 - protein, 7 aa, Artificial Sequence
  Synthetic construct
WLILTLF

SEQ ID NO: 34333 - protein, 7 aa, Artificial Sequence
  Synthetic construct
WLILTLY

SEQ ID NO: 34334 - protein, 7 aa, Artificial Sequence
  Synthetic construct
WLILTAF

SEQ ID NO: 34335 - protein, 7 aa, Artificial Sequence
  Synthetic construct
WLILTAY

SEQ ID NO: 34336 - protein, 7 aa, Artificial Sequence
  Synthetic construct
WLILTQF

SEQ ID NO: 34337 - protein, 7 aa, Artificial Sequence
  Synthetic construct
WLILTQY

SEQ ID NO: 34338 - protein, 7 aa, Artificial Sequence
  Synthetic construct
WLILTDF

SEQ ID NO: 34339 - protein, 7 aa, Artificial Sequence
  Synthetic construct
WLILTDY

SEQ ID NO: 34340 - protein, 7 aa, Artificial Sequence
  Synthetic construct
WLILTVF

SEQ ID NO: 34341 - protein, 7 aa, Artificial Sequence
  Synthetic construct
WLILTVY

SEQ ID NO: 34342 - protein, 7 aa, Artificial Sequence
  Synthetic construct
WLILGFF

SEQ ID NO: 34343 - protein, 7 aa, Artificial Sequence
  Synthetic construct
WLILGFY

SEQ ID NO: 34344 - protein, 7 aa, Artificial Sequence
  Synthetic construct
WLILGRF

SEQ ID NO: 34345 - protein, 7 aa, Artificial Sequence
  Synthetic construct
WLILGRY

SEQ ID NO: 34346 - protein, 7 aa, Artificial Sequence
  Synthetic construct
WLILGCF

SEQ ID NO: 34347 - protein, 7 aa, Artificial Sequence
  Synthetic construct
WLILGCY

SEQ ID NO: 34348 - protein, 7 aa, Artificial Sequence
  Synthetic construct
WLILGLF

SEQ ID NO: 34349 - protein, 7 aa, Artificial Sequence
  Synthetic construct
WLILGLY

SEQ ID NO: 34350 - protein, 7 aa, Artificial Sequence
  Synthetic construct
WLILGAF

SEQ ID NO: 34351 - protein, 7 aa, Artificial Sequence
  Synthetic construct
WLILGAY

SEQ ID NO: 34352 - protein, 7 aa, Artificial Sequence
  Synthetic construct
WLILGQF

SEQ ID NO: 34353 - protein, 7 aa, Artificial Sequence
  Synthetic construct
WLILGQY

SEQ ID NO: 34354 - protein, 7 aa, Artificial Sequence
  Synthetic construct
WLILGDF

SEQ ID NO: 34355 - protein, 7 aa, Artificial Sequence
  Synthetic construct
WLILGDY

SEQ ID NO: 34356 - protein, 7 aa, Artificial Sequence
  Synthetic construct
WLILGVF

SEQ ID NO: 34357 - protein, 7 aa, Artificial Sequence
  Synthetic construct
WLILGVY

SEQ ID NO: 34358 - protein, 7 aa, Artificial Sequence
  Synthetic construct
WLILAFF

SEQ ID NO: 34359 - protein, 7 aa, Artificial Sequence
  Synthetic construct
WLILAFY

SEQ ID NO: 34360 - protein, 7 aa, Artificial Sequence
  Synthetic construct
WLILARF

SEQ ID NO: 34361 - protein, 7 aa, Artificial Sequence
  Synthetic construct
WLILARY

SEQ ID NO: 34362 - protein, 7 aa, Artificial Sequence
  Synthetic construct
WLILACF

SEQ ID NO: 34363 - protein, 7 aa, Artificial Sequence
  Synthetic construct
WLILACY

SEQ ID NO: 34364 - protein, 7 aa, Artificial Sequence
  Synthetic construct
WLILALF

SEQ ID NO: 34365 - protein, 7 aa, Artificial Sequence
  Synthetic construct
WLILALY

SEQ ID NO: 34366 - protein, 7 aa, Artificial Sequence
  Synthetic construct
WLILAAF

SEQ ID NO: 34367 - protein, 7 aa, Artificial Sequence
  Synthetic construct
WLILAAY

SEQ ID NO: 34368 - protein, 7 aa, Artificial Sequence
  Synthetic construct
WLILAQF

SEQ ID NO: 34369 - protein, 7 aa, Artificial Sequence
  Synthetic construct
WLILAQY

SEQ ID NO: 34370 - protein, 7 aa, Artificial Sequence
  Synthetic construct
WLILADF

SEQ ID NO: 34371 - protein, 7 aa, Artificial Sequence
  Synthetic construct
WLILADY

SEQ ID NO: 34372 - protein, 7 aa, Artificial Sequence
  Synthetic construct
WLILAVF

SEQ ID NO: 34373 - protein, 7 aa, Artificial Sequence
  Synthetic construct
WLILAVY

SEQ ID NO: 34374 - protein, 7 aa, Artificial Sequence
  Synthetic construct
WLILQFF

SEQ ID NO: 34375 - protein, 7 aa, Artificial Sequence
  Synthetic construct
WLILQFY

SEQ ID NO: 34376 - protein, 7 aa, Artificial Sequence
  Synthetic construct
WLILQRF

SEQ ID NO: 34377 - protein, 7 aa, Artificial Sequence
  Synthetic construct
WLILQRY

SEQ ID NO: 34378 - protein, 7 aa, Artificial Sequence
  Synthetic construct
WLILQCF

SEQ ID NO: 34379 - protein, 7 aa, Artificial Sequence
  Synthetic construct
WLILQCY

SEQ ID NO: 34380 - protein, 7 aa, Artificial Sequence
  Synthetic construct
WLILQLF

SEQ ID NO: 34381 - protein, 7 aa, Artificial Sequence
  Synthetic construct
WLILQLY

SEQ ID NO: 34382 - protein, 7 aa, Artificial Sequence
  Synthetic construct
WLILQAF

SEQ ID NO: 34383 - protein, 7 aa, Artificial Sequence
  Synthetic construct
WLILQAY

SEQ ID NO: 34384 - protein, 7 aa, Artificial Sequence
  Synthetic construct
WLILQQF

SEQ ID NO: 34385 - protein, 7 aa, Artificial Sequence
  Synthetic construct
WLILQQY

SEQ ID NO: 34386 - protein, 7 aa, Artificial Sequence
  Synthetic construct
WLILQDF

SEQ ID NO: 34387 - protein, 7 aa, Artificial Sequence
  Synthetic construct
WLILQDY

SEQ ID NO: 34388 - protein, 7 aa, Artificial Sequence
  Synthetic construct
WLILQVF

SEQ ID NO: 34389 - protein, 7 aa, Artificial Sequence
  Synthetic construct
WLILQVY

SEQ ID NO: 34390 - protein, 7 aa, Artificial Sequence
  Synthetic construct
WLIFIFF

SEQ ID NO: 34391 - protein, 7 aa, Artificial Sequence
  Synthetic construct
WLIFIFY

SEQ ID NO: 34392 - protein, 7 aa, Artificial Sequence
  Synthetic construct
WLIFIRF

SEQ ID NO: 34393 - protein, 7 aa, Artificial Sequence
  Synthetic construct
WLIFIRY

SEQ ID NO: 34394 - protein, 7 aa, Artificial Sequence
  Synthetic construct
WLIFICF

SEQ ID NO: 34395 - protein, 7 aa, Artificial Sequence
  Synthetic construct
WLIFICY

SEQ ID NO: 34396 - protein, 7 aa, Artificial Sequence
  Synthetic construct
WLIFILF

SEQ ID NO: 34397 - protein, 7 aa, Artificial Sequence
  Synthetic construct
WLIFILY

SEQ ID NO: 34398 - protein, 7 aa, Artificial Sequence
  Synthetic construct
WLIFIAF

SEQ ID NO: 34399 - protein, 7 aa, Artificial Sequence
  Synthetic construct
WLIFIAY

SEQ ID NO: 34400 - protein, 7 aa, Artificial Sequence
  Synthetic construct
WLIFIQF

SEQ ID NO: 34401 - protein, 7 aa, Artificial Sequence
  Synthetic construct
WLIFIQY

SEQ ID NO: 34402 - protein, 7 aa, Artificial Sequence
  Synthetic construct
WLIFIDF

SEQ ID NO: 34403 - protein, 7 aa, Artificial Sequence
  Synthetic construct
WLIFIDY

SEQ ID NO: 34404 - protein, 7 aa, Artificial Sequence
  Synthetic construct
WLIFIVF

SEQ ID NO: 34405 - protein, 7 aa, Artificial Sequence
  Synthetic construct
WLIFIVY

SEQ ID NO: 34406 - protein, 7 aa, Artificial Sequence
  Synthetic construct
WLIFDFF

SEQ ID NO: 34407 - protein, 7 aa, Artificial Sequence
  Synthetic construct
WLIFDFY

SEQ ID NO: 34408 - protein, 7 aa, Artificial Sequence
  Synthetic construct
WLIFDRF

SEQ ID NO: 34409 - protein, 7 aa, Artificial Sequence
  Synthetic construct
WLIFDRY

SEQ ID NO: 34410 - protein, 7 aa, Artificial Sequence
  Synthetic construct
WLIFDCF

SEQ ID NO: 34411 - protein, 7 aa, Artificial Sequence
  Synthetic construct
WLIFDCY

SEQ ID NO: 34412 - protein, 7 aa, Artificial Sequence
  Synthetic construct
WLIFDLF

SEQ ID NO: 34413 - protein, 7 aa, Artificial Sequence
  Synthetic construct
WLIFDLY

SEQ ID NO: 34414 - protein, 7 aa, Artificial Sequence
  Synthetic construct
WLIFDAF

SEQ ID NO: 34415 - protein, 7 aa, Artificial Sequence
  Synthetic construct
WLIFDAY

SEQ ID NO: 34416 - protein, 7 aa, Artificial Sequence
  Synthetic construct
WLIFDQF

SEQ ID NO: 34417 - protein, 7 aa, Artificial Sequence
  Synthetic construct
WLIFDQY

SEQ ID NO: 34418 - protein, 7 aa, Artificial Sequence
  Synthetic construct
WLIFDDF

SEQ ID NO: 34419 - protein, 7 aa, Artificial Sequence
  Synthetic construct
WLIFDDY

SEQ ID NO: 34420 - protein, 7 aa, Artificial Sequence
  Synthetic construct
WLIFDVF

SEQ ID NO: 34421 - protein, 7 aa, Artificial Sequence
  Synthetic construct
WLIFDVY

SEQ ID NO: 34422 - protein, 7 aa, Artificial Sequence
  Synthetic construct
WLIFYFF

SEQ ID NO: 34423 - protein, 7 aa, Artificial Sequence
  Synthetic construct
WLIFYFY

SEQ ID NO: 34424 - protein, 7 aa, Artificial Sequence
  Synthetic construct
WLIFYRF

SEQ ID NO: 34425 - protein, 7 aa, Artificial Sequence
  Synthetic construct
WLIFYRY

SEQ ID NO: 34426 - protein, 7 aa, Artificial Sequence
  Synthetic construct
WLIFYCF

SEQ ID NO: 34427 - protein, 7 aa, Artificial Sequence
  Synthetic construct
WLIFYCY

SEQ ID NO: 34428 - protein, 7 aa, Artificial Sequence
  Synthetic construct
WLIFYLF

SEQ ID NO: 34429 - protein, 7 aa, Artificial Sequence
  Synthetic construct
WLIFYLY

SEQ ID NO: 34430 - protein, 7 aa, Artificial Sequence
  Synthetic construct
WLIFYAF

SEQ ID NO: 34431 - protein, 7 aa, Artificial Sequence
  Synthetic construct
WLIFYAY

SEQ ID NO: 34432 - protein, 7 aa, Artificial Sequence
  Synthetic construct
WLIFYQF

SEQ ID NO: 34433 - protein, 7 aa, Artificial Sequence
  Synthetic construct
WLIFYQY

SEQ ID NO: 34434 - protein, 7 aa, Artificial Sequence
  Synthetic construct
WLIFYDF

SEQ ID NO: 34435 - protein, 7 aa, Artificial Sequence
  Synthetic construct
WLIFYDY

SEQ ID NO: 34436 - protein, 7 aa, Artificial Sequence
  Synthetic construct
WLIFYVF

SEQ ID NO: 34437 - protein, 7 aa, Artificial Sequence
  Synthetic construct
WLIFYVY

SEQ ID NO: 34438 - protein, 7 aa, Artificial Sequence
  Synthetic construct
WLIFFFF

SEQ ID NO: 34439 - protein, 7 aa, Artificial Sequence
  Synthetic construct
WLIFFFY

SEQ ID NO: 34440 - protein, 7 aa, Artificial Sequence
  Synthetic construct
WLIFFRF

SEQ ID NO: 34441 - protein, 7 aa, Artificial Sequence
  Synthetic construct
WLIFFRY

SEQ ID NO: 34442 - protein, 7 aa, Artificial Sequence
  Synthetic construct
WLIFFCF

SEQ ID NO: 34443 - protein, 7 aa, Artificial Sequence
  Synthetic construct
WLIFFCY

SEQ ID NO: 34444 - protein, 7 aa, Artificial Sequence
  Synthetic construct
WLIFFLF

SEQ ID NO: 34445 - protein, 7 aa, Artificial Sequence
  Synthetic construct
WLIFFLY

SEQ ID NO: 34446 - protein, 7 aa, Artificial Sequence
  Synthetic construct
WLIFFAF

SEQ ID NO: 34447 - protein, 7 aa, Artificial Sequence
  Synthetic construct
WLIFFAY

SEQ ID NO: 34448 - protein, 7 aa, Artificial Sequence
  Synthetic construct
WLIFFQF

SEQ ID NO: 34449 - protein, 7 aa, Artificial Sequence
  Synthetic construct
WLIFFQY

SEQ ID NO: 34450 - protein, 7 aa, Artificial Sequence
  Synthetic construct
WLIFFDF

SEQ ID NO: 34451 - protein, 7 aa, Artificial Sequence
  Synthetic construct
WLIFFDY

SEQ ID NO: 34452 - protein, 7 aa, Artificial Sequence
  Synthetic construct
WLIFFVF

SEQ ID NO: 34453 - protein, 7 aa, Artificial Sequence
  Synthetic construct
WLIFFVY

SEQ ID NO: 34454 - protein, 7 aa, Artificial Sequence
  Synthetic construct
WLIFVFF

SEQ ID NO: 34455 - protein, 7 aa, Artificial Sequence
  Synthetic construct
WLIFVFY

SEQ ID NO: 34456 - protein, 7 aa, Artificial Sequence
  Synthetic construct
WLIFVRF

SEQ ID NO: 34457 - protein, 7 aa, Artificial Sequence
  Synthetic construct
WLIFVRY

SEQ ID NO: 34458 - protein, 7 aa, Artificial Sequence
  Synthetic construct
WLIFVCF

SEQ ID NO: 34459 - protein, 7 aa, Artificial Sequence
  Synthetic construct
WLIFVCY

SEQ ID NO: 34460 - protein, 7 aa, Artificial Sequence
  Synthetic construct
WLIFVLF

SEQ ID NO: 34461 - protein, 7 aa, Artificial Sequence
  Synthetic construct
WLIFVLY

SEQ ID NO: 34462 - protein, 7 aa, Artificial Sequence
  Synthetic construct
WLIFVAF

SEQ ID NO: 34463 - protein, 7 aa, Artificial Sequence
  Synthetic construct
WLIFVAY

SEQ ID NO: 34464 - protein, 7 aa, Artificial Sequence
  Synthetic construct
WLIFVQF

SEQ ID NO: 34465 - protein, 7 aa, Artificial Sequence
  Synthetic construct
WLIFVQY

SEQ ID NO: 34466 - protein, 7 aa, Artificial Sequence
  Synthetic construct
WLIFVDF

SEQ ID NO: 34467 - protein, 7 aa, Artificial Sequence
  Synthetic construct
WLIFVDY

SEQ ID NO: 34468 - protein, 7 aa, Artificial Sequence
  Synthetic construct
WLIFVVF

SEQ ID NO: 34469 - protein, 7 aa, Artificial Sequence
  Synthetic construct
WLIFVVY

SEQ ID NO: 34470 - protein, 7 aa, Artificial Sequence
  Synthetic construct
WLIFTFF

SEQ ID NO: 34471 - protein, 7 aa, Artificial Sequence
  Synthetic construct
WLIFTFY

SEQ ID NO: 34472 - protein, 7 aa, Artificial Sequence
  Synthetic construct
WLIFTRF

SEQ ID NO: 34473 - protein, 7 aa, Artificial Sequence
  Synthetic construct
WLIFTRY

SEQ ID NO: 34474 - protein, 7 aa, Artificial Sequence
  Synthetic construct
WLIFTCF

SEQ ID NO: 34475 - protein, 7 aa, Artificial Sequence
  Synthetic construct
WLIFTCY

SEQ ID NO: 34476 - protein, 7 aa, Artificial Sequence
  Synthetic construct
WLIFTLF

SEQ ID NO: 34477 - protein, 7 aa, Artificial Sequence
  Synthetic construct
WLIFTLY

SEQ ID NO: 34478 - protein, 7 aa, Artificial Sequence
  Synthetic construct
WLIFTAF

SEQ ID NO: 34479 - protein, 7 aa, Artificial Sequence
  Synthetic construct
WLIFTAY

SEQ ID NO: 34480 - protein, 7 aa, Artificial Sequence
  Synthetic construct
WLIFTQF

SEQ ID NO: 34481 - protein, 7 aa, Artificial Sequence
  Synthetic construct
WLIFTQY

SEQ ID NO: 34482 - protein, 7 aa, Artificial Sequence
  Synthetic construct
WLIFTDF

SEQ ID NO: 34483 - protein, 7 aa, Artificial Sequence
  Synthetic construct
WLIFTDY

SEQ ID NO: 34484 - protein, 7 aa, Artificial Sequence
  Synthetic construct
WLIFTVF

SEQ ID NO: 34485 - protein, 7 aa, Artificial Sequence
  Synthetic construct
WLIFTVY

SEQ ID NO: 34486 - protein, 7 aa, Artificial Sequence
  Synthetic construct
WLIFGFF

SEQ ID NO: 34487 - protein, 7 aa, Artificial Sequence
  Synthetic construct
WLIFGFY

SEQ ID NO: 34488 - protein, 7 aa, Artificial Sequence
  Synthetic construct
WLIFGRF

SEQ ID NO: 34489 - protein, 7 aa, Artificial Sequence
  Synthetic construct
WLIFGRY

SEQ ID NO: 34490 - protein, 7 aa, Artificial Sequence
  Synthetic construct
WLIFGCF

SEQ ID NO: 34491 - protein, 7 aa, Artificial Sequence
  Synthetic construct
WLIFGCY

SEQ ID NO: 34492 - protein, 7 aa, Artificial Sequence
  Synthetic construct
WLIFGLF

SEQ ID NO: 34493 - protein, 7 aa, Artificial Sequence
  Synthetic construct
WLIFGLY

SEQ ID NO: 34494 - protein, 7 aa, Artificial Sequence
  Synthetic construct
WLIFGAF

SEQ ID NO: 34495 - protein, 7 aa, Artificial Sequence
  Synthetic construct
WLIFGAY

SEQ ID NO: 34496 - protein, 7 aa, Artificial Sequence
  Synthetic construct
WLIFGQF

SEQ ID NO: 34497 - protein, 7 aa, Artificial Sequence
  Synthetic construct
WLIFGQY

SEQ ID NO: 34498 - protein, 7 aa, Artificial Sequence
  Synthetic construct
WLIFGDF

SEQ ID NO: 34499 - protein, 7 aa, Artificial Sequence
  Synthetic construct
WLIFGDY

SEQ ID NO: 34500 - protein, 7 aa, Artificial Sequence
  Synthetic construct
WLIFGVF

SEQ ID NO: 34501 - protein, 7 aa, Artificial Sequence
  Synthetic construct
WLIFGVY

SEQ ID NO: 34502 - protein, 7 aa, Artificial Sequence
  Synthetic construct
WLIFAFF

SEQ ID NO: 34503 - protein, 7 aa, Artificial Sequence
  Synthetic construct
WLIFAFY

SEQ ID NO: 34504 - protein, 7 aa, Artificial Sequence
  Synthetic construct
WLIFARF

SEQ ID NO: 34505 - protein, 7 aa, Artificial Sequence
  Synthetic construct
WLIFARY

SEQ ID NO: 34506 - protein, 7 aa, Artificial Sequence
  Synthetic construct
WLIFACF

SEQ ID NO: 34507 - protein, 7 aa, Artificial Sequence
  Synthetic construct
WLIFACY

SEQ ID NO: 34508 - protein, 7 aa, Artificial Sequence
  Synthetic construct
WLIFALF

SEQ ID NO: 34509 - protein, 7 aa, Artificial Sequence
  Synthetic construct
WLIFALY

SEQ ID NO: 34510 - protein, 7 aa, Artificial Sequence
  Synthetic construct
WLIFAAF

SEQ ID NO: 34511 - protein, 7 aa, Artificial Sequence
  Synthetic construct
WLIFAAY

SEQ ID NO: 34512 - protein, 7 aa, Artificial Sequence
  Synthetic construct
WLIFAQF

SEQ ID NO: 34513 - protein, 7 aa, Artificial Sequence
  Synthetic construct
WLIFAQY

SEQ ID NO: 34514 - protein, 7 aa, Artificial Sequence
  Synthetic construct
WLIFADF

SEQ ID NO: 34515 - protein, 7 aa, Artificial Sequence
  Synthetic construct
WLIFADY

SEQ ID NO: 34516 - protein, 7 aa, Artificial Sequence
  Synthetic construct
WLIFAVF

SEQ ID NO: 34517 - protein, 7 aa, Artificial Sequence
  Synthetic construct
WLIFAVY

SEQ ID NO: 34518 - protein, 7 aa, Artificial Sequence
  Synthetic construct
WLIFQFF

SEQ ID NO: 34519 - protein, 7 aa, Artificial Sequence
  Synthetic construct
WLIFQFY

SEQ ID NO: 34520 - protein, 7 aa, Artificial Sequence
  Synthetic construct
WLIFQRF

SEQ ID NO: 34521 - protein, 7 aa, Artificial Sequence
  Synthetic construct
WLIFQRY

SEQ ID NO: 34522 - protein, 7 aa, Artificial Sequence
  Synthetic construct
WLIFQCF

SEQ ID NO: 34523 - protein, 7 aa, Artificial Sequence
  Synthetic construct
WLIFQCY

SEQ ID NO: 34524 - protein, 7 aa, Artificial Sequence
  Synthetic construct
WLIFQLF

SEQ ID NO: 34525 - protein, 7 aa, Artificial Sequence
  Synthetic construct
WLIFQLY

SEQ ID NO: 34526 - protein, 7 aa, Artificial Sequence
  Synthetic construct
WLIFQAF

SEQ ID NO: 34527 - protein, 7 aa, Artificial Sequence
  Synthetic construct
WLIFQAY

SEQ ID NO: 34528 - protein, 7 aa, Artificial Sequence
  Synthetic construct
WLIFQQF

SEQ ID NO: 34529 - protein, 7 aa, Artificial Sequence
  Synthetic construct
WLIFQQY

SEQ ID NO: 34530 - protein, 7 aa, Artificial Sequence
  Synthetic construct
WLIFQDF

SEQ ID NO: 34531 - protein, 7 aa, Artificial Sequence
  Synthetic construct
WLIFQDY

SEQ ID NO: 34532 - protein, 7 aa, Artificial Sequence
  Synthetic construct
WLIFQVF

SEQ ID NO: 34533 - protein, 7 aa, Artificial Sequence
  Synthetic construct
WLIFQVY

SEQ ID NO: 34534 - protein, 7 aa, Artificial Sequence
  Synthetic construct
WLGYIFF

SEQ ID NO: 34535 - protein, 7 aa, Artificial Sequence
  Synthetic construct
WLGYIFY

SEQ ID NO: 34536 - protein, 7 aa, Artificial Sequence
  Synthetic construct
WLGYIRF

SEQ ID NO: 34537 - protein, 7 aa, Artificial Sequence
  Synthetic construct
WLGYIRY

SEQ ID NO: 34538 - protein, 7 aa, Artificial Sequence
  Synthetic construct
WLGYICF

SEQ ID NO: 34539 - protein, 7 aa, Artificial Sequence
  Synthetic construct
WLGYICY

SEQ ID NO: 34540 - protein, 7 aa, Artificial Sequence
  Synthetic construct
WLGYILF

SEQ ID NO: 34541 - protein, 7 aa, Artificial Sequence
  Synthetic construct
WLGYILY

SEQ ID NO: 34542 - protein, 7 aa, Artificial Sequence
  Synthetic construct
WLGYIAF

SEQ ID NO: 34543 - protein, 7 aa, Artificial Sequence
  Synthetic construct
WLGYIAY

SEQ ID NO: 34544 - protein, 7 aa, Artificial Sequence
  Synthetic construct
WLGYIQF

SEQ ID NO: 34545 - protein, 7 aa, Artificial Sequence
  Synthetic construct
WLGYIQY

SEQ ID NO: 34546 - protein, 7 aa, Artificial Sequence
  Synthetic construct
WLGYIDF

SEQ ID NO: 34547 - protein, 7 aa, Artificial Sequence
  Synthetic construct
WLGYIDY

SEQ ID NO: 34548 - protein, 7 aa, Artificial Sequence
  Synthetic construct
WLGYIVF

SEQ ID NO: 34549 - protein, 7 aa, Artificial Sequence
  Synthetic construct
WLGYIVY

SEQ ID NO: 34550 - protein, 7 aa, Artificial Sequence
  Synthetic construct
WLGYDFF

SEQ ID NO: 34551 - protein, 7 aa, Artificial Sequence
  Synthetic construct
WLGYDFY

SEQ ID NO: 34552 - protein, 7 aa, Artificial Sequence
  Synthetic construct
WLGYDRF

SEQ ID NO: 34553 - protein, 7 aa, Artificial Sequence
  Synthetic construct
WLGYDRY

SEQ ID NO: 34554 - protein, 7 aa, Artificial Sequence
  Synthetic construct
WLGYDCF

SEQ ID NO: 34555 - protein, 7 aa, Artificial Sequence
  Synthetic construct
WLGYDCY

SEQ ID NO: 34556 - protein, 7 aa, Artificial Sequence
  Synthetic construct
WLGYDLF

SEQ ID NO: 34557 - protein, 7 aa, Artificial Sequence
  Synthetic construct
WLGYDLY

SEQ ID NO: 34558 - protein, 7 aa, Artificial Sequence
  Synthetic construct
WLGYDAF

SEQ ID NO: 34559 - protein, 7 aa, Artificial Sequence
  Synthetic construct
WLGYDAY

SEQ ID NO: 34560 - protein, 7 aa, Artificial Sequence
  Synthetic construct
WLGYDQF

SEQ ID NO: 34561 - protein, 7 aa, Artificial Sequence
  Synthetic construct
WLGYDQY

SEQ ID NO: 34562 - protein, 7 aa, Artificial Sequence
  Synthetic construct
WLGYDDF

SEQ ID NO: 34563 - protein, 7 aa, Artificial Sequence
  Synthetic construct
WLGYDDY

SEQ ID NO: 34564 - protein, 7 aa, Artificial Sequence
  Synthetic construct
WLGYDVF

SEQ ID NO: 34565 - protein, 7 aa, Artificial Sequence
  Synthetic construct
WLGYDVY

SEQ ID NO: 34566 - protein, 7 aa, Artificial Sequence
  Synthetic construct
WLGYYFF

SEQ ID NO: 34567 - protein, 7 aa, Artificial Sequence
  Synthetic construct
WLGYYFY

SEQ ID NO: 34568 - protein, 7 aa, Artificial Sequence
  Synthetic construct
WLGYYRF

SEQ ID NO: 34569 - protein, 7 aa, Artificial Sequence
  Synthetic construct
WLGYYRY

SEQ ID NO: 34570 - protein, 7 aa, Artificial Sequence
  Synthetic construct
WLGYYCF

SEQ ID NO: 34571 - protein, 7 aa, Artificial Sequence
  Synthetic construct
WLGYYCY

SEQ ID NO: 34572 - protein, 7 aa, Artificial Sequence
  Synthetic construct
WLGYYLF

SEQ ID NO: 34573 - protein, 7 aa, Artificial Sequence
  Synthetic construct
WLGYYLY

SEQ ID NO: 34574 - protein, 7 aa, Artificial Sequence
  Synthetic construct
WLGYYAF

SEQ ID NO: 34575 - protein, 7 aa, Artificial Sequence
  Synthetic construct
WLGYYAY

SEQ ID NO: 34576 - protein, 7 aa, Artificial Sequence
  Synthetic construct
WLGYYQF

SEQ ID NO: 34577 - protein, 7 aa, Artificial Sequence
  Synthetic construct
WLGYYQY

SEQ ID NO: 34578 - protein, 7 aa, Artificial Sequence
  Synthetic construct
WLGYYDF

SEQ ID NO: 34579 - protein, 7 aa, Artificial Sequence
  Synthetic construct
WLGYYDY

SEQ ID NO: 34580 - protein, 7 aa, Artificial Sequence
  Synthetic construct
WLGYYVF

SEQ ID NO: 34581 - protein, 7 aa, Artificial Sequence
  Synthetic construct
WLGYYVY

SEQ ID NO: 34582 - protein, 7 aa, Artificial Sequence
  Synthetic construct
WLGYFFF

SEQ ID NO: 34583 - protein, 7 aa, Artificial Sequence
  Synthetic construct
WLGYFFY

SEQ ID NO: 34584 - protein, 7 aa, Artificial Sequence
  Synthetic construct
WLGYFRF

SEQ ID NO: 34585 - protein, 7 aa, Artificial Sequence
  Synthetic construct
WLGYFRY

SEQ ID NO: 34586 - protein, 7 aa, Artificial Sequence
  Synthetic construct
WLGYFCF

SEQ ID NO: 34587 - protein, 7 aa, Artificial Sequence
  Synthetic construct
WLGYFCY

SEQ ID NO: 34588 - protein, 7 aa, Artificial Sequence
  Synthetic construct
WLGYFLF

SEQ ID NO: 34589 - protein, 7 aa, Artificial Sequence
  Synthetic construct
WLGYFLY

SEQ ID NO: 34590 - protein, 7 aa, Artificial Sequence
  Synthetic construct
WLGYFAF

SEQ ID NO: 34591 - protein, 7 aa, Artificial Sequence
  Synthetic construct
WLGYFAY

SEQ ID NO: 34592 - protein, 7 aa, Artificial Sequence
  Synthetic construct
WLGYFQF

SEQ ID NO: 34593 - protein, 7 aa, Artificial Sequence
  Synthetic construct
WLGYFQY

SEQ ID NO: 34594 - protein, 7 aa, Artificial Sequence
  Synthetic construct
WLGYFDF

SEQ ID NO: 34595 - protein, 7 aa, Artificial Sequence
  Synthetic construct
WLGYFDY

SEQ ID NO: 34596 - protein, 7 aa, Artificial Sequence
  Synthetic construct
WLGYFVF

SEQ ID NO: 34597 - protein, 7 aa, Artificial Sequence
  Synthetic construct
WLGYFVY

SEQ ID NO: 34598 - protein, 7 aa, Artificial Sequence
  Synthetic construct
WLGYVFF

SEQ ID NO: 34599 - protein, 7 aa, Artificial Sequence
  Synthetic construct
WLGYVFY

SEQ ID NO: 34600 - protein, 7 aa, Artificial Sequence
  Synthetic construct
WLGYVRF

SEQ ID NO: 34601 - protein, 7 aa, Artificial Sequence
  Synthetic construct
WLGYVRY

SEQ ID NO: 34602 - protein, 7 aa, Artificial Sequence
  Synthetic construct
WLGYVCF

SEQ ID NO: 34603 - protein, 7 aa, Artificial Sequence
  Synthetic construct
WLGYVCY

SEQ ID NO: 34604 - protein, 7 aa, Artificial Sequence
  Synthetic construct
WLGYVLF

SEQ ID NO: 34605 - protein, 7 aa, Artificial Sequence
  Synthetic construct
WLGYVLY

SEQ ID NO: 34606 - protein, 7 aa, Artificial Sequence
  Synthetic construct
WLGYVAF

SEQ ID NO: 34607 - protein, 7 aa, Artificial Sequence
  Synthetic construct
WLGYVAY

SEQ ID NO: 34608 - protein, 7 aa, Artificial Sequence
  Synthetic construct
WLGYVQF

SEQ ID NO: 34609 - protein, 7 aa, Artificial Sequence
  Synthetic construct
WLGYVQY

SEQ ID NO: 34610 - protein, 7 aa, Artificial Sequence
  Synthetic construct
WLGYVDF

SEQ ID NO: 34611 - protein, 7 aa, Artificial Sequence
  Synthetic construct
WLGYVDY

SEQ ID NO: 34612 - protein, 7 aa, Artificial Sequence
  Synthetic construct
WLGYVVF

SEQ ID NO: 34613 - protein, 7 aa, Artificial Sequence
  Synthetic construct
WLGYVVY

SEQ ID NO: 34614 - protein, 7 aa, Artificial Sequence
  Synthetic construct
WLGYTFF

SEQ ID NO: 34615 - protein, 7 aa, Artificial Sequence
  Synthetic construct
WLGYTFY

SEQ ID NO: 34616 - protein, 7 aa, Artificial Sequence
  Synthetic construct
WLGYTRF

SEQ ID NO: 34617 - protein, 7 aa, Artificial Sequence
  Synthetic construct
WLGYTRY

SEQ ID NO: 34618 - protein, 7 aa, Artificial Sequence
  Synthetic construct
WLGYTCF

SEQ ID NO: 34619 - protein, 7 aa, Artificial Sequence
  Synthetic construct
WLGYTCY

SEQ ID NO: 34620 - protein, 7 aa, Artificial Sequence
  Synthetic construct
WLGYTLF

SEQ ID NO: 34621 - protein, 7 aa, Artificial Sequence
  Synthetic construct
WLGYTLY

SEQ ID NO: 34622 - protein, 7 aa, Artificial Sequence
  Synthetic construct
WLGYTAF

SEQ ID NO: 34623 - protein, 7 aa, Artificial Sequence
  Synthetic construct
WLGYTAY

SEQ ID NO: 34624 - protein, 7 aa, Artificial Sequence
  Synthetic construct
WLGYTQF

SEQ ID NO: 34625 - protein, 7 aa, Artificial Sequence
  Synthetic construct
WLGYTQY

SEQ ID NO: 34626 - protein, 7 aa, Artificial Sequence
  Synthetic construct
WLGYTDF

SEQ ID NO: 34627 - protein, 7 aa, Artificial Sequence
  Synthetic construct
WLGYTDY

SEQ ID NO: 34628 - protein, 7 aa, Artificial Sequence
  Synthetic construct
WLGYTVF

SEQ ID NO: 34629 - protein, 7 aa, Artificial Sequence
  Synthetic construct
WLGYTVY

SEQ ID NO: 34630 - protein, 7 aa, Artificial Sequence
  Synthetic construct
WLGYGFF

SEQ ID NO: 34631 - protein, 7 aa, Artificial Sequence
  Synthetic construct
WLGYGFY

SEQ ID NO: 34632 - protein, 7 aa, Artificial Sequence
  Synthetic construct
WLGYGRF

SEQ ID NO: 34633 - protein, 7 aa, Artificial Sequence
  Synthetic construct
WLGYGRY

SEQ ID NO: 34634 - protein, 7 aa, Artificial Sequence
  Synthetic construct
WLGYGCF

SEQ ID NO: 34635 - protein, 7 aa, Artificial Sequence
  Synthetic construct
WLGYGCY

SEQ ID NO: 34636 - protein, 7 aa, Artificial Sequence
  Synthetic construct
WLGYGLF

SEQ ID NO: 34637 - protein, 7 aa, Artificial Sequence
  Synthetic construct
WLGYGLY

SEQ ID NO: 34638 - protein, 7 aa, Artificial Sequence
  Synthetic construct
WLGYGAF

SEQ ID NO: 34639 - protein, 7 aa, Artificial Sequence
  Synthetic construct
WLGYGAY

SEQ ID NO: 34640 - protein, 7 aa, Artificial Sequence
  Synthetic construct
WLGYGQF

SEQ ID NO: 34641 - protein, 7 aa, Artificial Sequence
  Synthetic construct
WLGYGQY

SEQ ID NO: 34642 - protein, 7 aa, Artificial Sequence
  Synthetic construct
WLGYGDF

SEQ ID NO: 34643 - protein, 7 aa, Artificial Sequence
  Synthetic construct
WLGYGDY

SEQ ID NO: 34644 - protein, 7 aa, Artificial Sequence
  Synthetic construct
WLGYGVF

SEQ ID NO: 34645 - protein, 7 aa, Artificial Sequence
  Synthetic construct
WLGYGVY

SEQ ID NO: 34646 - protein, 7 aa, Artificial Sequence
  Synthetic construct
WLGYAFF

SEQ ID NO: 34647 - protein, 7 aa, Artificial Sequence
  Synthetic construct
WLGYAFY

SEQ ID NO: 34648 - protein, 7 aa, Artificial Sequence
  Synthetic construct
WLGYARF

SEQ ID NO: 34649 - protein, 7 aa, Artificial Sequence
  Synthetic construct
WLGYARY

SEQ ID NO: 34650 - protein, 7 aa, Artificial Sequence
  Synthetic construct
WLGYACF

SEQ ID NO: 34651 - protein, 7 aa, Artificial Sequence
  Synthetic construct
WLGYACY

SEQ ID NO: 34652 - protein, 7 aa, Artificial Sequence
  Synthetic construct
WLGYALF

SEQ ID NO: 34653 - protein, 7 aa, Artificial Sequence
  Synthetic construct
WLGYALY

SEQ ID NO: 34654 - protein, 7 aa, Artificial Sequence
  Synthetic construct
WLGYAAF

SEQ ID NO: 34655 - protein, 7 aa, Artificial Sequence
  Synthetic construct
WLGYAAY

SEQ ID NO: 34656 - protein, 7 aa, Artificial Sequence
  Synthetic construct
WLGYAQF

SEQ ID NO: 34657 - protein, 7 aa, Artificial Sequence
  Synthetic construct
WLGYAQY

SEQ ID NO: 34658 - protein, 7 aa, Artificial Sequence
  Synthetic construct
WLGYADF

SEQ ID NO: 34659 - protein, 7 aa, Artificial Sequence
  Synthetic construct
WLGYADY

SEQ ID NO: 34660 - protein, 7 aa, Artificial Sequence
  Synthetic construct
WLGYAVF

SEQ ID NO: 34661 - protein, 7 aa, Artificial Sequence
  Synthetic construct
WLGYAVY

SEQ ID NO: 34662 - protein, 7 aa, Artificial Sequence
  Synthetic construct
WLGYQFF

SEQ ID NO: 34663 - protein, 7 aa, Artificial Sequence
  Synthetic construct
WLGYQFY

SEQ ID NO: 34664 - protein, 7 aa, Artificial Sequence
  Synthetic construct
WLGYQRF

SEQ ID NO: 34665 - protein, 7 aa, Artificial Sequence
  Synthetic construct
WLGYQRY

SEQ ID NO: 34666 - protein, 7 aa, Artificial Sequence
  Synthetic construct
WLGYQCF

SEQ ID NO: 34667 - protein, 7 aa, Artificial Sequence
  Synthetic construct
WLGYQCY

SEQ ID NO: 34668 - protein, 7 aa, Artificial Sequence
  Synthetic construct
WLGYQLF

SEQ ID NO: 34669 - protein, 7 aa, Artificial Sequence
  Synthetic construct
WLGYQLY

SEQ ID NO: 34670 - protein, 7 aa, Artificial Sequence
  Synthetic construct
WLGYQAF

SEQ ID NO: 34671 - protein, 7 aa, Artificial Sequence
  Synthetic construct
WLGYQAY

SEQ ID NO: 34672 - protein, 7 aa, Artificial Sequence
  Synthetic construct
WLGYQQF

SEQ ID NO: 34673 - protein, 7 aa, Artificial Sequence
  Synthetic construct
WLGYQQY

SEQ ID NO: 34674 - protein, 7 aa, Artificial Sequence
  Synthetic construct
WLGYQDF

SEQ ID NO: 34675 - protein, 7 aa, Artificial Sequence
  Synthetic construct
WLGYQDY

SEQ ID NO: 34676 - protein, 7 aa, Artificial Sequence
  Synthetic construct
WLGYQVF

SEQ ID NO: 34677 - protein, 7 aa, Artificial Sequence
  Synthetic construct
WLGYQVY

SEQ ID NO: 34678 - protein, 7 aa, Artificial Sequence
  Synthetic construct
WLGPIFF

SEQ ID NO: 34679 - protein, 7 aa, Artificial Sequence
  Synthetic construct
WLGPIFY

SEQ ID NO: 34680 - protein, 7 aa, Artificial Sequence
  Synthetic construct
WLGPIRF

SEQ ID NO: 34681 - protein, 7 aa, Artificial Sequence
  Synthetic construct
WLGPIRY

SEQ ID NO: 34682 - protein, 7 aa, Artificial Sequence
  Synthetic construct
WLGPICF

SEQ ID NO: 34683 - protein, 7 aa, Artificial Sequence
  Synthetic construct
WLGPICY

SEQ ID NO: 34684 - protein, 7 aa, Artificial Sequence
  Synthetic construct
WLGPILF

SEQ ID NO: 34685 - protein, 7 aa, Artificial Sequence
  Synthetic construct
WLGPILY

SEQ ID NO: 34686 - protein, 7 aa, Artificial Sequence
  Synthetic construct
WLGPIAF

SEQ ID NO: 34687 - protein, 7 aa, Artificial Sequence
  Synthetic construct
WLGPIAY

SEQ ID NO: 34688 - protein, 7 aa, Artificial Sequence
  Synthetic construct
WLGPIQF

SEQ ID NO: 34689 - protein, 7 aa, Artificial Sequence
  Synthetic construct
WLGPIQY

SEQ ID NO: 34690 - protein, 7 aa, Artificial Sequence
  Synthetic construct
WLGPIDF

SEQ ID NO: 34691 - protein, 7 aa, Artificial Sequence
  Synthetic construct
WLGPIDY

SEQ ID NO: 34692 - protein, 7 aa, Artificial Sequence
  Synthetic construct
WLGPIVF

SEQ ID NO: 34693 - protein, 7 aa, Artificial Sequence
  Synthetic construct
WLGPIVY

SEQ ID NO: 34694 - protein, 7 aa, Artificial Sequence
  Synthetic construct
WLGPDFF

SEQ ID NO: 34695 - protein, 7 aa, Artificial Sequence
  Synthetic construct
WLGPDFY

SEQ ID NO: 34696 - protein, 7 aa, Artificial Sequence
  Synthetic construct
WLGPDRF

SEQ ID NO: 34697 - protein, 7 aa, Artificial Sequence
  Synthetic construct
WLGPDRY

SEQ ID NO: 34698 - protein, 7 aa, Artificial Sequence
  Synthetic construct
WLGPDCF

SEQ ID NO: 34699 - protein, 7 aa, Artificial Sequence
  Synthetic construct
WLGPDCY

SEQ ID NO: 34700 - protein, 7 aa, Artificial Sequence
  Synthetic construct
WLGPDLF

SEQ ID NO: 34701 - protein, 7 aa, Artificial Sequence
  Synthetic construct
WLGPDLY

SEQ ID NO: 34702 - protein, 7 aa, Artificial Sequence
  Synthetic construct
WLGPDAF

SEQ ID NO: 34703 - protein, 7 aa, Artificial Sequence
  Synthetic construct
WLGPDAY

SEQ ID NO: 34704 - protein, 7 aa, Artificial Sequence
  Synthetic construct
WLGPDQF

SEQ ID NO: 34705 - protein, 7 aa, Artificial Sequence
  Synthetic construct
WLGPDQY

SEQ ID NO: 34706 - protein, 7 aa, Artificial Sequence
  Synthetic construct
WLGPDDF

SEQ ID NO: 34707 - protein, 7 aa, Artificial Sequence
  Synthetic construct
WLGPDDY

SEQ ID NO: 34708 - protein, 7 aa, Artificial Sequence
  Synthetic construct
WLGPDVF

SEQ ID NO: 34709 - protein, 7 aa, Artificial Sequence
  Synthetic construct
WLGPDVY

SEQ ID NO: 34710 - protein, 7 aa, Artificial Sequence
  Synthetic construct
WLGPYFF

SEQ ID NO: 34711 - protein, 7 aa, Artificial Sequence
  Synthetic construct
WLGPYFY

SEQ ID NO: 34712 - protein, 7 aa, Artificial Sequence
  Synthetic construct
WLGPYRF

SEQ ID NO: 34713 - protein, 7 aa, Artificial Sequence
  Synthetic construct
WLGPYRY

SEQ ID NO: 34714 - protein, 7 aa, Artificial Sequence
  Synthetic construct
WLGPYCF

SEQ ID NO: 34715 - protein, 7 aa, Artificial Sequence
  Synthetic construct
WLGPYCY

SEQ ID NO: 34716 - protein, 7 aa, Artificial Sequence
  Synthetic construct
WLGPYLF

SEQ ID NO: 34717 - protein, 7 aa, Artificial Sequence
  Synthetic construct
WLGPYLY

SEQ ID NO: 34718 - protein, 7 aa, Artificial Sequence
  Synthetic construct
WLGPYAF

SEQ ID NO: 34719 - protein, 7 aa, Artificial Sequence
  Synthetic construct
WLGPYAY

SEQ ID NO: 34720 - protein, 7 aa, Artificial Sequence
  Synthetic construct
WLGPYQF

SEQ ID NO: 34721 - protein, 7 aa, Artificial Sequence
  Synthetic construct
WLGPYQY

SEQ ID NO: 34722 - protein, 7 aa, Artificial Sequence
  Synthetic construct
WLGPYDF

SEQ ID NO: 34723 - protein, 7 aa, Artificial Sequence
  Synthetic construct
WLGPYDY

SEQ ID NO: 34724 - protein, 7 aa, Artificial Sequence
  Synthetic construct
WLGPYVF

SEQ ID NO: 34725 - protein, 7 aa, Artificial Sequence
  Synthetic construct
WLGPYVY

SEQ ID NO: 34726 - protein, 7 aa, Artificial Sequence
  Synthetic construct
WLGPFFF

SEQ ID NO: 34727 - protein, 7 aa, Artificial Sequence
  Synthetic construct
WLGPFFY

SEQ ID NO: 34728 - protein, 7 aa, Artificial Sequence
  Synthetic construct
WLGPFRF

SEQ ID NO: 34729 - protein, 7 aa, Artificial Sequence
  Synthetic construct
WLGPFRY

SEQ ID NO: 34730 - protein, 7 aa, Artificial Sequence
  Synthetic construct
WLGPFCF

SEQ ID NO: 34731 - protein, 7 aa, Artificial Sequence
  Synthetic construct
WLGPFCY

SEQ ID NO: 34732 - protein, 7 aa, Artificial Sequence
  Synthetic construct
WLGPFLF

SEQ ID NO: 34733 - protein, 7 aa, Artificial Sequence
  Synthetic construct
WLGPFLY

SEQ ID NO: 34734 - protein, 7 aa, Artificial Sequence
  Synthetic construct
WLGPFAF

SEQ ID NO: 34735 - protein, 7 aa, Artificial Sequence
  Synthetic construct
WLGPFAY

SEQ ID NO: 34736 - protein, 7 aa, Artificial Sequence
  Synthetic construct
WLGPFQF

SEQ ID NO: 34737 - protein, 7 aa, Artificial Sequence
  Synthetic construct
WLGPFQY

SEQ ID NO: 34738 - protein, 7 aa, Artificial Sequence
  Synthetic construct
WLGPFDF

SEQ ID NO: 34739 - protein, 7 aa, Artificial Sequence
  Synthetic construct
WLGPFDY

SEQ ID NO: 34740 - protein, 7 aa, Artificial Sequence
  Synthetic construct
WLGPFVF

SEQ ID NO: 34741 - protein, 7 aa, Artificial Sequence
  Synthetic construct
WLGPFVY

SEQ ID NO: 34742 - protein, 7 aa, Artificial Sequence
  Synthetic construct
WLGPVFF

SEQ ID NO: 34743 - protein, 7 aa, Artificial Sequence
  Synthetic construct
WLGPVFY

SEQ ID NO: 34744 - protein, 7 aa, Artificial Sequence
  Synthetic construct
WLGPVRF

SEQ ID NO: 34745 - protein, 7 aa, Artificial Sequence
  Synthetic construct
WLGPVRY

SEQ ID NO: 34746 - protein, 7 aa, Artificial Sequence
  Synthetic construct
WLGPVCF

SEQ ID NO: 34747 - protein, 7 aa, Artificial Sequence
  Synthetic construct
WLGPVCY

SEQ ID NO: 34748 - protein, 7 aa, Artificial Sequence
  Synthetic construct
WLGPVLF

SEQ ID NO: 34749 - protein, 7 aa, Artificial Sequence
  Synthetic construct
WLGPVLY

SEQ ID NO: 34750 - protein, 7 aa, Artificial Sequence
  Synthetic construct
WLGPVAF

SEQ ID NO: 34751 - protein, 7 aa, Artificial Sequence
  Synthetic construct
WLGPVAY

SEQ ID NO: 34752 - protein, 7 aa, Artificial Sequence
  Synthetic construct
WLGPVQF

SEQ ID NO: 34753 - protein, 7 aa, Artificial Sequence
  Synthetic construct
WLGPVQY

SEQ ID NO: 34754 - protein, 7 aa, Artificial Sequence
  Synthetic construct
WLGPVDF

SEQ ID NO: 34755 - protein, 7 aa, Artificial Sequence
  Synthetic construct
WLGPVDY

SEQ ID NO: 34756 - protein, 7 aa, Artificial Sequence
  Synthetic construct
WLGPVVF

SEQ ID NO: 34757 - protein, 7 aa, Artificial Sequence
  Synthetic construct
WLGPVVY

SEQ ID NO: 34758 - protein, 7 aa, Artificial Sequence
  Synthetic construct
WLGPTFF

SEQ ID NO: 34759 - protein, 7 aa, Artificial Sequence
  Synthetic construct
WLGPTFY

SEQ ID NO: 34760 - protein, 7 aa, Artificial Sequence
  Synthetic construct
WLGPTRF

SEQ ID NO: 34761 - protein, 7 aa, Artificial Sequence
  Synthetic construct
WLGPTRY

SEQ ID NO: 34762 - protein, 7 aa, Artificial Sequence
  Synthetic construct
WLGPTCF

SEQ ID NO: 34763 - protein, 7 aa, Artificial Sequence
  Synthetic construct
WLGPTCY

SEQ ID NO: 34764 - protein, 7 aa, Artificial Sequence
  Synthetic construct
WLGPTLF

SEQ ID NO: 34765 - protein, 7 aa, Artificial Sequence
  Synthetic construct
WLGPTLY

SEQ ID NO: 34766 - protein, 7 aa, Artificial Sequence
  Synthetic construct
WLGPTAF

SEQ ID NO: 34767 - protein, 7 aa, Artificial Sequence
  Synthetic construct
WLGPTAY

SEQ ID NO: 34768 - protein, 7 aa, Artificial Sequence
  Synthetic construct
WLGPTQF

SEQ ID NO: 34769 - protein, 7 aa, Artificial Sequence
  Synthetic construct
WLGPTQY

SEQ ID NO: 34770 - protein, 7 aa, Artificial Sequence
  Synthetic construct
WLGPTDF

SEQ ID NO: 34771 - protein, 7 aa, Artificial Sequence
  Synthetic construct
WLGPTDY

SEQ ID NO: 34772 - protein, 7 aa, Artificial Sequence
  Synthetic construct
WLGPTVF

SEQ ID NO: 34773 - protein, 7 aa, Artificial Sequence
  Synthetic construct
WLGPTVY

SEQ ID NO: 34774 - protein, 7 aa, Artificial Sequence
  Synthetic construct
WLGPGFF

SEQ ID NO: 34775 - protein, 7 aa, Artificial Sequence
  Synthetic construct
WLGPGFY

SEQ ID NO: 34776 - protein, 7 aa, Artificial Sequence
  Synthetic construct
WLGPGRF

SEQ ID NO: 34777 - protein, 7 aa, Artificial Sequence
  Synthetic construct
WLGPGRY

SEQ ID NO: 34778 - protein, 7 aa, Artificial Sequence
  Synthetic construct
WLGPGCF

SEQ ID NO: 34779 - protein, 7 aa, Artificial Sequence
  Synthetic construct
WLGPGCY

SEQ ID NO: 34780 - protein, 7 aa, Artificial Sequence
  Synthetic construct
WLGPGLF

SEQ ID NO: 34781 - protein, 7 aa, Artificial Sequence
  Synthetic construct
WLGPGLY

SEQ ID NO: 34782 - protein, 7 aa, Artificial Sequence
  Synthetic construct
WLGPGAF

SEQ ID NO: 34783 - protein, 7 aa, Artificial Sequence
  Synthetic construct
WLGPGAY

SEQ ID NO: 34784 - protein, 7 aa, Artificial Sequence
  Synthetic construct
WLGPGQF

SEQ ID NO: 34785 - protein, 7 aa, Artificial Sequence
  Synthetic construct
WLGPGQY

SEQ ID NO: 34786 - protein, 7 aa, Artificial Sequence
  Synthetic construct
WLGPGDF

SEQ ID NO: 34787 - protein, 7 aa, Artificial Sequence
  Synthetic construct
WLGPGDY

SEQ ID NO: 34788 - protein, 7 aa, Artificial Sequence
  Synthetic construct
WLGPGVF

SEQ ID NO: 34789 - protein, 7 aa, Artificial Sequence
  Synthetic construct
WLGPGVY

SEQ ID NO: 34790 - protein, 7 aa, Artificial Sequence
  Synthetic construct
WLGPAFF

SEQ ID NO: 34791 - protein, 7 aa, Artificial Sequence
  Synthetic construct
WLGPAFY

SEQ ID NO: 34792 - protein, 7 aa, Artificial Sequence
  Synthetic construct
WLGPARF

SEQ ID NO: 34793 - protein, 7 aa, Artificial Sequence
  Synthetic construct
WLGPARY

SEQ ID NO: 34794 - protein, 7 aa, Artificial Sequence
  Synthetic construct
WLGPACF

SEQ ID NO: 34795 - protein, 7 aa, Artificial Sequence
  Synthetic construct
WLGPACY

SEQ ID NO: 34796 - protein, 7 aa, Artificial Sequence
  Synthetic construct
WLGPALF

SEQ ID NO: 34797 - protein, 7 aa, Artificial Sequence
  Synthetic construct
WLGPALY

SEQ ID NO: 34798 - protein, 7 aa, Artificial Sequence
  Synthetic construct
WLGPAAF

SEQ ID NO: 34799 - protein, 7 aa, Artificial Sequence
  Synthetic construct
WLGPAAY

SEQ ID NO: 34800 - protein, 7 aa, Artificial Sequence
  Synthetic construct
WLGPAQF

SEQ ID NO: 34801 - protein, 7 aa, Artificial Sequence
  Synthetic construct
WLGPAQY

SEQ ID NO: 34802 - protein, 7 aa, Artificial Sequence
  Synthetic construct
WLGPADF

SEQ ID NO: 34803 - protein, 7 aa, Artificial Sequence
  Synthetic construct
WLGPADY

SEQ ID NO: 34804 - protein, 7 aa, Artificial Sequence
  Synthetic construct
WLGPAVF

SEQ ID NO: 34805 - protein, 7 aa, Artificial Sequence
  Synthetic construct
WLGPAVY

SEQ ID NO: 34806 - protein, 7 aa, Artificial Sequence
  Synthetic construct
WLGPQFF

SEQ ID NO: 34807 - protein, 7 aa, Artificial Sequence
  Synthetic construct
WLGPQFY

SEQ ID NO: 34808 - protein, 7 aa, Artificial Sequence
  Synthetic construct
WLGPQRF

SEQ ID NO: 34809 - protein, 7 aa, Artificial Sequence
  Synthetic construct
WLGPQRY

SEQ ID NO: 34810 - protein, 7 aa, Artificial Sequence
  Synthetic construct
WLGPQCF

SEQ ID NO: 34811 - protein, 7 aa, Artificial Sequence
  Synthetic construct
WLGPQCY

SEQ ID NO: 34812 - protein, 7 aa, Artificial Sequence
  Synthetic construct
WLGPQLF

SEQ ID NO: 34813 - protein, 7 aa, Artificial Sequence
  Synthetic construct
WLGPQLY

SEQ ID NO: 34814 - protein, 7 aa, Artificial Sequence
  Synthetic construct
WLGPQAF

SEQ ID NO: 34815 - protein, 7 aa, Artificial Sequence
  Synthetic construct
WLGPQAY

SEQ ID NO: 34816 - protein, 7 aa, Artificial Sequence
  Synthetic construct
WLGPQQF

SEQ ID NO: 34817 - protein, 7 aa, Artificial Sequence
  Synthetic construct
WLGPQQY

SEQ ID NO: 34818 - protein, 7 aa, Artificial Sequence
  Synthetic construct
WLGPQDF

SEQ ID NO: 34819 - protein, 7 aa, Artificial Sequence
  Synthetic construct
WLGPQDY

SEQ ID NO: 34820 - protein, 7 aa, Artificial Sequence
  Synthetic construct
WLGPQVF

SEQ ID NO: 34821 - protein, 7 aa, Artificial Sequence
  Synthetic construct
WLGPQVY

SEQ ID NO: 34822 - protein, 7 aa, Artificial Sequence
  Synthetic construct
WLGHIFF

SEQ ID NO: 34823 - protein, 7 aa, Artificial Sequence
  Synthetic construct
WLGHIFY

SEQ ID NO: 34824 - protein, 7 aa, Artificial Sequence
  Synthetic construct
WLGHIRF

SEQ ID NO: 34825 - protein, 7 aa, Artificial Sequence
  Synthetic construct
WLGHIRY

SEQ ID NO: 34826 - protein, 7 aa, Artificial Sequence
  Synthetic construct
WLGHICF

SEQ ID NO: 34827 - protein, 7 aa, Artificial Sequence
  Synthetic construct
WLGHICY

SEQ ID NO: 34828 - protein, 7 aa, Artificial Sequence
  Synthetic construct
WLGHILF

SEQ ID NO: 34829 - protein, 7 aa, Artificial Sequence
  Synthetic construct
WLGHILY

SEQ ID NO: 34830 - protein, 7 aa, Artificial Sequence
  Synthetic construct
WLGHIAF

SEQ ID NO: 34831 - protein, 7 aa, Artificial Sequence
  Synthetic construct
WLGHIAY

SEQ ID NO: 34832 - protein, 7 aa, Artificial Sequence
  Synthetic construct
WLGHIQF

SEQ ID NO: 34833 - protein, 7 aa, Artificial Sequence
  Synthetic construct
WLGHIQY

SEQ ID NO: 34834 - protein, 7 aa, Artificial Sequence
  Synthetic construct
WLGHIDF

SEQ ID NO: 34835 - protein, 7 aa, Artificial Sequence
  Synthetic construct
WLGHIDY

SEQ ID NO: 34836 - protein, 7 aa, Artificial Sequence
  Synthetic construct
WLGHIVF

SEQ ID NO: 34837 - protein, 7 aa, Artificial Sequence
  Synthetic construct
WLGHIVY

SEQ ID NO: 34838 - protein, 7 aa, Artificial Sequence
  Synthetic construct
WLGHDFF

SEQ ID NO: 34839 - protein, 7 aa, Artificial Sequence
  Synthetic construct
WLGHDFY

SEQ ID NO: 34840 - protein, 7 aa, Artificial Sequence
  Synthetic construct
WLGHDRF

SEQ ID NO: 34841 - protein, 7 aa, Artificial Sequence
  Synthetic construct
WLGHDRY

SEQ ID NO: 34842 - protein, 7 aa, Artificial Sequence
  Synthetic construct
WLGHDCF

SEQ ID NO: 34843 - protein, 7 aa, Artificial Sequence
  Synthetic construct
WLGHDCY

SEQ ID NO: 34844 - protein, 7 aa, Artificial Sequence
  Synthetic construct
WLGHDLF

SEQ ID NO: 34845 - protein, 7 aa, Artificial Sequence
  Synthetic construct
WLGHDLY

SEQ ID NO: 34846 - protein, 7 aa, Artificial Sequence
  Synthetic construct
WLGHDAF

SEQ ID NO: 34847 - protein, 7 aa, Artificial Sequence
  Synthetic construct
WLGHDAY

SEQ ID NO: 34848 - protein, 7 aa, Artificial Sequence
  Synthetic construct
WLGHDQF

SEQ ID NO: 34849 - protein, 7 aa, Artificial Sequence
  Synthetic construct
WLGHDQY

SEQ ID NO: 34850 - protein, 7 aa, Artificial Sequence
  Synthetic construct
WLGHDDF

SEQ ID NO: 34851 - protein, 7 aa, Artificial Sequence
  Synthetic construct
WLGHDDY

SEQ ID NO: 34852 - protein, 7 aa, Artificial Sequence
  Synthetic construct
WLGHDVF

SEQ ID NO: 34853 - protein, 7 aa, Artificial Sequence
  Synthetic construct
WLGHDVY

SEQ ID NO: 34854 - protein, 7 aa, Artificial Sequence
  Synthetic construct
WLGHYFF

SEQ ID NO: 34855 - protein, 7 aa, Artificial Sequence
  Synthetic construct
WLGHYFY

SEQ ID NO: 34856 - protein, 7 aa, Artificial Sequence
  Synthetic construct
WLGHYRF

SEQ ID NO: 34857 - protein, 7 aa, Artificial Sequence
  Synthetic construct
WLGHYRY

SEQ ID NO: 34858 - protein, 7 aa, Artificial Sequence
  Synthetic construct
WLGHYCF

SEQ ID NO: 34859 - protein, 7 aa, Artificial Sequence
  Synthetic construct
WLGHYCY

SEQ ID NO: 34860 - protein, 7 aa, Artificial Sequence
  Synthetic construct
WLGHYLF

SEQ ID NO: 34861 - protein, 7 aa, Artificial Sequence
  Synthetic construct
WLGHYLY

SEQ ID NO: 34862 - protein, 7 aa, Artificial Sequence
  Synthetic construct
WLGHYAF

SEQ ID NO: 34863 - protein, 7 aa, Artificial Sequence
  Synthetic construct
WLGHYAY

SEQ ID NO: 34864 - protein, 7 aa, Artificial Sequence
  Synthetic construct
WLGHYQF

SEQ ID NO: 34865 - protein, 7 aa, Artificial Sequence
  Synthetic construct
WLGHYQY

SEQ ID NO: 34866 - protein, 7 aa, Artificial Sequence
  Synthetic construct
WLGHYDF

SEQ ID NO: 34867 - protein, 7 aa, Artificial Sequence
  Synthetic construct
WLGHYDY

SEQ ID NO: 34868 - protein, 7 aa, Artificial Sequence
  Synthetic construct
WLGHYVF

SEQ ID NO: 34869 - protein, 7 aa, Artificial Sequence
  Synthetic construct
WLGHYVY

SEQ ID NO: 34870 - protein, 7 aa, Artificial Sequence
  Synthetic construct
WLGHFFF

SEQ ID NO: 34871 - protein, 7 aa, Artificial Sequence
  Synthetic construct
WLGHFFY

SEQ ID NO: 34872 - protein, 7 aa, Artificial Sequence
  Synthetic construct
WLGHFRF

SEQ ID NO: 34873 - protein, 7 aa, Artificial Sequence
  Synthetic construct
WLGHFRY

SEQ ID NO: 34874 - protein, 7 aa, Artificial Sequence
  Synthetic construct
WLGHFCF

SEQ ID NO: 34875 - protein, 7 aa, Artificial Sequence
  Synthetic construct
WLGHFCY

SEQ ID NO: 34876 - protein, 7 aa, Artificial Sequence
  Synthetic construct
WLGHFLF

SEQ ID NO: 34877 - protein, 7 aa, Artificial Sequence
  Synthetic construct
WLGHFLY

SEQ ID NO: 34878 - protein, 7 aa, Artificial Sequence
  Synthetic construct
WLGHFAF

SEQ ID NO: 34879 - protein, 7 aa, Artificial Sequence
  Synthetic construct
WLGHFAY

SEQ ID NO: 34880 - protein, 7 aa, Artificial Sequence
  Synthetic construct
WLGHFQF

SEQ ID NO: 34881 - protein, 7 aa, Artificial Sequence
  Synthetic construct
WLGHFQY

SEQ ID NO: 34882 - protein, 7 aa, Artificial Sequence
  Synthetic construct
WLGHFDF

SEQ ID NO: 34883 - protein, 7 aa, Artificial Sequence
  Synthetic construct
WLGHFDY

SEQ ID NO: 34884 - protein, 7 aa, Artificial Sequence
  Synthetic construct
WLGHFVF

SEQ ID NO: 34885 - protein, 7 aa, Artificial Sequence
  Synthetic construct
WLGHFVY

SEQ ID NO: 34886 - protein, 7 aa, Artificial Sequence
  Synthetic construct
WLGHVFF

SEQ ID NO: 34887 - protein, 7 aa, Artificial Sequence
  Synthetic construct
WLGHVFY

SEQ ID NO: 34888 - protein, 7 aa, Artificial Sequence
  Synthetic construct
WLGHVRF

SEQ ID NO: 34889 - protein, 7 aa, Artificial Sequence
  Synthetic construct
WLGHVRY

SEQ ID NO: 34890 - protein, 7 aa, Artificial Sequence
  Synthetic construct
WLGHVCF

SEQ ID NO: 34891 - protein, 7 aa, Artificial Sequence
  Synthetic construct
WLGHVCY

SEQ ID NO: 34892 - protein, 7 aa, Artificial Sequence
  Synthetic construct
WLGHVLF

SEQ ID NO: 34893 - protein, 7 aa, Artificial Sequence
  Synthetic construct
WLGHVLY

SEQ ID NO: 34894 - protein, 7 aa, Artificial Sequence
  Synthetic construct
WLGHVAF

SEQ ID NO: 34895 - protein, 7 aa, Artificial Sequence
  Synthetic construct
WLGHVAY

SEQ ID NO: 34896 - protein, 7 aa, Artificial Sequence
  Synthetic construct
WLGHVQF

SEQ ID NO: 34897 - protein, 7 aa, Artificial Sequence
  Synthetic construct
WLGHVQY

SEQ ID NO: 34898 - protein, 7 aa, Artificial Sequence
  Synthetic construct
WLGHVDF

SEQ ID NO: 34899 - protein, 7 aa, Artificial Sequence
  Synthetic construct
WLGHVDY

SEQ ID NO: 34900 - protein, 7 aa, Artificial Sequence
  Synthetic construct
WLGHVVF

SEQ ID NO: 34901 - protein, 7 aa, Artificial Sequence
  Synthetic construct
WLGHVVY

SEQ ID NO: 34902 - protein, 7 aa, Artificial Sequence
  Synthetic construct
WLGHTFF

SEQ ID NO: 34903 - protein, 7 aa, Artificial Sequence
  Synthetic construct
WLGHTFY

SEQ ID NO: 34904 - protein, 7 aa, Artificial Sequence
  Synthetic construct
WLGHTRF

SEQ ID NO: 34905 - protein, 7 aa, Artificial Sequence
  Synthetic construct
WLGHTRY

SEQ ID NO: 34906 - protein, 7 aa, Artificial Sequence
  Synthetic construct
WLGHTCF

SEQ ID NO: 34907 - protein, 7 aa, Artificial Sequence
  Synthetic construct
WLGHTCY

SEQ ID NO: 34908 - protein, 7 aa, Artificial Sequence
  Synthetic construct
WLGHTLF

SEQ ID NO: 34909 - protein, 7 aa, Artificial Sequence
  Synthetic construct
WLGHTLY

SEQ ID NO: 34910 - protein, 7 aa, Artificial Sequence
  Synthetic construct
WLGHTAF

SEQ ID NO: 34911 - protein, 7 aa, Artificial Sequence
  Synthetic construct
WLGHTAY

SEQ ID NO: 34912 - protein, 7 aa, Artificial Sequence
  Synthetic construct
WLGHTQF

SEQ ID NO: 34913 - protein, 7 aa, Artificial Sequence
  Synthetic construct
WLGHTQY

SEQ ID NO: 34914 - protein, 7 aa, Artificial Sequence
  Synthetic construct
WLGHTDF

SEQ ID NO: 34915 - protein, 7 aa, Artificial Sequence
  Synthetic construct
WLGHTDY

SEQ ID NO: 34916 - protein, 7 aa, Artificial Sequence
  Synthetic construct
WLGHTVF

SEQ ID NO: 34917 - protein, 7 aa, Artificial Sequence
  Synthetic construct
WLGHTVY

SEQ ID NO: 34918 - protein, 7 aa, Artificial Sequence
  Synthetic construct
WLGHGFF

SEQ ID NO: 34919 - protein, 7 aa, Artificial Sequence
  Synthetic construct
WLGHGFY

SEQ ID NO: 34920 - protein, 7 aa, Artificial Sequence
  Synthetic construct
WLGHGRF

SEQ ID NO: 34921 - protein, 7 aa, Artificial Sequence
  Synthetic construct
WLGHGRY

SEQ ID NO: 34922 - protein, 7 aa, Artificial Sequence
  Synthetic construct
WLGHGCF

SEQ ID NO: 34923 - protein, 7 aa, Artificial Sequence
  Synthetic construct
WLGHGCY

SEQ ID NO: 34924 - protein, 7 aa, Artificial Sequence
  Synthetic construct
WLGHGLF

SEQ ID NO: 34925 - protein, 7 aa, Artificial Sequence
  Synthetic construct
WLGHGLY

SEQ ID NO: 34926 - protein, 7 aa, Artificial Sequence
  Synthetic construct
WLGHGAF

SEQ ID NO: 34927 - protein, 7 aa, Artificial Sequence
  Synthetic construct
WLGHGAY

SEQ ID NO: 34928 - protein, 7 aa, Artificial Sequence
  Synthetic construct
WLGHGQF

SEQ ID NO: 34929 - protein, 7 aa, Artificial Sequence
  Synthetic construct
WLGHGQY

SEQ ID NO: 34930 - protein, 7 aa, Artificial Sequence
  Synthetic construct
WLGHGDF

SEQ ID NO: 34931 - protein, 7 aa, Artificial Sequence
  Synthetic construct
WLGHGDY

SEQ ID NO: 34932 - protein, 7 aa, Artificial Sequence
  Synthetic construct
WLGHGVF

SEQ ID NO: 34933 - protein, 7 aa, Artificial Sequence
  Synthetic construct
WLGHGVY

SEQ ID NO: 34934 - protein, 7 aa, Artificial Sequence
  Synthetic construct
WLGHAFF

SEQ ID NO: 34935 - protein, 7 aa, Artificial Sequence
  Synthetic construct
WLGHAFY

SEQ ID NO: 34936 - protein, 7 aa, Artificial Sequence
  Synthetic construct
WLGHARF

SEQ ID NO: 34937 - protein, 7 aa, Artificial Sequence
  Synthetic construct
WLGHARY

SEQ ID NO: 34938 - protein, 7 aa, Artificial Sequence
  Synthetic construct
WLGHACF

SEQ ID NO: 34939 - protein, 7 aa, Artificial Sequence
  Synthetic construct
WLGHACY

SEQ ID NO: 34940 - protein, 7 aa, Artificial Sequence
  Synthetic construct
WLGHALF

SEQ ID NO: 34941 - protein, 7 aa, Artificial Sequence
  Synthetic construct
WLGHALY

SEQ ID NO: 34942 - protein, 7 aa, Artificial Sequence
  Synthetic construct
WLGHAAF

SEQ ID NO: 34943 - protein, 7 aa, Artificial Sequence
  Synthetic construct
WLGHAAY

SEQ ID NO: 34944 - protein, 7 aa, Artificial Sequence
  Synthetic construct
WLGHAQF

SEQ ID NO: 34945 - protein, 7 aa, Artificial Sequence
  Synthetic construct
WLGHAQY

SEQ ID NO: 34946 - protein, 7 aa, Artificial Sequence
  Synthetic construct
WLGHADF

SEQ ID NO: 34947 - protein, 7 aa, Artificial Sequence
  Synthetic construct
WLGHADY

SEQ ID NO: 34948 - protein, 7 aa, Artificial Sequence
  Synthetic construct
WLGHAVF

SEQ ID NO: 34949 - protein, 7 aa, Artificial Sequence
  Synthetic construct
WLGHAVY

SEQ ID NO: 34950 - protein, 7 aa, Artificial Sequence
  Synthetic construct
WLGHQFF

SEQ ID NO: 34951 - protein, 7 aa, Artificial Sequence
  Synthetic construct
WLGHQFY

SEQ ID NO: 34952 - protein, 7 aa, Artificial Sequence
  Synthetic construct
WLGHQRF

SEQ ID NO: 34953 - protein, 7 aa, Artificial Sequence
  Synthetic construct
WLGHQRY

SEQ ID NO: 34954 - protein, 7 aa, Artificial Sequence
  Synthetic construct
WLGHQCF

SEQ ID NO: 34955 - protein, 7 aa, Artificial Sequence
  Synthetic construct
WLGHQCY

SEQ ID NO: 34956 - protein, 7 aa, Artificial Sequence
  Synthetic construct
WLGHQLF

SEQ ID NO: 34957 - protein, 7 aa, Artificial Sequence
  Synthetic construct
WLGHQLY

SEQ ID NO: 34958 - protein, 7 aa, Artificial Sequence
  Synthetic construct
WLGHQAF

SEQ ID NO: 34959 - protein, 7 aa, Artificial Sequence
  Synthetic construct
WLGHQAY

SEQ ID NO: 34960 - protein, 7 aa, Artificial Sequence
  Synthetic construct
WLGHQQF

SEQ ID NO: 34961 - protein, 7 aa, Artificial Sequence
  Synthetic construct
WLGHQQY

SEQ ID NO: 34962 - protein, 7 aa, Artificial Sequence
  Synthetic construct
WLGHQDF

SEQ ID NO: 34963 - protein, 7 aa, Artificial Sequence
  Synthetic construct
WLGHQDY

SEQ ID NO: 34964 - protein, 7 aa, Artificial Sequence
  Synthetic construct
WLGHQVF

SEQ ID NO: 34965 - protein, 7 aa, Artificial Sequence
  Synthetic construct
WLGHQVY

SEQ ID NO: 34966 - protein, 7 aa, Artificial Sequence
  Synthetic construct
WLGLIFF

SEQ ID NO: 34967 - protein, 7 aa, Artificial Sequence
  Synthetic construct
WLGLIFY

SEQ ID NO: 34968 - protein, 7 aa, Artificial Sequence
  Synthetic construct
WLGLIRF

SEQ ID NO: 34969 - protein, 7 aa, Artificial Sequence
  Synthetic construct
WLGLIRY

SEQ ID NO: 34970 - protein, 7 aa, Artificial Sequence
  Synthetic construct
WLGLICF

SEQ ID NO: 34971 - protein, 7 aa, Artificial Sequence
  Synthetic construct
WLGLICY

SEQ ID NO: 34972 - protein, 7 aa, Artificial Sequence
  Synthetic construct
WLGLILF

SEQ ID NO: 34973 - protein, 7 aa, Artificial Sequence
  Synthetic construct
WLGLILY

SEQ ID NO: 34974 - protein, 7 aa, Artificial Sequence
  Synthetic construct
WLGLIAF

SEQ ID NO: 34975 - protein, 7 aa, Artificial Sequence
  Synthetic construct
WLGLIAY

SEQ ID NO: 34976 - protein, 7 aa, Artificial Sequence
  Synthetic construct
WLGLIQF

SEQ ID NO: 34977 - protein, 7 aa, Artificial Sequence
  Synthetic construct
WLGLIQY

SEQ ID NO: 34978 - protein, 7 aa, Artificial Sequence
  Synthetic construct
WLGLIDF

SEQ ID NO: 34979 - protein, 7 aa, Artificial Sequence
  Synthetic construct
WLGLIDY

SEQ ID NO: 34980 - protein, 7 aa, Artificial Sequence
  Synthetic construct
WLGLIVF

SEQ ID NO: 34981 - protein, 7 aa, Artificial Sequence
  Synthetic construct
WLGLIVY

SEQ ID NO: 34982 - protein, 7 aa, Artificial Sequence
  Synthetic construct
WLGLDFF

SEQ ID NO: 34983 - protein, 7 aa, Artificial Sequence
  Synthetic construct
WLGLDFY

SEQ ID NO: 34984 - protein, 7 aa, Artificial Sequence
  Synthetic construct
WLGLDRF

SEQ ID NO: 34985 - protein, 7 aa, Artificial Sequence
  Synthetic construct
WLGLDRY

SEQ ID NO: 34986 - protein, 7 aa, Artificial Sequence
  Synthetic construct
WLGLDCF

SEQ ID NO: 34987 - protein, 7 aa, Artificial Sequence
  Synthetic construct
WLGLDCY

SEQ ID NO: 34988 - protein, 7 aa, Artificial Sequence
  Synthetic construct
WLGLDLF

SEQ ID NO: 34989 - protein, 7 aa, Artificial Sequence
  Synthetic construct
WLGLDLY

SEQ ID NO: 34990 - protein, 7 aa, Artificial Sequence
  Synthetic construct
WLGLDAF

SEQ ID NO: 34991 - protein, 7 aa, Artificial Sequence
  Synthetic construct
WLGLDAY

SEQ ID NO: 34992 - protein, 7 aa, Artificial Sequence
  Synthetic construct
WLGLDQF

SEQ ID NO: 34993 - protein, 7 aa, Artificial Sequence
  Synthetic construct
WLGLDQY

SEQ ID NO: 34994 - protein, 7 aa, Artificial Sequence
  Synthetic construct
WLGLDDF

SEQ ID NO: 34995 - protein, 7 aa, Artificial Sequence
  Synthetic construct
WLGLDDY

SEQ ID NO: 34996 - protein, 7 aa, Artificial Sequence
  Synthetic construct
WLGLDVF

SEQ ID NO: 34997 - protein, 7 aa, Artificial Sequence
  Synthetic construct
WLGLDVY

SEQ ID NO: 34998 - protein, 7 aa, Artificial Sequence
  Synthetic construct
WLGLYFF

SEQ ID NO: 34999 - protein, 7 aa, Artificial Sequence
  Synthetic construct
WLGLYFY

SEQ ID NO: 35000 - protein, 7 aa, Artificial Sequence
  Synthetic construct
WLGLYRF

SEQ ID NO: 35001 - protein, 7 aa, Artificial Sequence
  Synthetic construct
WLGLYRY

SEQ ID NO: 35002 - protein, 7 aa, Artificial Sequence
  Synthetic construct
WLGLYCF

SEQ ID NO: 35003 - protein, 7 aa, Artificial Sequence
  Synthetic construct
WLGLYCY

SEQ ID NO: 35004 - protein, 7 aa, Artificial Sequence
  Synthetic construct
WLGLYLF

SEQ ID NO: 35005 - protein, 7 aa, Artificial Sequence
  Synthetic construct
WLGLYLY

SEQ ID NO: 35006 - protein, 7 aa, Artificial Sequence
  Synthetic construct
WLGLYAF

SEQ ID NO: 35007 - protein, 7 aa, Artificial Sequence
  Synthetic construct
WLGLYAY

SEQ ID NO: 35008 - protein, 7 aa, Artificial Sequence
  Synthetic construct
WLGLYQF

SEQ ID NO: 35009 - protein, 7 aa, Artificial Sequence
  Synthetic construct
WLGLYQY

SEQ ID NO: 35010 - protein, 7 aa, Artificial Sequence
  Synthetic construct
WLGLYDF

SEQ ID NO: 35011 - protein, 7 aa, Artificial Sequence
  Synthetic construct
WLGLYDY

SEQ ID NO: 35012 - protein, 7 aa, Artificial Sequence
  Synthetic construct
WLGLYVF

SEQ ID NO: 35013 - protein, 7 aa, Artificial Sequence
  Synthetic construct
WLGLYVY

SEQ ID NO: 35014 - protein, 7 aa, Artificial Sequence
  Synthetic construct
WLGLFFF

SEQ ID NO: 35015 - protein, 7 aa, Artificial Sequence
  Synthetic construct
WLGLFFY

SEQ ID NO: 35016 - protein, 7 aa, Artificial Sequence
  Synthetic construct
WLGLFRF

SEQ ID NO: 35017 - protein, 7 aa, Artificial Sequence
  Synthetic construct
WLGLFRY

SEQ ID NO: 35018 - protein, 7 aa, Artificial Sequence
  Synthetic construct
WLGLFCF

SEQ ID NO: 35019 - protein, 7 aa, Artificial Sequence
  Synthetic construct
WLGLFCY

SEQ ID NO: 35020 - protein, 7 aa, Artificial Sequence
  Synthetic construct
WLGLFLF

SEQ ID NO: 35021 - protein, 7 aa, Artificial Sequence
  Synthetic construct
WLGLFLY

SEQ ID NO: 35022 - protein, 7 aa, Artificial Sequence
  Synthetic construct
WLGLFAF

SEQ ID NO: 35023 - protein, 7 aa, Artificial Sequence
  Synthetic construct
WLGLFAY

SEQ ID NO: 35024 - protein, 7 aa, Artificial Sequence
  Synthetic construct
WLGLFQF

SEQ ID NO: 35025 - protein, 7 aa, Artificial Sequence
  Synthetic construct
WLGLFQY

SEQ ID NO: 35026 - protein, 7 aa, Artificial Sequence
  Synthetic construct
WLGLFDF

SEQ ID NO: 35027 - protein, 7 aa, Artificial Sequence
  Synthetic construct
WLGLFDY

SEQ ID NO: 35028 - protein, 7 aa, Artificial Sequence
  Synthetic construct
WLGLFVF

SEQ ID NO: 35029 - protein, 7 aa, Artificial Sequence
  Synthetic construct
WLGLFVY

SEQ ID NO: 35030 - protein, 7 aa, Artificial Sequence
  Synthetic construct
WLGLVFF

SEQ ID NO: 35031 - protein, 7 aa, Artificial Sequence
  Synthetic construct
WLGLVFY

SEQ ID NO: 35032 - protein, 7 aa, Artificial Sequence
  Synthetic construct
WLGLVRF

SEQ ID NO: 35033 - protein, 7 aa, Artificial Sequence
  Synthetic construct
WLGLVRY

SEQ ID NO: 35034 - protein, 7 aa, Artificial Sequence
  Synthetic construct
WLGLVCF

SEQ ID NO: 35035 - protein, 7 aa, Artificial Sequence
  Synthetic construct
WLGLVCY

SEQ ID NO: 35036 - protein, 7 aa, Artificial Sequence
  Synthetic construct
WLGLVLF

SEQ ID NO: 35037 - protein, 7 aa, Artificial Sequence
  Synthetic construct
WLGLVLY

SEQ ID NO: 35038 - protein, 7 aa, Artificial Sequence
  Synthetic construct
WLGLVAF

SEQ ID NO: 35039 - protein, 7 aa, Artificial Sequence
  Synthetic construct
WLGLVAY

SEQ ID NO: 35040 - protein, 7 aa, Artificial Sequence
  Synthetic construct
WLGLVQF

SEQ ID NO: 35041 - protein, 7 aa, Artificial Sequence
  Synthetic construct
WLGLVQY

SEQ ID NO: 35042 - protein, 7 aa, Artificial Sequence
  Synthetic construct
WLGLVDF

SEQ ID NO: 35043 - protein, 7 aa, Artificial Sequence
  Synthetic construct
WLGLVDY

SEQ ID NO: 35044 - protein, 7 aa, Artificial Sequence
  Synthetic construct
WLGLVVF

SEQ ID NO: 35045 - protein, 7 aa, Artificial Sequence
  Synthetic construct
WLGLVVY

SEQ ID NO: 35046 - protein, 7 aa, Artificial Sequence
  Synthetic construct
WLGLTFF

SEQ ID NO: 35047 - protein, 7 aa, Artificial Sequence
  Synthetic construct
WLGLTFY

SEQ ID NO: 35048 - protein, 7 aa, Artificial Sequence
  Synthetic construct
WLGLTRF

SEQ ID NO: 35049 - protein, 7 aa, Artificial Sequence
  Synthetic construct
WLGLTRY

SEQ ID NO: 35050 - protein, 7 aa, Artificial Sequence
  Synthetic construct
WLGLTCF

SEQ ID NO: 35051 - protein, 7 aa, Artificial Sequence
  Synthetic construct
WLGLTCY

SEQ ID NO: 35052 - protein, 7 aa, Artificial Sequence
  Synthetic construct
WLGLTLF

SEQ ID NO: 35053 - protein, 7 aa, Artificial Sequence
  Synthetic construct
WLGLTLY

SEQ ID NO: 35054 - protein, 7 aa, Artificial Sequence
  Synthetic construct
WLGLTAF

SEQ ID NO: 35055 - protein, 7 aa, Artificial Sequence
  Synthetic construct
WLGLTAY

SEQ ID NO: 35056 - protein, 7 aa, Artificial Sequence
  Synthetic construct
WLGLTQF

SEQ ID NO: 35057 - protein, 7 aa, Artificial Sequence
  Synthetic construct
WLGLTQY

SEQ ID NO: 35058 - protein, 7 aa, Artificial Sequence
  Synthetic construct
WLGLTDF

SEQ ID NO: 35059 - protein, 7 aa, Artificial Sequence
  Synthetic construct
WLGLTDY

SEQ ID NO: 35060 - protein, 7 aa, Artificial Sequence
  Synthetic construct
WLGLTVF

SEQ ID NO: 35061 - protein, 7 aa, Artificial Sequence
  Synthetic construct
WLGLTVY

SEQ ID NO: 35062 - protein, 7 aa, Artificial Sequence
  Synthetic construct
WLGLGFF

SEQ ID NO: 35063 - protein, 7 aa, Artificial Sequence
  Synthetic construct
WLGLGFY

SEQ ID NO: 35064 - protein, 7 aa, Artificial Sequence
  Synthetic construct
WLGLGRF

SEQ ID NO: 35065 - protein, 7 aa, Artificial Sequence
  Synthetic construct
WLGLGRY

SEQ ID NO: 35066 - protein, 7 aa, Artificial Sequence
  Synthetic construct
WLGLGCF

SEQ ID NO: 35067 - protein, 7 aa, Artificial Sequence
  Synthetic construct
WLGLGCY

SEQ ID NO: 35068 - protein, 7 aa, Artificial Sequence
  Synthetic construct
WLGLGLF

SEQ ID NO: 35069 - protein, 7 aa, Artificial Sequence
  Synthetic construct
WLGLGLY

SEQ ID NO: 35070 - protein, 7 aa, Artificial Sequence
  Synthetic construct
WLGLGAF

SEQ ID NO: 35071 - protein, 7 aa, Artificial Sequence
  Synthetic construct
WLGLGAY

SEQ ID NO: 35072 - protein, 7 aa, Artificial Sequence
  Synthetic construct
WLGLGQF

SEQ ID NO: 35073 - protein, 7 aa, Artificial Sequence
  Synthetic construct
WLGLGQY

SEQ ID NO: 35074 - protein, 7 aa, Artificial Sequence
  Synthetic construct
WLGLGDF

SEQ ID NO: 35075 - protein, 7 aa, Artificial Sequence
  Synthetic construct
WLGLGDY

SEQ ID NO: 35076 - protein, 7 aa, Artificial Sequence
  Synthetic construct
WLGLGVF

SEQ ID NO: 35077 - protein, 7 aa, Artificial Sequence
  Synthetic construct
WLGLGVY

SEQ ID NO: 35078 - protein, 7 aa, Artificial Sequence
  Synthetic construct
WLGLAFF

SEQ ID NO: 35079 - protein, 7 aa, Artificial Sequence
  Synthetic construct
WLGLAFY

SEQ ID NO: 35080 - protein, 7 aa, Artificial Sequence
  Synthetic construct
WLGLARF

SEQ ID NO: 35081 - protein, 7 aa, Artificial Sequence
  Synthetic construct
WLGLARY

SEQ ID NO: 35082 - protein, 7 aa, Artificial Sequence
  Synthetic construct
WLGLACF

SEQ ID NO: 35083 - protein, 7 aa, Artificial Sequence
  Synthetic construct
WLGLACY

SEQ ID NO: 35084 - protein, 7 aa, Artificial Sequence
  Synthetic construct
WLGLALF

SEQ ID NO: 35085 - protein, 7 aa, Artificial Sequence
  Synthetic construct
WLGLALY

SEQ ID NO: 35086 - protein, 7 aa, Artificial Sequence
  Synthetic construct
WLGLAAF

SEQ ID NO: 35087 - protein, 7 aa, Artificial Sequence
  Synthetic construct
WLGLAAY

SEQ ID NO: 35088 - protein, 7 aa, Artificial Sequence
  Synthetic construct
WLGLAQF

SEQ ID NO: 35089 - protein, 7 aa, Artificial Sequence
  Synthetic construct
WLGLAQY

SEQ ID NO: 35090 - protein, 7 aa, Artificial Sequence
  Synthetic construct
WLGLADF

SEQ ID NO: 35091 - protein, 7 aa, Artificial Sequence
  Synthetic construct
WLGLADY

SEQ ID NO: 35092 - protein, 7 aa, Artificial Sequence
  Synthetic construct
WLGLAVF

SEQ ID NO: 35093 - protein, 7 aa, Artificial Sequence
  Synthetic construct
WLGLAVY

SEQ ID NO: 35094 - protein, 7 aa, Artificial Sequence
  Synthetic construct
WLGLQFF

SEQ ID NO: 35095 - protein, 7 aa, Artificial Sequence
  Synthetic construct
WLGLQFY

SEQ ID NO: 35096 - protein, 7 aa, Artificial Sequence
  Synthetic construct
WLGLQRF

SEQ ID NO: 35097 - protein, 7 aa, Artificial Sequence
  Synthetic construct
WLGLQRY

SEQ ID NO: 35098 - protein, 7 aa, Artificial Sequence
  Synthetic construct
WLGLQCF

SEQ ID NO: 35099 - protein, 7 aa, Artificial Sequence
  Synthetic construct
WLGLQCY

SEQ ID NO: 35100 - protein, 7 aa, Artificial Sequence
  Synthetic construct
WLGLQLF

SEQ ID NO: 35101 - protein, 7 aa, Artificial Sequence
  Synthetic construct
WLGLQLY

SEQ ID NO: 35102 - protein, 7 aa, Artificial Sequence
  Synthetic construct
WLGLQAF

SEQ ID NO: 35103 - protein, 7 aa, Artificial Sequence
  Synthetic construct
WLGLQAY

SEQ ID NO: 35104 - protein, 7 aa, Artificial Sequence
  Synthetic construct
WLGLQQF

SEQ ID NO: 35105 - protein, 7 aa, Artificial Sequence
  Synthetic construct
WLGLQQY

SEQ ID NO: 35106 - protein, 7 aa, Artificial Sequence
  Synthetic construct
WLGLQDF

SEQ ID NO: 35107 - protein, 7 aa, Artificial Sequence
  Synthetic construct
WLGLQDY

SEQ ID NO: 35108 - protein, 7 aa, Artificial Sequence
  Synthetic construct
WLGLQVF

SEQ ID NO: 35109 - protein, 7 aa, Artificial Sequence
  Synthetic construct
WLGLQVY

SEQ ID NO: 35110 - protein, 7 aa, Artificial Sequence
  Synthetic construct
WLGFIFF

SEQ ID NO: 35111 - protein, 7 aa, Artificial Sequence
  Synthetic construct
WLGFIFY

SEQ ID NO: 35112 - protein, 7 aa, Artificial Sequence
  Synthetic construct
WLGFIRF

SEQ ID NO: 35113 - protein, 7 aa, Artificial Sequence
  Synthetic construct
WLGFIRY

SEQ ID NO: 35114 - protein, 7 aa, Artificial Sequence
  Synthetic construct
WLGFICF

SEQ ID NO: 35115 - protein, 7 aa, Artificial Sequence
  Synthetic construct
WLGFICY

SEQ ID NO: 35116 - protein, 7 aa, Artificial Sequence
  Synthetic construct
WLGFILF

SEQ ID NO: 35117 - protein, 7 aa, Artificial Sequence
  Synthetic construct
WLGFILY

SEQ ID NO: 35118 - protein, 7 aa, Artificial Sequence
  Synthetic construct
WLGFIAF

SEQ ID NO: 35119 - protein, 7 aa, Artificial Sequence
  Synthetic construct
WLGFIAY

SEQ ID NO: 35120 - protein, 7 aa, Artificial Sequence
  Synthetic construct
WLGFIQF

SEQ ID NO: 35121 - protein, 7 aa, Artificial Sequence
  Synthetic construct
WLGFIQY

SEQ ID NO: 35122 - protein, 7 aa, Artificial Sequence
  Synthetic construct
WLGFIDF

SEQ ID NO: 35123 - protein, 7 aa, Artificial Sequence
  Synthetic construct
WLGFIDY

SEQ ID NO: 35124 - protein, 7 aa, Artificial Sequence
  Synthetic construct
WLGFIVF

SEQ ID NO: 35125 - protein, 7 aa, Artificial Sequence
  Synthetic construct
WLGFIVY

SEQ ID NO: 35126 - protein, 7 aa, Artificial Sequence
  Synthetic construct
WLGFDFF

SEQ ID NO: 35127 - protein, 7 aa, Artificial Sequence
  Synthetic construct
WLGFDFY

SEQ ID NO: 35128 - protein, 7 aa, Artificial Sequence
  Synthetic construct
WLGFDRF

SEQ ID NO: 35129 - protein, 7 aa, Artificial Sequence
  Synthetic construct
WLGFDRY

SEQ ID NO: 35130 - protein, 7 aa, Artificial Sequence
  Synthetic construct
WLGFDCF

SEQ ID NO: 35131 - protein, 7 aa, Artificial Sequence
  Synthetic construct
WLGFDCY

SEQ ID NO: 35132 - protein, 7 aa, Artificial Sequence
  Synthetic construct
WLGFDLF

SEQ ID NO: 35133 - protein, 7 aa, Artificial Sequence
  Synthetic construct
WLGFDLY

SEQ ID NO: 35134 - protein, 7 aa, Artificial Sequence
  Synthetic construct
WLGFDAF

SEQ ID NO: 35135 - protein, 7 aa, Artificial Sequence
  Synthetic construct
WLGFDAY

SEQ ID NO: 35136 - protein, 7 aa, Artificial Sequence
  Synthetic construct
WLGFDQF

SEQ ID NO: 35137 - protein, 7 aa, Artificial Sequence
  Synthetic construct
WLGFDQY

SEQ ID NO: 35138 - protein, 7 aa, Artificial Sequence
  Synthetic construct
WLGFDDF

SEQ ID NO: 35139 - protein, 7 aa, Artificial Sequence
  Synthetic construct
WLGFDDY

SEQ ID NO: 35140 - protein, 7 aa, Artificial Sequence
  Synthetic construct
WLGFDVF

SEQ ID NO: 35141 - protein, 7 aa, Artificial Sequence
  Synthetic construct
WLGFDVY

SEQ ID NO: 35142 - protein, 7 aa, Artificial Sequence
  Synthetic construct
WLGFYFF

SEQ ID NO: 35143 - protein, 7 aa, Artificial Sequence
  Synthetic construct
WLGFYFY

SEQ ID NO: 35144 - protein, 7 aa, Artificial Sequence
  Synthetic construct
WLGFYRF

SEQ ID NO: 35145 - protein, 7 aa, Artificial Sequence
  Synthetic construct
WLGFYRY

SEQ ID NO: 35146 - protein, 7 aa, Artificial Sequence
  Synthetic construct
WLGFYCF

SEQ ID NO: 35147 - protein, 7 aa, Artificial Sequence
  Synthetic construct
WLGFYCY

SEQ ID NO: 35148 - protein, 7 aa, Artificial Sequence
  Synthetic construct
WLGFYLF

SEQ ID NO: 35149 - protein, 7 aa, Artificial Sequence
  Synthetic construct
WLGFYLY

SEQ ID NO: 35150 - protein, 7 aa, Artificial Sequence
  Synthetic construct
WLGFYAF

SEQ ID NO: 35151 - protein, 7 aa, Artificial Sequence
  Synthetic construct
WLGFYAY

SEQ ID NO: 35152 - protein, 7 aa, Artificial Sequence
  Synthetic construct
WLGFYQF

SEQ ID NO: 35153 - protein, 7 aa, Artificial Sequence
  Synthetic construct
WLGFYQY

SEQ ID NO: 35154 - protein, 7 aa, Artificial Sequence
  Synthetic construct
WLGFYDF

SEQ ID NO: 35155 - protein, 7 aa, Artificial Sequence
  Synthetic construct
WLGFYDY

SEQ ID NO: 35156 - protein, 7 aa, Artificial Sequence
  Synthetic construct
WLGFYVF

SEQ ID NO: 35157 - protein, 7 aa, Artificial Sequence
  Synthetic construct
WLGFYVY

SEQ ID NO: 35158 - protein, 7 aa, Artificial Sequence
  Synthetic construct
WLGFFFF

SEQ ID NO: 35159 - protein, 7 aa, Artificial Sequence
  Synthetic construct
WLGFFFY

SEQ ID NO: 35160 - protein, 7 aa, Artificial Sequence
  Synthetic construct
WLGFFRF

SEQ ID NO: 35161 - protein, 7 aa, Artificial Sequence
  Synthetic construct
WLGFFRY

SEQ ID NO: 35162 - protein, 7 aa, Artificial Sequence
  Synthetic construct
WLGFFCF

SEQ ID NO: 35163 - protein, 7 aa, Artificial Sequence
  Synthetic construct
WLGFFCY

SEQ ID NO: 35164 - protein, 7 aa, Artificial Sequence
  Synthetic construct
WLGFFLF

SEQ ID NO: 35165 - protein, 7 aa, Artificial Sequence
  Synthetic construct
WLGFFLY

SEQ ID NO: 35166 - protein, 7 aa, Artificial Sequence
  Synthetic construct
WLGFFAF

SEQ ID NO: 35167 - protein, 7 aa, Artificial Sequence
  Synthetic construct
WLGFFAY

SEQ ID NO: 35168 - protein, 7 aa, Artificial Sequence
  Synthetic construct
WLGFFQF

SEQ ID NO: 35169 - protein, 7 aa, Artificial Sequence
  Synthetic construct
WLGFFQY

SEQ ID NO: 35170 - protein, 7 aa, Artificial Sequence
  Synthetic construct
WLGFFDF

SEQ ID NO: 35171 - protein, 7 aa, Artificial Sequence
  Synthetic construct
WLGFFDY

SEQ ID NO: 35172 - protein, 7 aa, Artificial Sequence
  Synthetic construct
WLGFFVF

SEQ ID NO: 35173 - protein, 7 aa, Artificial Sequence
  Synthetic construct
WLGFFVY

SEQ ID NO: 35174 - protein, 7 aa, Artificial Sequence
  Synthetic construct
WLGFVFF

SEQ ID NO: 35175 - protein, 7 aa, Artificial Sequence
  Synthetic construct
WLGFVFY

SEQ ID NO: 35176 - protein, 7 aa, Artificial Sequence
  Synthetic construct
WLGFVRF

SEQ ID NO: 35177 - protein, 7 aa, Artificial Sequence
  Synthetic construct
WLGFVRY

SEQ ID NO: 35178 - protein, 7 aa, Artificial Sequence
  Synthetic construct
WLGFVCF

SEQ ID NO: 35179 - protein, 7 aa, Artificial Sequence
  Synthetic construct
WLGFVCY

SEQ ID NO: 35180 - protein, 7 aa, Artificial Sequence
  Synthetic construct
WLGFVLF

SEQ ID NO: 35181 - protein, 7 aa, Artificial Sequence
  Synthetic construct
WLGFVLY

SEQ ID NO: 35182 - protein, 7 aa, Artificial Sequence
  Synthetic construct
WLGFVAF

SEQ ID NO: 35183 - protein, 7 aa, Artificial Sequence
  Synthetic construct
WLGFVAY

SEQ ID NO: 35184 - protein, 7 aa, Artificial Sequence
  Synthetic construct
WLGFVQF

SEQ ID NO: 35185 - protein, 7 aa, Artificial Sequence
  Synthetic construct
WLGFVQY

SEQ ID NO: 35186 - protein, 7 aa, Artificial Sequence
  Synthetic construct
WLGFVDF

SEQ ID NO: 35187 - protein, 7 aa, Artificial Sequence
  Synthetic construct
WLGFVDY

SEQ ID NO: 35188 - protein, 7 aa, Artificial Sequence
  Synthetic construct
WLGFVVF

SEQ ID NO: 35189 - protein, 7 aa, Artificial Sequence
  Synthetic construct
WLGFVVY

SEQ ID NO: 35190 - protein, 7 aa, Artificial Sequence
  Synthetic construct
WLGFTFF

SEQ ID NO: 35191 - protein, 7 aa, Artificial Sequence
  Synthetic construct
WLGFTFY

SEQ ID NO: 35192 - protein, 7 aa, Artificial Sequence
  Synthetic construct
WLGFTRF

SEQ ID NO: 35193 - protein, 7 aa, Artificial Sequence
  Synthetic construct
WLGFTRY

SEQ ID NO: 35194 - protein, 7 aa, Artificial Sequence
  Synthetic construct
WLGFTCF

SEQ ID NO: 35195 - protein, 7 aa, Artificial Sequence
  Synthetic construct
WLGFTCY

SEQ ID NO: 35196 - protein, 7 aa, Artificial Sequence
  Synthetic construct
WLGFTLF

SEQ ID NO: 35197 - protein, 7 aa, Artificial Sequence
  Synthetic construct
WLGFTLY

SEQ ID NO: 35198 - protein, 7 aa, Artificial Sequence
  Synthetic construct
WLGFTAF

SEQ ID NO: 35199 - protein, 7 aa, Artificial Sequence
  Synthetic construct
WLGFTAY

SEQ ID NO: 35200 - protein, 7 aa, Artificial Sequence
  Synthetic construct
WLGFTQF

SEQ ID NO: 35201 - protein, 7 aa, Artificial Sequence
  Synthetic construct
WLGFTQY

SEQ ID NO: 35202 - protein, 7 aa, Artificial Sequence
  Synthetic construct
WLGFTDF

SEQ ID NO: 35203 - protein, 7 aa, Artificial Sequence
  Synthetic construct
WLGFTDY

SEQ ID NO: 35204 - protein, 7 aa, Artificial Sequence
  Synthetic construct
WLGFTVF

SEQ ID NO: 35205 - protein, 7 aa, Artificial Sequence
  Synthetic construct
WLGFTVY

SEQ ID NO: 35206 - protein, 7 aa, Artificial Sequence
  Synthetic construct
WLGFGFF

SEQ ID NO: 35207 - protein, 7 aa, Artificial Sequence
  Synthetic construct
WLGFGFY

SEQ ID NO: 35208 - protein, 7 aa, Artificial Sequence
  Synthetic construct
WLGFGRF

SEQ ID NO: 35209 - protein, 7 aa, Artificial Sequence
  Synthetic construct
WLGFGRY

SEQ ID NO: 35210 - protein, 7 aa, Artificial Sequence
  Synthetic construct
WLGFGCF

SEQ ID NO: 35211 - protein, 7 aa, Artificial Sequence
  Synthetic construct
WLGFGCY

SEQ ID NO: 35212 - protein, 7 aa, Artificial Sequence
  Synthetic construct
WLGFGLF

SEQ ID NO: 35213 - protein, 7 aa, Artificial Sequence
  Synthetic construct
WLGFGLY

SEQ ID NO: 35214 - protein, 7 aa, Artificial Sequence
  Synthetic construct
WLGFGAF

SEQ ID NO: 35215 - protein, 7 aa, Artificial Sequence
  Synthetic construct
WLGFGAY

SEQ ID NO: 35216 - protein, 7 aa, Artificial Sequence
  Synthetic construct
WLGFGQF

SEQ ID NO: 35217 - protein, 7 aa, Artificial Sequence
  Synthetic construct
WLGFGQY

SEQ ID NO: 35218 - protein, 7 aa, Artificial Sequence
  Synthetic construct
WLGFGDF

SEQ ID NO: 35219 - protein, 7 aa, Artificial Sequence
  Synthetic construct
WLGFGDY

SEQ ID NO: 35220 - protein, 7 aa, Artificial Sequence
  Synthetic construct
WLGFGVF

SEQ ID NO: 35221 - protein, 7 aa, Artificial Sequence
  Synthetic construct
WLGFGVY

SEQ ID NO: 35222 - protein, 7 aa, Artificial Sequence
  Synthetic construct
WLGFAFF

SEQ ID NO: 35223 - protein, 7 aa, Artificial Sequence
  Synthetic construct
WLGFAFY

SEQ ID NO: 35224 - protein, 7 aa, Artificial Sequence
  Synthetic construct
WLGFARF

SEQ ID NO: 35225 - protein, 7 aa, Artificial Sequence
  Synthetic construct
WLGFARY

SEQ ID NO: 35226 - protein, 7 aa, Artificial Sequence
  Synthetic construct
WLGFACF

SEQ ID NO: 35227 - protein, 7 aa, Artificial Sequence
  Synthetic construct
WLGFACY

SEQ ID NO: 35228 - protein, 7 aa, Artificial Sequence
  Synthetic construct
WLGFALF

SEQ ID NO: 35229 - protein, 7 aa, Artificial Sequence
  Synthetic construct
WLGFALY

SEQ ID NO: 35230 - protein, 7 aa, Artificial Sequence
  Synthetic construct
WLGFAAF

SEQ ID NO: 35231 - protein, 7 aa, Artificial Sequence
  Synthetic construct
WLGFAAY

SEQ ID NO: 35232 - protein, 7 aa, Artificial Sequence
  Synthetic construct
WLGFAQF

SEQ ID NO: 35233 - protein, 7 aa, Artificial Sequence
  Synthetic construct
WLGFAQY

SEQ ID NO: 35234 - protein, 7 aa, Artificial Sequence
  Synthetic construct
WLGFADF

SEQ ID NO: 35235 - protein, 7 aa, Artificial Sequence
  Synthetic construct
WLGFADY

SEQ ID NO: 35236 - protein, 7 aa, Artificial Sequence
  Synthetic construct
WLGFAVF

SEQ ID NO: 35237 - protein, 7 aa, Artificial Sequence
  Synthetic construct
WLGFAVY

SEQ ID NO: 35238 - protein, 7 aa, Artificial Sequence
  Synthetic construct
WLGFQFF

SEQ ID NO: 35239 - protein, 7 aa, Artificial Sequence
  Synthetic construct
WLGFQFY

SEQ ID NO: 35240 - protein, 7 aa, Artificial Sequence
  Synthetic construct
WLGFQRF

SEQ ID NO: 35241 - protein, 7 aa, Artificial Sequence
  Synthetic construct
WLGFQRY

SEQ ID NO: 35242 - protein, 7 aa, Artificial Sequence
  Synthetic construct
WLGFQCF

SEQ ID NO: 35243 - protein, 7 aa, Artificial Sequence
  Synthetic construct
WLGFQCY

SEQ ID NO: 35244 - protein, 7 aa, Artificial Sequence
  Synthetic construct
WLGFQLF

SEQ ID NO: 35245 - protein, 7 aa, Artificial Sequence
  Synthetic construct
WLGFQLY

SEQ ID NO: 35246 - protein, 7 aa, Artificial Sequence
  Synthetic construct
WLGFQAF

SEQ ID NO: 35247 - protein, 7 aa, Artificial Sequence
  Synthetic construct
WLGFQAY

SEQ ID NO: 35248 - protein, 7 aa, Artificial Sequence
  Synthetic construct
WLGFQQF

SEQ ID NO: 35249 - protein, 7 aa, Artificial Sequence
  Synthetic construct
WLGFQQY

SEQ ID NO: 35250 - protein, 7 aa, Artificial Sequence
  Synthetic construct
WLGFQDF

SEQ ID NO: 35251 - protein, 7 aa, Artificial Sequence
  Synthetic construct
WLGFQDY

SEQ ID NO: 35252 - protein, 7 aa, Artificial Sequence
  Synthetic construct
WLGFQVF

SEQ ID NO: 35253 - protein, 7 aa, Artificial Sequence
  Synthetic construct
WLGFQVY

SEQ ID NO: 35254 - protein, 7 aa, Artificial Sequence
  Synthetic construct
FPPPAPP

SEQ ID NO: 35255 - protein, 7 aa, Artificial Sequence
  Synthetic construct
FPPPAPY

SEQ ID NO: 35256 - protein, 7 aa, Artificial Sequence
  Synthetic construct
FPPPAPL

SEQ ID NO: 35257 - protein, 7 aa, Artificial Sequence
  Synthetic construct
FPPPAPA

SEQ ID NO: 35258 - protein, 7 aa, Artificial Sequence
  Synthetic construct
FPPPAPE

SEQ ID NO: 35259 - protein, 7 aa, Artificial Sequence
  Synthetic construct
FPPPAPG

SEQ ID NO: 35260 - protein, 7 aa, Artificial Sequence
  Synthetic construct
FPPPAPV

SEQ ID NO: 35261 - protein, 7 aa, Artificial Sequence
  Synthetic construct
FPPPAPI

SEQ ID NO: 35262 - protein, 7 aa, Artificial Sequence
  Synthetic construct
FSPPAPP

SEQ ID NO: 35263 - protein, 7 aa, Artificial Sequence
  Synthetic construct
FSPPAPY

SEQ ID NO: 35264 - protein, 7 aa, Artificial Sequence
  Synthetic construct
FSPPAPL

SEQ ID NO: 35265 - protein, 7 aa, Artificial Sequence
  Synthetic construct
FSPPAPA

SEQ ID NO: 35266 - protein, 7 aa, Artificial Sequence
  Synthetic construct
FSPPAPE

SEQ ID NO: 35267 - protein, 7 aa, Artificial Sequence
  Synthetic construct
FSPPAPG

SEQ ID NO: 35268 - protein, 7 aa, Artificial Sequence
  Synthetic construct
FSPPAPV

SEQ ID NO: 35269 - protein, 7 aa, Artificial Sequence
  Synthetic construct
FSPPAPI

SEQ ID NO: 35270 - protein, 7 aa, Artificial Sequence
  Synthetic construct
DFTVFPP

SEQ ID NO: 35271 - protein, 7 aa, Artificial Sequence
  Synthetic construct
DFTIFPP

SEQ ID NO: 35272 - protein, 7 aa, Artificial Sequence
  Synthetic construct
YTPAHFY

SEQ ID NO: 35273 - protein, 7 aa, Artificial Sequence
  Synthetic construct
YTPAHFA

SEQ ID NO: 35274 - protein, 7 aa, Artificial Sequence
  Synthetic construct
YTPAIFY

SEQ ID NO: 35275 - protein, 7 aa, Artificial Sequence
  Synthetic construct
YTPAIFA

SEQ ID NO: 35276 - protein, 7 aa, Artificial Sequence
  Synthetic construct
TTPAHFY

SEQ ID NO: 35277 - protein, 7 aa, Artificial Sequence
  Synthetic construct
TTPAHFA

SEQ ID NO: 35278 - protein, 7 aa, Artificial Sequence
  Synthetic construct
TTPAIFY

SEQ ID NO: 35279 - protein, 7 aa, Artificial Sequence
  Synthetic construct
TTPAIFA

SEQ ID NO: 35280 - protein, 7 aa, Artificial Sequence
  Synthetic construct
HTPAHFY

SEQ ID NO: 35281 - protein, 7 aa, Artificial Sequence
  Synthetic construct
HTPAHFA

SEQ ID NO: 35282 - protein, 7 aa, Artificial Sequence
  Synthetic construct
HTPAIFY

SEQ ID NO: 35283 - protein, 7 aa, Artificial Sequence
  Synthetic construct
HTPAIFA

SEQ ID NO: 35284 - protein, 10 aa, Artificial Sequence
  Synthetic construct
PARATPPSPP

SEQ ID NO: 35285 - protein, 10 aa, Artificial Sequence
  Synthetic construct
PARATPFSPP

SEQ ID NO: 35286 - protein, 10 aa, Artificial Sequence
  Synthetic construct
PARPTPPSPP

SEQ ID NO: 35287 - protein, 10 aa, Artificial Sequence
  Synthetic construct
PARPTPFSPP

SEQ ID NO: 35288 - protein, 10 aa, Artificial Sequence
  Synthetic construct
PARWTPPSPP

SEQ ID NO: 35289 - protein, 10 aa, Artificial Sequence
  Synthetic construct
PARWTPFSPP

SEQ ID NO: 35290 - protein, 10 aa, Artificial Sequence
  Synthetic construct
PARNTPPSPP

SEQ ID NO: 35291 - protein, 10 aa, Artificial Sequence
  Synthetic construct
PARNTPFSPP

SEQ ID NO: 35292 - protein, 10 aa, Artificial Sequence
  Synthetic construct
PARLTPPSPP

SEQ ID NO: 35293 - protein, 10 aa, Artificial Sequence
  Synthetic construct
PARLTPFSPP

SEQ ID NO: 35294 - protein, 10 aa, Artificial Sequence
  Synthetic construct
AARATPPSPP

SEQ ID NO: 35295 - protein, 10 aa, Artificial Sequence
  Synthetic construct
AARATPFSPP

SEQ ID NO: 35296 - protein, 10 aa, Artificial Sequence
  Synthetic construct
AARPTPPSPP

SEQ ID NO: 35297 - protein, 10 aa, Artificial Sequence
  Synthetic construct
AARPTPFSPP

SEQ ID NO: 35298 - protein, 10 aa, Artificial Sequence
  Synthetic construct
AARWTPPSPP

SEQ ID NO: 35299 - protein, 10 aa, Artificial Sequence
  Synthetic construct
AARWTPFSPP

SEQ ID NO: 35300 - protein, 10 aa, Artificial Sequence
  Synthetic construct
AARNTPPSPP

SEQ ID NO: 35301 - protein, 10 aa, Artificial Sequence
  Synthetic construct
AARNTPFSPP

SEQ ID NO: 35302 - protein, 10 aa, Artificial Sequence
  Synthetic construct
AARLTPPSPP

SEQ ID NO: 35303 - protein, 10 aa, Artificial Sequence
  Synthetic construct
AARLTPFSPP

SEQ ID NO: 35304 - protein, 8 aa, Artificial Sequence
  Synthetic construct
PATAYKPP

SEQ ID NO: 35305 - protein, 8 aa, Artificial Sequence
  Synthetic construct
PATAYKPF

SEQ ID NO: 35306 - protein, 8 aa, Artificial Sequence
  Synthetic construct
PPTAYKPP

SEQ ID NO: 35307 - protein, 8 aa, Artificial Sequence
  Synthetic construct
PPTAYKPF

SEQ ID NO: 35308 - protein, 8 aa, Artificial Sequence
  Synthetic construct
PWTAYKPP

SEQ ID NO: 35309 - protein, 8 aa, Artificial Sequence
  Synthetic construct
PWTAYKPF

SEQ ID NO: 35310 - protein, 8 aa, Artificial Sequence
  Synthetic construct
PNTAYKPP

SEQ ID NO: 35311 - protein, 8 aa, Artificial Sequence
  Synthetic construct
PNTAYKPF

SEQ ID NO: 35312 - protein, 8 aa, Artificial Sequence
  Synthetic construct
PLTAYKPP

SEQ ID NO: 35313 - protein, 8 aa, Artificial Sequence
  Synthetic construct
PLTAYKPF

SEQ ID NO: 35314 - protein, 8 aa, Artificial Sequence
  Synthetic construct
AATAYKPP

SEQ ID NO: 35315 - protein, 8 aa, Artificial Sequence
  Synthetic construct
AATAYKPF

SEQ ID NO: 35316 - protein, 8 aa, Artificial Sequence
  Synthetic construct
APTAYKPP

SEQ ID NO: 35317 - protein, 8 aa, Artificial Sequence
  Synthetic construct
APTAYKPF

SEQ ID NO: 35318 - protein, 8 aa, Artificial Sequence
  Synthetic construct
AWTAYKPP

SEQ ID NO: 35319 - protein, 8 aa, Artificial Sequence
  Synthetic construct
AWTAYKPF

SEQ ID NO: 35320 - protein, 8 aa, Artificial Sequence
  Synthetic construct
ANTAYKPP

SEQ ID NO: 35321 - protein, 8 aa, Artificial Sequence
  Synthetic construct
ANTAYKPF

SEQ ID NO: 35322 - protein, 8 aa, Artificial Sequence
  Synthetic construct
ALTAYKPP

SEQ ID NO: 35323 - protein, 8 aa, Artificial Sequence
  Synthetic construct
ALTAYKPF

SEQ ID NO: 35324 - protein, 10 aa, Artificial Sequence
  Synthetic construct
NAFPAPYIWR

SEQ ID NO: 35325 - protein, 10 aa, Artificial Sequence
  Synthetic construct
NAFPAPYIWQ

SEQ ID NO: 35326 - protein, 10 aa, Artificial Sequence
  Synthetic construct
NAFPAPYIQR

SEQ ID NO: 35327 - protein, 10 aa, Artificial Sequence
  Synthetic construct
NAFPAPYIQQ

SEQ ID NO: 35328 - protein, 10 aa, Artificial Sequence
  Synthetic construct
NAFPAPAIWR

SEQ ID NO: 35329 - protein, 10 aa, Artificial Sequence
  Synthetic construct
NAFPAPAIWQ

SEQ ID NO: 35330 - protein, 10 aa, Artificial Sequence
  Synthetic construct
NAFPAPAIQR

SEQ ID NO: 35331 - protein, 10 aa, Artificial Sequence
  Synthetic construct
NAFPAPAIQQ

SEQ ID NO: 35332 - protein, 10 aa, Artificial Sequence
  Synthetic construct
NAFHAPYIWR

SEQ ID NO: 35333 - protein, 10 aa, Artificial Sequence
  Synthetic construct
NAFHAPYIWQ

SEQ ID NO: 35334 - protein, 10 aa, Artificial Sequence
  Synthetic construct
NAFHAPYIQR

SEQ ID NO: 35335 - protein, 10 aa, Artificial Sequence
  Synthetic construct
NAFHAPYIQQ

SEQ ID NO: 35336 - protein, 10 aa, Artificial Sequence
  Synthetic construct
NAFHAPAIWR

SEQ ID NO: 35337 - protein, 10 aa, Artificial Sequence
  Synthetic construct
NAFHAPAIWQ

SEQ ID NO: 35338 - protein, 10 aa, Artificial Sequence
  Synthetic construct
NAFHAPAIQR

SEQ ID NO: 35339 - protein, 10 aa, Artificial Sequence
  Synthetic construct
NAFHAPAIQQ

SEQ ID NO: 35340 - protein, 10 aa, Artificial Sequence
  Synthetic construct
NAFYAPYIWR

SEQ ID NO: 35341 - protein, 10 aa, Artificial Sequence
  Synthetic construct
NAFYAPYIWQ

SEQ ID NO: 35342 - protein, 10 aa, Artificial Sequence
  Synthetic construct
NAFYAPYIQR

SEQ ID NO: 35343 - protein, 10 aa, Artificial Sequence
  Synthetic construct
NAFYAPYIQQ

SEQ ID NO: 35344 - protein, 10 aa, Artificial Sequence
  Synthetic construct
NAFYAPAIWR

SEQ ID NO: 35345 - protein, 10 aa, Artificial Sequence
  Synthetic construct
NAFYAPAIWQ

SEQ ID NO: 35346 - protein, 10 aa, Artificial Sequence
  Synthetic construct
NAFYAPAIQR

SEQ ID NO: 35347 - protein, 10 aa, Artificial Sequence
  Synthetic construct
NAFYAPAIQQ

SEQ ID NO: 35348 - protein, 10 aa, Artificial Sequence
  Synthetic construct
NAFWAPYIWR

SEQ ID NO: 35349 - protein, 10 aa, Artificial Sequence
  Synthetic construct
NAFWAPYIWQ

SEQ ID NO: 35350 - protein, 10 aa, Artificial Sequence
  Synthetic construct
NAFWAPYIQR

SEQ ID NO: 35351 - protein, 10 aa, Artificial Sequence
  Synthetic construct
NAFWAPYIQQ

SEQ ID NO: 35352 - protein, 10 aa, Artificial Sequence
  Synthetic construct
NAFWAPAIWR

SEQ ID NO: 35353 - protein, 10 aa, Artificial Sequence
  Synthetic construct
NAFWAPAIWQ

SEQ ID NO: 35354 - protein, 10 aa, Artificial Sequence
  Synthetic construct
NAFWAPAIQR

SEQ ID NO: 35355 - protein, 10 aa, Artificial Sequence
  Synthetic construct
NAFWAPAIQQ

SEQ ID NO: 35356 - protein, 10 aa, Artificial Sequence
  Synthetic construct
NAFAAPYIWR

SEQ ID NO: 35357 - protein, 10 aa, Artificial Sequence
  Synthetic construct
NAFAAPYIWQ

SEQ ID NO: 35358 - protein, 10 aa, Artificial Sequence
  Synthetic construct
NAFAAPYIQR

SEQ ID NO: 35359 - protein, 10 aa, Artificial Sequence
  Synthetic construct
NAFAAPYIQQ

SEQ ID NO: 35360 - protein, 10 aa, Artificial Sequence
  Synthetic construct
NAFAAPAIWR

SEQ ID NO: 35361 - protein, 10 aa, Artificial Sequence
  Synthetic construct
NAFAAPAIWQ

SEQ ID NO: 35362 - protein, 10 aa, Artificial Sequence
  Synthetic construct
NAFAAPAIQR

SEQ ID NO: 35363 - protein, 10 aa, Artificial Sequence
  Synthetic construct
NAFAAPAIQQ

SEQ ID NO: 35364 - protein, 10 aa, Artificial Sequence
  Synthetic construct
NANPAPYIWR

SEQ ID NO: 35365 - protein, 10 aa, Artificial Sequence
  Synthetic construct
NANPAPYIWQ

SEQ ID NO: 35366 - protein, 10 aa, Artificial Sequence
  Synthetic construct
NANPAPYIQR

SEQ ID NO: 35367 - protein, 10 aa, Artificial Sequence
  Synthetic construct
NANPAPYIQQ

SEQ ID NO: 35368 - protein, 10 aa, Artificial Sequence
  Synthetic construct
NANPAPAIWR

SEQ ID NO: 35369 - protein, 10 aa, Artificial Sequence
  Synthetic construct
NANPAPAIWQ

SEQ ID NO: 35370 - protein, 10 aa, Artificial Sequence
  Synthetic construct
NANPAPAIQR

SEQ ID NO: 35371 - protein, 10 aa, Artificial Sequence
  Synthetic construct
NANPAPAIQQ

SEQ ID NO: 35372 - protein, 10 aa, Artificial Sequence
  Synthetic construct
NANHAPYIWR

SEQ ID NO: 35373 - protein, 10 aa, Artificial Sequence
  Synthetic construct
NANHAPYIWQ

SEQ ID NO: 35374 - protein, 10 aa, Artificial Sequence
  Synthetic construct
NANHAPYIQR

SEQ ID NO: 35375 - protein, 10 aa, Artificial Sequence
  Synthetic construct
NANHAPYIQQ

SEQ ID NO: 35376 - protein, 10 aa, Artificial Sequence
  Synthetic construct
NANHAPAIWR

SEQ ID NO: 35377 - protein, 10 aa, Artificial Sequence
  Synthetic construct
NANHAPAIWQ

SEQ ID NO: 35378 - protein, 10 aa, Artificial Sequence
  Synthetic construct
NANHAPAIQR

SEQ ID NO: 35379 - protein, 10 aa, Artificial Sequence
  Synthetic construct
NANHAPAIQQ

SEQ ID NO: 35380 - protein, 10 aa, Artificial Sequence
  Synthetic construct
NANYAPYIWR

SEQ ID NO: 35381 - protein, 10 aa, Artificial Sequence
  Synthetic construct
NANYAPYIWQ

SEQ ID NO: 35382 - protein, 10 aa, Artificial Sequence
  Synthetic construct
NANYAPYIQR

SEQ ID NO: 35383 - protein, 10 aa, Artificial Sequence
  Synthetic construct
NANYAPYIQQ

SEQ ID NO: 35384 - protein, 10 aa, Artificial Sequence
  Synthetic construct
NANYAPAIWR

SEQ ID NO: 35385 - protein, 10 aa, Artificial Sequence
  Synthetic construct
NANYAPAIWQ

SEQ ID NO: 35386 - protein, 10 aa, Artificial Sequence
  Synthetic construct
NANYAPAIQR

SEQ ID NO: 35387 - protein, 10 aa, Artificial Sequence
  Synthetic construct
NANYAPAIQQ

SEQ ID NO: 35388 - protein, 10 aa, Artificial Sequence
  Synthetic construct
NANWAPYIWR

SEQ ID NO: 35389 - protein, 10 aa, Artificial Sequence
  Synthetic construct
NANWAPYIWQ

SEQ ID NO: 35390 - protein, 10 aa, Artificial Sequence
  Synthetic construct
NANWAPYIQR

SEQ ID NO: 35391 - protein, 10 aa, Artificial Sequence
  Synthetic construct
NANWAPYIQQ

SEQ ID NO: 35392 - protein, 10 aa, Artificial Sequence
  Synthetic construct
NANWAPAIWR

SEQ ID NO: 35393 - protein, 10 aa, Artificial Sequence
  Synthetic construct
NANWAPAIWQ

SEQ ID NO: 35394 - protein, 10 aa, Artificial Sequence
  Synthetic construct
NANWAPAIQR

SEQ ID NO: 35395 - protein, 10 aa, Artificial Sequence
  Synthetic construct
NANWAPAIQQ

SEQ ID NO: 35396 - protein, 10 aa, Artificial Sequence
  Synthetic construct
NANAAPYIWR

SEQ ID NO: 35397 - protein, 10 aa, Artificial Sequence
  Synthetic construct
NANAAPYIWQ

SEQ ID NO: 35398 - protein, 10 aa, Artificial Sequence
  Synthetic construct
NANAAPYIQR

SEQ ID NO: 35399 - protein, 10 aa, Artificial Sequence
  Synthetic construct
NANAAPYIQQ

SEQ ID NO: 35400 - protein, 10 aa, Artificial Sequence
  Synthetic construct
NANAAPAIWR

SEQ ID NO: 35401 - protein, 10 aa, Artificial Sequence
  Synthetic construct
NANAAPAIWQ

SEQ ID NO: 35402 - protein, 10 aa, Artificial Sequence
  Synthetic construct
NANAAPAIQR

SEQ ID NO: 35403 - protein, 10 aa, Artificial Sequence
  Synthetic construct
NANAAPAIQQ

SEQ ID NO: 35404 - protein, 10 aa, Artificial Sequence
  Synthetic construct
NAYPAPYIWR

SEQ ID NO: 35405 - protein, 10 aa, Artificial Sequence
  Synthetic construct
NAYPAPYIWQ

SEQ ID NO: 35406 - protein, 10 aa, Artificial Sequence
  Synthetic construct
NAYPAPYIQR

SEQ ID NO: 35407 - protein, 10 aa, Artificial Sequence
  Synthetic construct
NAYPAPYIQQ

SEQ ID NO: 35408 - protein, 10 aa, Artificial Sequence
  Synthetic construct
NAYPAPAIWR

SEQ ID NO: 35409 - protein, 10 aa, Artificial Sequence
  Synthetic construct
NAYPAPAIWQ

SEQ ID NO: 35410 - protein, 10 aa, Artificial Sequence
  Synthetic construct
NAYPAPAIQR

SEQ ID NO: 35411 - protein, 10 aa, Artificial Sequence
  Synthetic construct
NAYPAPAIQQ

SEQ ID NO: 35412 - protein, 10 aa, Artificial Sequence
  Synthetic construct
NAYHAPYIWR

SEQ ID NO: 35413 - protein, 10 aa, Artificial Sequence
  Synthetic construct
NAYHAPYIWQ

SEQ ID NO: 35414 - protein, 10 aa, Artificial Sequence
  Synthetic construct
NAYHAPYIQR

SEQ ID NO: 35415 - protein, 10 aa, Artificial Sequence
  Synthetic construct
NAYHAPYIQQ

SEQ ID NO: 35416 - protein, 10 aa, Artificial Sequence
  Synthetic construct
NAYHAPAIWR

SEQ ID NO: 35417 - protein, 10 aa, Artificial Sequence
  Synthetic construct
NAYHAPAIWQ

SEQ ID NO: 35418 - protein, 10 aa, Artificial Sequence
  Synthetic construct
NAYHAPAIQR

SEQ ID NO: 35419 - protein, 10 aa, Artificial Sequence
  Synthetic construct
NAYHAPAIQQ

SEQ ID NO: 35420 - protein, 10 aa, Artificial Sequence
  Synthetic construct
NAYYAPYIWR

SEQ ID NO: 35421 - protein, 10 aa, Artificial Sequence
  Synthetic construct
NAYYAPYIWQ

SEQ ID NO: 35422 - protein, 10 aa, Artificial Sequence
  Synthetic construct
NAYYAPYIQR

SEQ ID NO: 35423 - protein, 10 aa, Artificial Sequence
  Synthetic construct
NAYYAPYIQQ

SEQ ID NO: 35424 - protein, 10 aa, Artificial Sequence
  Synthetic construct
NAYYAPAIWR

SEQ ID NO: 35425 - protein, 10 aa, Artificial Sequence
  Synthetic construct
NAYYAPAIWQ

SEQ ID NO: 35426 - protein, 10 aa, Artificial Sequence
  Synthetic construct
NAYYAPAIQR

SEQ ID NO: 35427 - protein, 10 aa, Artificial Sequence
  Synthetic construct
NAYYAPAIQQ

SEQ ID NO: 35428 - protein, 10 aa, Artificial Sequence
  Synthetic construct
NAYWAPYIWR

SEQ ID NO: 35429 - protein, 10 aa, Artificial Sequence
  Synthetic construct
NAYWAPYIWQ

SEQ ID NO: 35430 - protein, 10 aa, Artificial Sequence
  Synthetic construct
NAYWAPYIQR

SEQ ID NO: 35431 - protein, 10 aa, Artificial Sequence
  Synthetic construct
NAYWAPYIQQ

SEQ ID NO: 35432 - protein, 10 aa, Artificial Sequence
  Synthetic construct
NAYWAPAIWR

SEQ ID NO: 35433 - protein, 10 aa, Artificial Sequence
  Synthetic construct
NAYWAPAIWQ

SEQ ID NO: 35434 - protein, 10 aa, Artificial Sequence
  Synthetic construct
NAYWAPAIQR

SEQ ID NO: 35435 - protein, 10 aa, Artificial Sequence
  Synthetic construct
NAYWAPAIQQ

SEQ ID NO: 35436 - protein, 10 aa, Artificial Sequence
  Synthetic construct
NAYAAPYIWR

SEQ ID NO: 35437 - protein, 10 aa, Artificial Sequence
  Synthetic construct
NAYAAPYIWQ

SEQ ID NO: 35438 - protein, 10 aa, Artificial Sequence
  Synthetic construct
NAYAAPYIQR

SEQ ID NO: 35439 - protein, 10 aa, Artificial Sequence
  Synthetic construct
NAYAAPYIQQ

SEQ ID NO: 35440 - protein, 10 aa, Artificial Sequence
  Synthetic construct
NAYAAPAIWR

SEQ ID NO: 35441 - protein, 10 aa, Artificial Sequence
  Synthetic construct
NAYAAPAIWQ

SEQ ID NO: 35442 - protein, 10 aa, Artificial Sequence
  Synthetic construct
NAYAAPAIQR

SEQ ID NO: 35443 - protein, 10 aa, Artificial Sequence
  Synthetic construct
NAYAAPAIQQ

SEQ ID NO: 35444 - protein, 10 aa, Artificial Sequence
  Synthetic construct
NAPPAPYIWR

SEQ ID NO: 35445 - protein, 10 aa, Artificial Sequence
  Synthetic construct
NAPPAPYIWQ

SEQ ID NO: 35446 - protein, 10 aa, Artificial Sequence
  Synthetic construct
NAPPAPYIQR

SEQ ID NO: 35447 - protein, 10 aa, Artificial Sequence
  Synthetic construct
NAPPAPYIQQ

SEQ ID NO: 35448 - protein, 10 aa, Artificial Sequence
  Synthetic construct
NAPPAPAIWR

SEQ ID NO: 35449 - protein, 10 aa, Artificial Sequence
  Synthetic construct
NAPPAPAIWQ

SEQ ID NO: 35450 - protein, 10 aa, Artificial Sequence
  Synthetic construct
NAPPAPAIQR

SEQ ID NO: 35451 - protein, 10 aa, Artificial Sequence
  Synthetic construct
NAPPAPAIQQ

SEQ ID NO: 35452 - protein, 10 aa, Artificial Sequence
  Synthetic construct
NAPHAPYIWR

SEQ ID NO: 35453 - protein, 10 aa, Artificial Sequence
  Synthetic construct
NAPHAPYIWQ

SEQ ID NO: 35454 - protein, 10 aa, Artificial Sequence
  Synthetic construct
NAPHAPYIQR

SEQ ID NO: 35455 - protein, 10 aa, Artificial Sequence
  Synthetic construct
NAPHAPYIQQ

SEQ ID NO: 35456 - protein, 10 aa, Artificial Sequence
  Synthetic construct
NAPHAPAIWR

SEQ ID NO: 35457 - protein, 10 aa, Artificial Sequence
  Synthetic construct
NAPHAPAIWQ

SEQ ID NO: 35458 - protein, 10 aa, Artificial Sequence
  Synthetic construct
NAPHAPAIQR

SEQ ID NO: 35459 - protein, 10 aa, Artificial Sequence
  Synthetic construct
NAPHAPAIQQ

SEQ ID NO: 35460 - protein, 10 aa, Artificial Sequence
  Synthetic construct
NAPYAPYIWR

SEQ ID NO: 35461 - protein, 10 aa, Artificial Sequence
  Synthetic construct
NAPYAPYIWQ

SEQ ID NO: 35462 - protein, 10 aa, Artificial Sequence
  Synthetic construct
NAPYAPYIQR

SEQ ID NO: 35463 - protein, 10 aa, Artificial Sequence
  Synthetic construct
NAPYAPYIQQ

SEQ ID NO: 35464 - protein, 10 aa, Artificial Sequence
  Synthetic construct
NAPYAPAIWR

SEQ ID NO: 35465 - protein, 10 aa, Artificial Sequence
  Synthetic construct
NAPYAPAIWQ

SEQ ID NO: 35466 - protein, 10 aa, Artificial Sequence
  Synthetic construct
NAPYAPAIQR

SEQ ID NO: 35467 - protein, 10 aa, Artificial Sequence
  Synthetic construct
NAPYAPAIQQ

SEQ ID NO: 35468 - protein, 10 aa, Artificial Sequence
  Synthetic construct
NAPWAPYIWR

SEQ ID NO: 35469 - protein, 10 aa, Artificial Sequence
  Synthetic construct
NAPWAPYIWQ

SEQ ID NO: 35470 - protein, 10 aa, Artificial Sequence
  Synthetic construct
NAPWAPYIQR

SEQ ID NO: 35471 - protein, 10 aa, Artificial Sequence
  Synthetic construct
NAPWAPYIQQ

SEQ ID NO: 35472 - protein, 10 aa, Artificial Sequence
  Synthetic construct
NAPWAPAIWR

SEQ ID NO: 35473 - protein, 10 aa, Artificial Sequence
  Synthetic construct
NAPWAPAIWQ

SEQ ID NO: 35474 - protein, 10 aa, Artificial Sequence
  Synthetic construct
NAPWAPAIQR

SEQ ID NO: 35475 - protein, 10 aa, Artificial Sequence
  Synthetic construct
NAPWAPAIQQ

SEQ ID NO: 35476 - protein, 10 aa, Artificial Sequence
  Synthetic construct
NAPAAPYIWR

SEQ ID NO: 35477 - protein, 10 aa, Artificial Sequence
  Synthetic construct
NAPAAPYIWQ

SEQ ID NO: 35478 - protein, 10 aa, Artificial Sequence
  Synthetic construct
NAPAAPYIQR

SEQ ID NO: 35479 - protein, 10 aa, Artificial Sequence
  Synthetic construct
NAPAAPYIQQ

SEQ ID NO: 35480 - protein, 10 aa, Artificial Sequence
  Synthetic construct
NAPAAPAIWR

SEQ ID NO: 35481 - protein, 10 aa, Artificial Sequence
  Synthetic construct
NAPAAPAIWQ

SEQ ID NO: 35482 - protein, 10 aa, Artificial Sequence
  Synthetic construct
NAPAAPAIQR

SEQ ID NO: 35483 - protein, 10 aa, Artificial Sequence
  Synthetic construct
NAPAAPAIQQ

SEQ ID NO: 35484 - protein, 10 aa, Artificial Sequence
  Synthetic construct
WAFPAPYIWR

SEQ ID NO: 35485 - protein, 10 aa, Artificial Sequence
  Synthetic construct
WAFPAPYIWQ

SEQ ID NO: 35486 - protein, 10 aa, Artificial Sequence
  Synthetic construct
WAFPAPYIQR

SEQ ID NO: 35487 - protein, 10 aa, Artificial Sequence
  Synthetic construct
WAFPAPYIQQ

SEQ ID NO: 35488 - protein, 10 aa, Artificial Sequence
  Synthetic construct
WAFPAPAIWR

SEQ ID NO: 35489 - protein, 10 aa, Artificial Sequence
  Synthetic construct
WAFPAPAIWQ

SEQ ID NO: 35490 - protein, 10 aa, Artificial Sequence
  Synthetic construct
WAFPAPAIQR

SEQ ID NO: 35491 - protein, 10 aa, Artificial Sequence
  Synthetic construct
WAFPAPAIQQ

SEQ ID NO: 35492 - protein, 10 aa, Artificial Sequence
  Synthetic construct
WAFHAPYIWR

SEQ ID NO: 35493 - protein, 10 aa, Artificial Sequence
  Synthetic construct
WAFHAPYIWQ

SEQ ID NO: 35494 - protein, 10 aa, Artificial Sequence
  Synthetic construct
WAFHAPYIQR

SEQ ID NO: 35495 - protein, 10 aa, Artificial Sequence
  Synthetic construct
WAFHAPYIQQ

SEQ ID NO: 35496 - protein, 10 aa, Artificial Sequence
  Synthetic construct
WAFHAPAIWR

SEQ ID NO: 35497 - protein, 10 aa, Artificial Sequence
  Synthetic construct
WAFHAPAIWQ

SEQ ID NO: 35498 - protein, 10 aa, Artificial Sequence
  Synthetic construct
WAFHAPAIQR

SEQ ID NO: 35499 - protein, 10 aa, Artificial Sequence
  Synthetic construct
WAFHAPAIQQ

SEQ ID NO: 35500 - protein, 10 aa, Artificial Sequence
  Synthetic construct
WAFYAPYIWR

SEQ ID NO: 35501 - protein, 10 aa, Artificial Sequence
  Synthetic construct
WAFYAPYIWQ

SEQ ID NO: 35502 - protein, 10 aa, Artificial Sequence
  Synthetic construct
WAFYAPYIQR

SEQ ID NO: 35503 - protein, 10 aa, Artificial Sequence
  Synthetic construct
WAFYAPYIQQ

SEQ ID NO: 35504 - protein, 10 aa, Artificial Sequence
  Synthetic construct
WAFYAPAIWR

SEQ ID NO: 35505 - protein, 10 aa, Artificial Sequence
  Synthetic construct
WAFYAPAIWQ

SEQ ID NO: 35506 - protein, 10 aa, Artificial Sequence
  Synthetic construct
WAFYAPAIQR

SEQ ID NO: 35507 - protein, 10 aa, Artificial Sequence
  Synthetic construct
WAFYAPAIQQ

SEQ ID NO: 35508 - protein, 10 aa, Artificial Sequence
  Synthetic construct
WAFWAPYIWR

SEQ ID NO: 35509 - protein, 10 aa, Artificial Sequence
  Synthetic construct
WAFWAPYIWQ

SEQ ID NO: 35510 - protein, 10 aa, Artificial Sequence
  Synthetic construct
WAFWAPYIQR

SEQ ID NO: 35511 - protein, 10 aa, Artificial Sequence
  Synthetic construct
WAFWAPYIQQ

SEQ ID NO: 35512 - protein, 10 aa, Artificial Sequence
  Synthetic construct
WAFWAPAIWR

SEQ ID NO: 35513 - protein, 10 aa, Artificial Sequence
  Synthetic construct
WAFWAPAIWQ

SEQ ID NO: 35514 - protein, 10 aa, Artificial Sequence
  Synthetic construct
WAFWAPAIQR

SEQ ID NO: 35515 - protein, 10 aa, Artificial Sequence
  Synthetic construct
WAFWAPAIQQ

SEQ ID NO: 35516 - protein, 10 aa, Artificial Sequence
  Synthetic construct
WAFAAPYIWR

SEQ ID NO: 35517 - protein, 10 aa, Artificial Sequence
  Synthetic construct
WAFAAPYIWQ

SEQ ID NO: 35518 - protein, 10 aa, Artificial Sequence
  Synthetic construct
WAFAAPYIQR

SEQ ID NO: 35519 - protein, 10 aa, Artificial Sequence
  Synthetic construct
WAFAAPYIQQ

SEQ ID NO: 35520 - protein, 10 aa, Artificial Sequence
  Synthetic construct
WAFAAPAIWR

SEQ ID NO: 35521 - protein, 10 aa, Artificial Sequence
  Synthetic construct
WAFAAPAIWQ

SEQ ID NO: 35522 - protein, 10 aa, Artificial Sequence
  Synthetic construct
WAFAAPAIQR

SEQ ID NO: 35523 - protein, 10 aa, Artificial Sequence
  Synthetic construct
WAFAAPAIQQ

SEQ ID NO: 35524 - protein, 10 aa, Artificial Sequence
  Synthetic construct
WANPAPYIWR

SEQ ID NO: 35525 - protein, 10 aa, Artificial Sequence
  Synthetic construct
WANPAPYIWQ

SEQ ID NO: 35526 - protein, 10 aa, Artificial Sequence
  Synthetic construct
WANPAPYIQR

SEQ ID NO: 35527 - protein, 10 aa, Artificial Sequence
  Synthetic construct
WANPAPYIQQ

SEQ ID NO: 35528 - protein, 10 aa, Artificial Sequence
  Synthetic construct
WANPAPAIWR

SEQ ID NO: 35529 - protein, 10 aa, Artificial Sequence
  Synthetic construct
WANPAPAIWQ

SEQ ID NO: 35530 - protein, 10 aa, Artificial Sequence
  Synthetic construct
WANPAPAIQR

SEQ ID NO: 35531 - protein, 10 aa, Artificial Sequence
  Synthetic construct
WANPAPAIQQ

SEQ ID NO: 35532 - protein, 10 aa, Artificial Sequence
  Synthetic construct
WANHAPYIWR

SEQ ID NO: 35533 - protein, 10 aa, Artificial Sequence
  Synthetic construct
WANHAPYIWQ

SEQ ID NO: 35534 - protein, 10 aa, Artificial Sequence
  Synthetic construct
WANHAPYIQR

SEQ ID NO: 35535 - protein, 10 aa, Artificial Sequence
  Synthetic construct
WANHAPYIQQ

SEQ ID NO: 35536 - protein, 10 aa, Artificial Sequence
  Synthetic construct
WANHAPAIWR

SEQ ID NO: 35537 - protein, 10 aa, Artificial Sequence
  Synthetic construct
WANHAPAIWQ

SEQ ID NO: 35538 - protein, 10 aa, Artificial Sequence
  Synthetic construct
WANHAPAIQR

SEQ ID NO: 35539 - protein, 10 aa, Artificial Sequence
  Synthetic construct
WANHAPAIQQ

SEQ ID NO: 35540 - protein, 10 aa, Artificial Sequence
  Synthetic construct
WANYAPYIWR

SEQ ID NO: 35541 - protein, 10 aa, Artificial Sequence
  Synthetic construct
WANYAPYIWQ

SEQ ID NO: 35542 - protein, 10 aa, Artificial Sequence
  Synthetic construct
WANYAPYIQR

SEQ ID NO: 35543 - protein, 10 aa, Artificial Sequence
  Synthetic construct
WANYAPYIQQ

SEQ ID NO: 35544 - protein, 10 aa, Artificial Sequence
  Synthetic construct
WANYAPAIWR

SEQ ID NO: 35545 - protein, 10 aa, Artificial Sequence
  Synthetic construct
WANYAPAIWQ

SEQ ID NO: 35546 - protein, 10 aa, Artificial Sequence
  Synthetic construct
WANYAPAIQR

SEQ ID NO: 35547 - protein, 10 aa, Artificial Sequence
  Synthetic construct
WANYAPAIQQ

SEQ ID NO: 35548 - protein, 10 aa, Artificial Sequence
  Synthetic construct
WANWAPYIWR

SEQ ID NO: 35549 - protein, 10 aa, Artificial Sequence
  Synthetic construct
WANWAPYIWQ

SEQ ID NO: 35550 - protein, 10 aa, Artificial Sequence
  Synthetic construct
WANWAPYIQR

SEQ ID NO: 35551 - protein, 10 aa, Artificial Sequence
  Synthetic construct
WANWAPYIQQ

SEQ ID NO: 35552 - protein, 10 aa, Artificial Sequence
  Synthetic construct
WANWAPAIWR

SEQ ID NO: 35553 - protein, 10 aa, Artificial Sequence
  Synthetic construct
WANWAPAIWQ

SEQ ID NO: 35554 - protein, 10 aa, Artificial Sequence
  Synthetic construct
WANWAPAIQR

SEQ ID NO: 35555 - protein, 10 aa, Artificial Sequence
  Synthetic construct
WANWAPAIQQ

SEQ ID NO: 35556 - protein, 10 aa, Artificial Sequence
  Synthetic construct
WANAAPYIWR

SEQ ID NO: 35557 - protein, 10 aa, Artificial Sequence
  Synthetic construct
WANAAPYIWQ

SEQ ID NO: 35558 - protein, 10 aa, Artificial Sequence
  Synthetic construct
WANAAPYIQR

SEQ ID NO: 35559 - protein, 10 aa, Artificial Sequence
  Synthetic construct
WANAAPYIQQ

SEQ ID NO: 35560 - protein, 10 aa, Artificial Sequence
  Synthetic construct
WANAAPAIWR

SEQ ID NO: 35561 - protein, 10 aa, Artificial Sequence
  Synthetic construct
WANAAPAIWQ

SEQ ID NO: 35562 - protein, 10 aa, Artificial Sequence
  Synthetic construct
WANAAPAIQR

SEQ ID NO: 35563 - protein, 10 aa, Artificial Sequence
  Synthetic construct
WANAAPAIQQ

SEQ ID NO: 35564 - protein, 10 aa, Artificial Sequence
  Synthetic construct
WAYPAPYIWR

SEQ ID NO: 35565 - protein, 10 aa, Artificial Sequence
  Synthetic construct
WAYPAPYIWQ

SEQ ID NO: 35566 - protein, 10 aa, Artificial Sequence
  Synthetic construct
WAYPAPYIQR

SEQ ID NO: 35567 - protein, 10 aa, Artificial Sequence
  Synthetic construct
WAYPAPYIQQ

SEQ ID NO: 35568 - protein, 10 aa, Artificial Sequence
  Synthetic construct
WAYPAPAIWR

SEQ ID NO: 35569 - protein, 10 aa, Artificial Sequence
  Synthetic construct
WAYPAPAIWQ

SEQ ID NO: 35570 - protein, 10 aa, Artificial Sequence
  Synthetic construct
WAYPAPAIQR

SEQ ID NO: 35571 - protein, 10 aa, Artificial Sequence
  Synthetic construct
WAYPAPAIQQ

SEQ ID NO: 35572 - protein, 10 aa, Artificial Sequence
  Synthetic construct
WAYHAPYIWR

SEQ ID NO: 35573 - protein, 10 aa, Artificial Sequence
  Synthetic construct
WAYHAPYIWQ

SEQ ID NO: 35574 - protein, 10 aa, Artificial Sequence
  Synthetic construct
WAYHAPYIQR

SEQ ID NO: 35575 - protein, 10 aa, Artificial Sequence
  Synthetic construct
WAYHAPYIQQ

SEQ ID NO: 35576 - protein, 10 aa, Artificial Sequence
  Synthetic construct
WAYHAPAIWR

SEQ ID NO: 35577 - protein, 10 aa, Artificial Sequence
  Synthetic construct
WAYHAPAIWQ

SEQ ID NO: 35578 - protein, 10 aa, Artificial Sequence
  Synthetic construct
WAYHAPAIQR

SEQ ID NO: 35579 - protein, 10 aa, Artificial Sequence
  Synthetic construct
WAYHAPAIQQ

SEQ ID NO: 35580 - protein, 10 aa, Artificial Sequence
  Synthetic construct
WAYYAPYIWR

SEQ ID NO: 35581 - protein, 10 aa, Artificial Sequence
  Synthetic construct
WAYYAPYIWQ

SEQ ID NO: 35582 - protein, 10 aa, Artificial Sequence
  Synthetic construct
WAYYAPYIQR

SEQ ID NO: 35583 - protein, 10 aa, Artificial Sequence
  Synthetic construct
WAYYAPYIQQ

SEQ ID NO: 35584 - protein, 10 aa, Artificial Sequence
  Synthetic construct
WAYYAPAIWR

SEQ ID NO: 35585 - protein, 10 aa, Artificial Sequence
  Synthetic construct
WAYYAPAIWQ

SEQ ID NO: 35586 - protein, 10 aa, Artificial Sequence
  Synthetic construct
WAYYAPAIQR

SEQ ID NO: 35587 - protein, 10 aa, Artificial Sequence
  Synthetic construct
WAYYAPAIQQ

SEQ ID NO: 35588 - protein, 10 aa, Artificial Sequence
  Synthetic construct
WAYWAPYIWR

SEQ ID NO: 35589 - protein, 10 aa, Artificial Sequence
  Synthetic construct
WAYWAPYIWQ

SEQ ID NO: 35590 - protein, 10 aa, Artificial Sequence
  Synthetic construct
WAYWAPYIQR

SEQ ID NO: 35591 - protein, 10 aa, Artificial Sequence
  Synthetic construct
WAYWAPYIQQ

SEQ ID NO: 35592 - protein, 10 aa, Artificial Sequence
  Synthetic construct
WAYWAPAIWR

SEQ ID NO: 35593 - protein, 10 aa, Artificial Sequence
  Synthetic construct
WAYWAPAIWQ

SEQ ID NO: 35594 - protein, 10 aa, Artificial Sequence
  Synthetic construct
WAYWAPAIQR

SEQ ID NO: 35595 - protein, 10 aa, Artificial Sequence
  Synthetic construct
WAYWAPAIQQ

SEQ ID NO: 35596 - protein, 10 aa, Artificial Sequence
  Synthetic construct
WAYAAPYIWR

SEQ ID NO: 35597 - protein, 10 aa, Artificial Sequence
  Synthetic construct
WAYAAPYIWQ

SEQ ID NO: 35598 - protein, 10 aa, Artificial Sequence
  Synthetic construct
WAYAAPYIQR

SEQ ID NO: 35599 - protein, 10 aa, Artificial Sequence
  Synthetic construct
WAYAAPYIQQ

SEQ ID NO: 35600 - protein, 10 aa, Artificial Sequence
  Synthetic construct
WAYAAPAIWR

SEQ ID NO: 35601 - protein, 10 aa, Artificial Sequence
  Synthetic construct
WAYAAPAIWQ

SEQ ID NO: 35602 - protein, 10 aa, Artificial Sequence
  Synthetic construct
WAYAAPAIQR

SEQ ID NO: 35603 - protein, 10 aa, Artificial Sequence
  Synthetic construct
WAYAAPAIQQ

SEQ ID NO: 35604 - protein, 10 aa, Artificial Sequence
  Synthetic construct
WAPPAPYIWR

SEQ ID NO: 35605 - protein, 10 aa, Artificial Sequence
  Synthetic construct
WAPPAPYIWQ

SEQ ID NO: 35606 - protein, 10 aa, Artificial Sequence
  Synthetic construct
WAPPAPYIQR

SEQ ID NO: 35607 - protein, 10 aa, Artificial Sequence
  Synthetic construct
WAPPAPYIQQ

SEQ ID NO: 35608 - protein, 10 aa, Artificial Sequence
  Synthetic construct
WAPPAPAIWR

SEQ ID NO: 35609 - protein, 10 aa, Artificial Sequence
  Synthetic construct
WAPPAPAIWQ

SEQ ID NO: 35610 - protein, 10 aa, Artificial Sequence
  Synthetic construct
WAPPAPAIQR

SEQ ID NO: 35611 - protein, 10 aa, Artificial Sequence
  Synthetic construct
WAPPAPAIQQ

SEQ ID NO: 35612 - protein, 10 aa, Artificial Sequence
  Synthetic construct
WAPHAPYIWR

SEQ ID NO: 35613 - protein, 10 aa, Artificial Sequence
  Synthetic construct
WAPHAPYIWQ

SEQ ID NO: 35614 - protein, 10 aa, Artificial Sequence
  Synthetic construct
WAPHAPYIQR

SEQ ID NO: 35615 - protein, 10 aa, Artificial Sequence
  Synthetic construct
WAPHAPYIQQ

SEQ ID NO: 35616 - protein, 10 aa, Artificial Sequence
  Synthetic construct
WAPHAPAIWR

SEQ ID NO: 35617 - protein, 10 aa, Artificial Sequence
  Synthetic construct
WAPHAPAIWQ

SEQ ID NO: 35618 - protein, 10 aa, Artificial Sequence
  Synthetic construct
WAPHAPAIQR

SEQ ID NO: 35619 - protein, 10 aa, Artificial Sequence
  Synthetic construct
WAPHAPAIQQ

SEQ ID NO: 35620 - protein, 10 aa, Artificial Sequence
  Synthetic construct
WAPYAPYIWR

SEQ ID NO: 35621 - protein, 10 aa, Artificial Sequence
  Synthetic construct
WAPYAPYIWQ

SEQ ID NO: 35622 - protein, 10 aa, Artificial Sequence
  Synthetic construct
WAPYAPYIQR

SEQ ID NO: 35623 - protein, 10 aa, Artificial Sequence
  Synthetic construct
WAPYAPYIQQ

SEQ ID NO: 35624 - protein, 10 aa, Artificial Sequence
  Synthetic construct
WAPYAPAIWR

SEQ ID NO: 35625 - protein, 10 aa, Artificial Sequence
  Synthetic construct
WAPYAPAIWQ

SEQ ID NO: 35626 - protein, 10 aa, Artificial Sequence
  Synthetic construct
WAPYAPAIQR

SEQ ID NO: 35627 - protein, 10 aa, Artificial Sequence
  Synthetic construct
WAPYAPAIQQ

SEQ ID NO: 35628 - protein, 10 aa, Artificial Sequence
  Synthetic construct
WAPWAPYIWR

SEQ ID NO: 35629 - protein, 10 aa, Artificial Sequence
  Synthetic construct
WAPWAPYIWQ

SEQ ID NO: 35630 - protein, 10 aa, Artificial Sequence
  Synthetic construct
WAPWAPYIQR

SEQ ID NO: 35631 - protein, 10 aa, Artificial Sequence
  Synthetic construct
WAPWAPYIQQ

SEQ ID NO: 35632 - protein, 10 aa, Artificial Sequence
  Synthetic construct
WAPWAPAIWR

SEQ ID NO: 35633 - protein, 10 aa, Artificial Sequence
  Synthetic construct
WAPWAPAIWQ

SEQ ID NO: 35634 - protein, 10 aa, Artificial Sequence
  Synthetic construct
WAPWAPAIQR

SEQ ID NO: 35635 - protein, 10 aa, Artificial Sequence
  Synthetic construct
WAPWAPAIQQ

SEQ ID NO: 35636 - protein, 10 aa, Artificial Sequence
  Synthetic construct
WAPAAPYIWR

SEQ ID NO: 35637 - protein, 10 aa, Artificial Sequence
  Synthetic construct
WAPAAPYIWQ

SEQ ID NO: 35638 - protein, 10 aa, Artificial Sequence
  Synthetic construct
WAPAAPYIQR

SEQ ID NO: 35639 - protein, 10 aa, Artificial Sequence
  Synthetic construct
WAPAAPYIQQ

SEQ ID NO: 35640 - protein, 10 aa, Artificial Sequence
  Synthetic construct
WAPAAPAIWR

SEQ ID NO: 35641 - protein, 10 aa, Artificial Sequence
  Synthetic construct
WAPAAPAIWQ

SEQ ID NO: 35642 - protein, 10 aa, Artificial Sequence
  Synthetic construct
WAPAAPAIQR

SEQ ID NO: 35643 - protein, 10 aa, Artificial Sequence
  Synthetic construct
WAPAAPAIQQ

SEQ ID NO: 35644 - protein, 10 aa, Artificial Sequence
  Synthetic construct
AAFPAPYIWR

SEQ ID NO: 35645 - protein, 10 aa, Artificial Sequence
  Synthetic construct
AAFPAPYIWQ

SEQ ID NO: 35646 - protein, 10 aa, Artificial Sequence
  Synthetic construct
AAFPAPYIQR

SEQ ID NO: 35647 - protein, 10 aa, Artificial Sequence
  Synthetic construct
AAFPAPYIQQ

SEQ ID NO: 35648 - protein, 10 aa, Artificial Sequence
  Synthetic construct
AAFPAPAIWR

SEQ ID NO: 35649 - protein, 10 aa, Artificial Sequence
  Synthetic construct
AAFPAPAIWQ

SEQ ID NO: 35650 - protein, 10 aa, Artificial Sequence
  Synthetic construct
AAFPAPAIQR

SEQ ID NO: 35651 - protein, 10 aa, Artificial Sequence
  Synthetic construct
AAFPAPAIQQ

SEQ ID NO: 35652 - protein, 10 aa, Artificial Sequence
  Synthetic construct
AAFHAPYIWR

SEQ ID NO: 35653 - protein, 10 aa, Artificial Sequence
  Synthetic construct
AAFHAPYIWQ

SEQ ID NO: 35654 - protein, 10 aa, Artificial Sequence
  Synthetic construct
AAFHAPYIQR

SEQ ID NO: 35655 - protein, 10 aa, Artificial Sequence
  Synthetic construct
AAFHAPYIQQ

SEQ ID NO: 35656 - protein, 10 aa, Artificial Sequence
  Synthetic construct
AAFHAPAIWR

SEQ ID NO: 35657 - protein, 10 aa, Artificial Sequence
  Synthetic construct
AAFHAPAIWQ

SEQ ID NO: 35658 - protein, 10 aa, Artificial Sequence
  Synthetic construct
AAFHAPAIQR

SEQ ID NO: 35659 - protein, 10 aa, Artificial Sequence
  Synthetic construct
AAFHAPAIQQ

SEQ ID NO: 35660 - protein, 10 aa, Artificial Sequence
  Synthetic construct
AAFYAPYIWR

SEQ ID NO: 35661 - protein, 10 aa, Artificial Sequence
  Synthetic construct
AAFYAPYIWQ

SEQ ID NO: 35662 - protein, 10 aa, Artificial Sequence
  Synthetic construct
AAFYAPYIQR

SEQ ID NO: 35663 - protein, 10 aa, Artificial Sequence
  Synthetic construct
AAFYAPYIQQ

SEQ ID NO: 35664 - protein, 10 aa, Artificial Sequence
  Synthetic construct
AAFYAPAIWR

SEQ ID NO: 35665 - protein, 10 aa, Artificial Sequence
  Synthetic construct
AAFYAPAIWQ

SEQ ID NO: 35666 - protein, 10 aa, Artificial Sequence
  Synthetic construct
AAFYAPAIQR

SEQ ID NO: 35667 - protein, 10 aa, Artificial Sequence
  Synthetic construct
AAFYAPAIQQ

SEQ ID NO: 35668 - protein, 10 aa, Artificial Sequence
  Synthetic construct
AAFWAPYIWR

SEQ ID NO: 35669 - protein, 10 aa, Artificial Sequence
  Synthetic construct
AAFWAPYIWQ

SEQ ID NO: 35670 - protein, 10 aa, Artificial Sequence
  Synthetic construct
AAFWAPYIQR

SEQ ID NO: 35671 - protein, 10 aa, Artificial Sequence
  Synthetic construct
AAFWAPYIQQ

SEQ ID NO: 35672 - protein, 10 aa, Artificial Sequence
  Synthetic construct
AAFWAPAIWR

SEQ ID NO: 35673 - protein, 10 aa, Artificial Sequence
  Synthetic construct
AAFWAPAIWQ

SEQ ID NO: 35674 - protein, 10 aa, Artificial Sequence
  Synthetic construct
AAFWAPAIQR

SEQ ID NO: 35675 - protein, 10 aa, Artificial Sequence
  Synthetic construct
AAFWAPAIQQ

SEQ ID NO: 35676 - protein, 10 aa, Artificial Sequence
  Synthetic construct
AAFAAPYIWR

SEQ ID NO: 35677 - protein, 10 aa, Artificial Sequence
  Synthetic construct
AAFAAPYIWQ

SEQ ID NO: 35678 - protein, 10 aa, Artificial Sequence
  Synthetic construct
AAFAAPYIQR

SEQ ID NO: 35679 - protein, 10 aa, Artificial Sequence
  Synthetic construct
AAFAAPYIQQ

SEQ ID NO: 35680 - protein, 10 aa, Artificial Sequence
  Synthetic construct
AAFAAPAIWR

SEQ ID NO: 35681 - protein, 10 aa, Artificial Sequence
  Synthetic construct
AAFAAPAIWQ

SEQ ID NO: 35682 - protein, 10 aa, Artificial Sequence
  Synthetic construct
AAFAAPAIQR

SEQ ID NO: 35683 - protein, 10 aa, Artificial Sequence
  Synthetic construct
AAFAAPAIQQ

SEQ ID NO: 35684 - protein, 10 aa, Artificial Sequence
  Synthetic construct
AANPAPYIWR

SEQ ID NO: 35685 - protein, 10 aa, Artificial Sequence
  Synthetic construct
AANPAPYIWQ

SEQ ID NO: 35686 - protein, 10 aa, Artificial Sequence
  Synthetic construct
AANPAPYIQR

SEQ ID NO: 35687 - protein, 10 aa, Artificial Sequence
  Synthetic construct
AANPAPYIQQ

SEQ ID NO: 35688 - protein, 10 aa, Artificial Sequence
  Synthetic construct
AANPAPAIWR

SEQ ID NO: 35689 - protein, 10 aa, Artificial Sequence
  Synthetic construct
AANPAPAIWQ

SEQ ID NO: 35690 - protein, 10 aa, Artificial Sequence
  Synthetic construct
AANPAPAIQR

SEQ ID NO: 35691 - protein, 10 aa, Artificial Sequence
  Synthetic construct
AANPAPAIQQ

SEQ ID NO: 35692 - protein, 10 aa, Artificial Sequence
  Synthetic construct
AANHAPYIWR

SEQ ID NO: 35693 - protein, 10 aa, Artificial Sequence
  Synthetic construct
AANHAPYIWQ

SEQ ID NO: 35694 - protein, 10 aa, Artificial Sequence
  Synthetic construct
AANHAPYIQR

SEQ ID NO: 35695 - protein, 10 aa, Artificial Sequence
  Synthetic construct
AANHAPYIQQ

SEQ ID NO: 35696 - protein, 10 aa, Artificial Sequence
  Synthetic construct
AANHAPAIWR

SEQ ID NO: 35697 - protein, 10 aa, Artificial Sequence
  Synthetic construct
AANHAPAIWQ

SEQ ID NO: 35698 - protein, 10 aa, Artificial Sequence
  Synthetic construct
AANHAPAIQR

SEQ ID NO: 35699 - protein, 10 aa, Artificial Sequence
  Synthetic construct
AANHAPAIQQ

SEQ ID NO: 35700 - protein, 10 aa, Artificial Sequence
  Synthetic construct
AANYAPYIWR

SEQ ID NO: 35701 - protein, 10 aa, Artificial Sequence
  Synthetic construct
AANYAPYIWQ

SEQ ID NO: 35702 - protein, 10 aa, Artificial Sequence
  Synthetic construct
AANYAPYIQR

SEQ ID NO: 35703 - protein, 10 aa, Artificial Sequence
  Synthetic construct
AANYAPYIQQ

SEQ ID NO: 35704 - protein, 10 aa, Artificial Sequence
  Synthetic construct
AANYAPAIWR

SEQ ID NO: 35705 - protein, 10 aa, Artificial Sequence
  Synthetic construct
AANYAPAIWQ

SEQ ID NO: 35706 - protein, 10 aa, Artificial Sequence
  Synthetic construct
AANYAPAIQR

SEQ ID NO: 35707 - protein, 10 aa, Artificial Sequence
  Synthetic construct
AANYAPAIQQ

SEQ ID NO: 35708 - protein, 10 aa, Artificial Sequence
  Synthetic construct
AANWAPYIWR

SEQ ID NO: 35709 - protein, 10 aa, Artificial Sequence
  Synthetic construct
AANWAPYIWQ

SEQ ID NO: 35710 - protein, 10 aa, Artificial Sequence
  Synthetic construct
AANWAPYIQR

SEQ ID NO: 35711 - protein, 10 aa, Artificial Sequence
  Synthetic construct
AANWAPYIQQ

SEQ ID NO: 35712 - protein, 10 aa, Artificial Sequence
  Synthetic construct
AANWAPAIWR

SEQ ID NO: 35713 - protein, 10 aa, Artificial Sequence
  Synthetic construct
AANWAPAIWQ

SEQ ID NO: 35714 - protein, 10 aa, Artificial Sequence
  Synthetic construct
AANWAPAIQR

SEQ ID NO: 35715 - protein, 10 aa, Artificial Sequence
  Synthetic construct
AANWAPAIQQ

SEQ ID NO: 35716 - protein, 10 aa, Artificial Sequence
  Synthetic construct
AANAAPYIWR

SEQ ID NO: 35717 - protein, 10 aa, Artificial Sequence
  Synthetic construct
AANAAPYIWQ

SEQ ID NO: 35718 - protein, 10 aa, Artificial Sequence
  Synthetic construct
AANAAPYIQR

SEQ ID NO: 35719 - protein, 10 aa, Artificial Sequence
  Synthetic construct
AANAAPYIQQ

SEQ ID NO: 35720 - protein, 10 aa, Artificial Sequence
  Synthetic construct
AANAAPAIWR

SEQ ID NO: 35721 - protein, 10 aa, Artificial Sequence
  Synthetic construct
AANAAPAIWQ

SEQ ID NO: 35722 - protein, 10 aa, Artificial Sequence
  Synthetic construct
AANAAPAIQR

SEQ ID NO: 35723 - protein, 10 aa, Artificial Sequence
  Synthetic construct
AANAAPAIQQ

SEQ ID NO: 35724 - protein, 10 aa, Artificial Sequence
  Synthetic construct
AAYPAPYIWR

SEQ ID NO: 35725 - protein, 10 aa, Artificial Sequence
  Synthetic construct
AAYPAPYIWQ

SEQ ID NO: 35726 - protein, 10 aa, Artificial Sequence
  Synthetic construct
AAYPAPYIQR

SEQ ID NO: 35727 - protein, 10 aa, Artificial Sequence
  Synthetic construct
AAYPAPYIQQ

SEQ ID NO: 35728 - protein, 10 aa, Artificial Sequence
  Synthetic construct
AAYPAPAIWR

SEQ ID NO: 35729 - protein, 10 aa, Artificial Sequence
  Synthetic construct
AAYPAPAIWQ

SEQ ID NO: 35730 - protein, 10 aa, Artificial Sequence
  Synthetic construct
AAYPAPAIQR

SEQ ID NO: 35731 - protein, 10 aa, Artificial Sequence
  Synthetic construct
AAYPAPAIQQ

SEQ ID NO: 35732 - protein, 10 aa, Artificial Sequence
  Synthetic construct
AAYHAPYIWR

SEQ ID NO: 35733 - protein, 10 aa, Artificial Sequence
  Synthetic construct
AAYHAPYIWQ

SEQ ID NO: 35734 - protein, 10 aa, Artificial Sequence
  Synthetic construct
AAYHAPYIQR

SEQ ID NO: 35735 - protein, 10 aa, Artificial Sequence
  Synthetic construct
AAYHAPYIQQ

SEQ ID NO: 35736 - protein, 10 aa, Artificial Sequence
  Synthetic construct
AAYHAPAIWR

SEQ ID NO: 35737 - protein, 10 aa, Artificial Sequence
  Synthetic construct
AAYHAPAIWQ

SEQ ID NO: 35738 - protein, 10 aa, Artificial Sequence
  Synthetic construct
AAYHAPAIQR

SEQ ID NO: 35739 - protein, 10 aa, Artificial Sequence
  Synthetic construct
AAYHAPAIQQ

SEQ ID NO: 35740 - protein, 10 aa, Artificial Sequence
  Synthetic construct
AAYYAPYIWR

SEQ ID NO: 35741 - protein, 10 aa, Artificial Sequence
  Synthetic construct
AAYYAPYIWQ

SEQ ID NO: 35742 - protein, 10 aa, Artificial Sequence
  Synthetic construct
AAYYAPYIQR

SEQ ID NO: 35743 - protein, 10 aa, Artificial Sequence
  Synthetic construct
AAYYAPYIQQ

SEQ ID NO: 35744 - protein, 10 aa, Artificial Sequence
  Synthetic construct
AAYYAPAIWR

SEQ ID NO: 35745 - protein, 10 aa, Artificial Sequence
  Synthetic construct
AAYYAPAIWQ

SEQ ID NO: 35746 - protein, 10 aa, Artificial Sequence
  Synthetic construct
AAYYAPAIQR

SEQ ID NO: 35747 - protein, 10 aa, Artificial Sequence
  Synthetic construct
AAYYAPAIQQ

SEQ ID NO: 35748 - protein, 10 aa, Artificial Sequence
  Synthetic construct
AAYWAPYIWR

SEQ ID NO: 35749 - protein, 10 aa, Artificial Sequence
  Synthetic construct
AAYWAPYIWQ

SEQ ID NO: 35750 - protein, 10 aa, Artificial Sequence
  Synthetic construct
AAYWAPYIQR

SEQ ID NO: 35751 - protein, 10 aa, Artificial Sequence
  Synthetic construct
AAYWAPYIQQ

SEQ ID NO: 35752 - protein, 10 aa, Artificial Sequence
  Synthetic construct
AAYWAPAIWR

SEQ ID NO: 35753 - protein, 10 aa, Artificial Sequence
  Synthetic construct
AAYWAPAIWQ

SEQ ID NO: 35754 - protein, 10 aa, Artificial Sequence
  Synthetic construct
AAYWAPAIQR

SEQ ID NO: 35755 - protein, 10 aa, Artificial Sequence
  Synthetic construct
AAYWAPAIQQ

SEQ ID NO: 35756 - protein, 10 aa, Artificial Sequence
  Synthetic construct
AAYAAPYIWR

SEQ ID NO: 35757 - protein, 10 aa, Artificial Sequence
  Synthetic construct
AAYAAPYIWQ

SEQ ID NO: 35758 - protein, 10 aa, Artificial Sequence
  Synthetic construct
AAYAAPYIQR

SEQ ID NO: 35759 - protein, 10 aa, Artificial Sequence
  Synthetic construct
AAYAAPYIQQ

SEQ ID NO: 35760 - protein, 10 aa, Artificial Sequence
  Synthetic construct
AAYAAPAIWR

SEQ ID NO: 35761 - protein, 10 aa, Artificial Sequence
  Synthetic construct
AAYAAPAIWQ

SEQ ID NO: 35762 - protein, 10 aa, Artificial Sequence
  Synthetic construct
AAYAAPAIQR

SEQ ID NO: 35763 - protein, 10 aa, Artificial Sequence
  Synthetic construct
AAYAAPAIQQ

SEQ ID NO: 35764 - protein, 10 aa, Artificial Sequence
  Synthetic construct
AAPPAPYIWR

SEQ ID NO: 35765 - protein, 10 aa, Artificial Sequence
  Synthetic construct
AAPPAPYIWQ

SEQ ID NO: 35766 - protein, 10 aa, Artificial Sequence
  Synthetic construct
AAPPAPYIQR

SEQ ID NO: 35767 - protein, 10 aa, Artificial Sequence
  Synthetic construct
AAPPAPYIQQ

SEQ ID NO: 35768 - protein, 10 aa, Artificial Sequence
  Synthetic construct
AAPPAPAIWR

SEQ ID NO: 35769 - protein, 10 aa, Artificial Sequence
  Synthetic construct
AAPPAPAIWQ

SEQ ID NO: 35770 - protein, 10 aa, Artificial Sequence
  Synthetic construct
AAPPAPAIQR

SEQ ID NO: 35771 - protein, 10 aa, Artificial Sequence
  Synthetic construct
AAPPAPAIQQ

SEQ ID NO: 35772 - protein, 10 aa, Artificial Sequence
  Synthetic construct
AAPHAPYIWR

SEQ ID NO: 35773 - protein, 10 aa, Artificial Sequence
  Synthetic construct
AAPHAPYIWQ

SEQ ID NO: 35774 - protein, 10 aa, Artificial Sequence
  Synthetic construct
AAPHAPYIQR

SEQ ID NO: 35775 - protein, 10 aa, Artificial Sequence
  Synthetic construct
AAPHAPYIQQ

SEQ ID NO: 35776 - protein, 10 aa, Artificial Sequence
  Synthetic construct
AAPHAPAIWR

SEQ ID NO: 35777 - protein, 10 aa, Artificial Sequence
  Synthetic construct
AAPHAPAIWQ

SEQ ID NO: 35778 - protein, 10 aa, Artificial Sequence
  Synthetic construct
AAPHAPAIQR

SEQ ID NO: 35779 - protein, 10 aa, Artificial Sequence
  Synthetic construct
AAPHAPAIQQ

SEQ ID NO: 35780 - protein, 10 aa, Artificial Sequence
  Synthetic construct
AAPYAPYIWR

SEQ ID NO: 35781 - protein, 10 aa, Artificial Sequence
  Synthetic construct
AAPYAPYIWQ

SEQ ID NO: 35782 - protein, 10 aa, Artificial Sequence
  Synthetic construct
AAPYAPYIQR

SEQ ID NO: 35783 - protein, 10 aa, Artificial Sequence
  Synthetic construct
AAPYAPYIQQ

SEQ ID NO: 35784 - protein, 10 aa, Artificial Sequence
  Synthetic construct
AAPYAPAIWR

SEQ ID NO: 35785 - protein, 10 aa, Artificial Sequence
  Synthetic construct
AAPYAPAIWQ

SEQ ID NO: 35786 - protein, 10 aa, Artificial Sequence
  Synthetic construct
AAPYAPAIQR

SEQ ID NO: 35787 - protein, 10 aa, Artificial Sequence
  Synthetic construct
AAPYAPAIQQ

SEQ ID NO: 35788 - protein, 10 aa, Artificial Sequence
  Synthetic construct
AAPWAPYIWR

SEQ ID NO: 35789 - protein, 10 aa, Artificial Sequence
  Synthetic construct
AAPWAPYIWQ

SEQ ID NO: 35790 - protein, 10 aa, Artificial Sequence
  Synthetic construct
AAPWAPYIQR

SEQ ID NO: 35791 - protein, 10 aa, Artificial Sequence
  Synthetic construct
AAPWAPYIQQ

SEQ ID NO: 35792 - protein, 10 aa, Artificial Sequence
  Synthetic construct
AAPWAPAIWR

SEQ ID NO: 35793 - protein, 10 aa, Artificial Sequence
  Synthetic construct
AAPWAPAIWQ

SEQ ID NO: 35794 - protein, 10 aa, Artificial Sequence
  Synthetic construct
AAPWAPAIQR

SEQ ID NO: 35795 - protein, 10 aa, Artificial Sequence
  Synthetic construct
AAPWAPAIQQ

SEQ ID NO: 35796 - protein, 10 aa, Artificial Sequence
  Synthetic construct
AAPAAPYIWR

SEQ ID NO: 35797 - protein, 10 aa, Artificial Sequence
  Synthetic construct
AAPAAPYIWQ

SEQ ID NO: 35798 - protein, 10 aa, Artificial Sequence
  Synthetic construct
AAPAAPYIQR

SEQ ID NO: 35799 - protein, 10 aa, Artificial Sequence
  Synthetic construct
AAPAAPYIQQ

SEQ ID NO: 35800 - protein, 10 aa, Artificial Sequence
  Synthetic construct
AAPAAPAIWR

SEQ ID NO: 35801 - protein, 10 aa, Artificial Sequence
  Synthetic construct
AAPAAPAIWQ

SEQ ID NO: 35802 - protein, 10 aa, Artificial Sequence
  Synthetic construct
AAPAAPAIQR

SEQ ID NO: 35803 - protein, 10 aa, Artificial Sequence
  Synthetic construct
AAPAAPAIQQ

SEQ ID NO: 35804 - protein, 10 aa, Artificial Sequence
  Synthetic construct
HEGQPHAQEP

SEQ ID NO: 35805 - protein, 10 aa, Artificial Sequence
  Synthetic construct
HEGQPWAQEP

SEQ ID NO: 35806 - protein, 10 aa, Artificial Sequence
  Synthetic construct
HEGQPKAQEP

SEQ ID NO: 35807 - protein, 10 aa, Artificial Sequence
  Synthetic construct
HEAQPHAQEP

SEQ ID NO: 35808 - protein, 10 aa, Artificial Sequence
  Synthetic construct
HEAQPWAQEP

SEQ ID NO: 35809 - protein, 10 aa, Artificial Sequence
  Synthetic construct
HEAQPKAQEP

SEQ ID NO: 35810 - protein, 10 aa, Artificial Sequence
  Synthetic construct
HENQPHAQEP

SEQ ID NO: 35811 - protein, 10 aa, Artificial Sequence
  Synthetic construct
HENQPWAQEP

SEQ ID NO: 35812 - protein, 10 aa, Artificial Sequence
  Synthetic construct
HENQPKAQEP

SEQ ID NO: 35813 - protein, 10 aa, Artificial Sequence
  Synthetic construct
HGGQPHAQEP

SEQ ID NO: 35814 - protein, 10 aa, Artificial Sequence
  Synthetic construct
HGGQPWAQEP

SEQ ID NO: 35815 - protein, 10 aa, Artificial Sequence
  Synthetic construct
HGGQPKAQEP

SEQ ID NO: 35816 - protein, 10 aa, Artificial Sequence
  Synthetic construct
HGAQPHAQEP

SEQ ID NO: 35817 - protein, 10 aa, Artificial Sequence
  Synthetic construct
HGAQPWAQEP

SEQ ID NO: 35818 - protein, 10 aa, Artificial Sequence
  Synthetic construct
HGAQPKAQEP

SEQ ID NO: 35819 - protein, 10 aa, Artificial Sequence
  Synthetic construct
HGNQPHAQEP

SEQ ID NO: 35820 - protein, 10 aa, Artificial Sequence
  Synthetic construct
HGNQPWAQEP

SEQ ID NO: 35821 - protein, 10 aa, Artificial Sequence
  Synthetic construct
HGNQPKAQEP

SEQ ID NO: 35822 - protein, 10 aa, Artificial Sequence
  Synthetic construct
HWGQPHAQEP

SEQ ID NO: 35823 - protein, 10 aa, Artificial Sequence
  Synthetic construct
HWGQPWAQEP

SEQ ID NO: 35824 - protein, 10 aa, Artificial Sequence
  Synthetic construct
HWGQPKAQEP

SEQ ID NO: 35825 - protein, 10 aa, Artificial Sequence
  Synthetic construct
HWAQPHAQEP

SEQ ID NO: 35826 - protein, 10 aa, Artificial Sequence
  Synthetic construct
HWAQPWAQEP

SEQ ID NO: 35827 - protein, 10 aa, Artificial Sequence
  Synthetic construct
HWAQPKAQEP

SEQ ID NO: 35828 - protein, 10 aa, Artificial Sequence
  Synthetic construct
HWNQPHAQEP

SEQ ID NO: 35829 - protein, 10 aa, Artificial Sequence
  Synthetic construct
HWNQPWAQEP

SEQ ID NO: 35830 - protein, 10 aa, Artificial Sequence
  Synthetic construct
HWNQPKAQEP

SEQ ID NO: 35831 - protein, 10 aa, Artificial Sequence
  Synthetic construct
HFGQPHAQEP

SEQ ID NO: 35832 - protein, 10 aa, Artificial Sequence
  Synthetic construct
HFGQPWAQEP

SEQ ID NO: 35833 - protein, 10 aa, Artificial Sequence
  Synthetic construct
HFGQPKAQEP

SEQ ID NO: 35834 - protein, 10 aa, Artificial Sequence
  Synthetic construct
HFAQPHAQEP

SEQ ID NO: 35835 - protein, 10 aa, Artificial Sequence
  Synthetic construct
HFAQPWAQEP

SEQ ID NO: 35836 - protein, 10 aa, Artificial Sequence
  Synthetic construct
HFAQPKAQEP

SEQ ID NO: 35837 - protein, 10 aa, Artificial Sequence
  Synthetic construct
HFNQPHAQEP

SEQ ID NO: 35838 - protein, 10 aa, Artificial Sequence
  Synthetic construct
HFNQPWAQEP

SEQ ID NO: 35839 - protein, 10 aa, Artificial Sequence
  Synthetic construct
HFNQPKAQEP

SEQ ID NO: 35840 - protein, 50 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(41): Xaa = any amino acid, non amino acid, or is absent
  MISC_FEATURE (44)..(44): Xaa = any amino acid, non amino acid, or is absent
  MISC_FEATURE (47)..(50): Xaa = any amino acid, non amino acid, or is absent
XXXXGFXLKXXXXNSXXNXLAXCXLSXXIXVXXXQLXIXXXGFXLKXXXX

SEQ ID NO: 35841 - protein, 51 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(41): Xaa = any amino acid, non amino acid, or is absent
  MISC_FEATURE (45)..(45): Xaa = Asn or Asp
  MISC_FEATURE (46)..(46): Xaa = Asn or Glu
  MISC_FEATURE (47)..(51): Xaa = any amino acid, non amino acid, or is absent
XXXXGFXLKXXXXNSXXNXLAXCXLSXXIXVXXXQLXIXXXTPAXXXXXXX

SEQ ID NO: 35842 - protein, 47 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Ile, Phe, Trp, Tyr or Ala
  MISC_FEATURE (41)..(41): Xaa = Asp, Ala, Gln, Glu, Gly, His, Ile, Leu, Phe, Pro, Thr or Tyr
  MISC_FEATURE (42)..(42): Xaa = Gln, Leu, Trp or Tyr
  MISC_FEATURE (46)..(47): Xaa = any amino acid, non amino acid, or is absent
XXXXGFXLKXXXXNSXXNXLAXCXLSXXIXVXXXQLXIXXXXAPWXX

SEQ ID NO: 35843 - protein, 48 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (42)..(42): Xaa = Tyr or Pro
  MISC_FEATURE (43)..(43): Xaa = Trp, Tyr, Phe, Ala, Val, Cys, Thr, Leu, Ser, His, Gln, Glu, Gly or Ile
  MISC_FEATURE (44)..(44): Xaa = Trp, Ile, Phe, Pro, Asp, Gly, Cys or Ala
  MISC_FEATURE (45)..(45): Xaa = Gly or Asn
  MISC_FEATURE (47)..(48): Xaa = any amino acid, non amino acid, or is absent
XXXXGFXLKXXXXNSXXNXLAXCXLSXXIXVXXXQLXIXPPXXXXPXX

SEQ ID NO: 35844 - protein, 48 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Gly, Tyr or Trp
  MISC_FEATURE (41)..(41): Xaa = Trp, Val, Ile, Phe, Arg, Met, Ser or Leu
  MISC_FEATURE (42)..(42): Xaa = Ile or Gly
  MISC_FEATURE (43)..(43): Xaa = Tyr, Pro, His, Leu or Phe
  MISC_FEATURE (44)..(44): Xaa = Ile, Asp, Tyr, Phe, Val, Thr, Gly, Ala or Gln
  MISC_FEATURE (45)..(45): Xaa = Phe, Arg, Cys, Leu, Ala, Gln, Asp or Val
  MISC_FEATURE (46)..(46): Xaa = Phe or Tyr
  MISC_FEATURE (47)..(48): Xaa = any amino acid, non amino acid, or is absent
XXXXGFXLKXXXXNSXXNXLAXCXLSXXIXVXXXQLXIXXXXXXXXXX

SEQ ID NO: 35845 - protein, 48 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (41)..(41): Xaa = Pro or Ser
  MISC_FEATURE (46)..(46): Xaa = Pro, Tyr, Leu, Ala, Glu, Gly, Val or Ile
  MISC_FEATURE (47)..(48): Xaa = any amino acid, non amino acid, or is absent
XXXXGFXLKXXXXNSXXNXLAXCXLSXXIXVXXXQLXIXFXPPAPXXX

SEQ ID NO: 35846 - protein, 48 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (43)..(43): Xaa = Val or Ile
  MISC_FEATURE (47)..(48): Xaa = any amino acid, non amino acid, or is absent
XXXXGFXLKXXXXNSXXNXLAXCXLSXXIXVXXXQLXIXDFTXFPPXX

SEQ ID NO: 35847 - protein, 48 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Tyr, Thr or His
  MISC_FEATURE (44)..(44): Xaa = His or Ile
  MISC_FEATURE (46)..(46): Xaa = Tyr or Ala
  MISC_FEATURE (47)..(48): Xaa = any amino acid, non amino acid, or is absent
XXXXGFXLKXXXXNSXXNXLAXCXLSXXIXVXXXQLXIXXTPAXFXXX

SEQ ID NO: 35848 - protein, 51 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Pro or Ala
  MISC_FEATURE (43)..(43): Xaa = Ala, Pro, Trp, Asn or Leu
  MISC_FEATURE (46)..(46): Xaa = Pro or Phe
  MISC_FEATURE (50)..(51): Xaa = any amino acid, non amino acid, or is absent
XXXXGFXLKXXXXNSXXNXLAXCXLSXXIXVXXXQLXIXXARXTPXSPPXX

SEQ ID NO: 35849 - protein, 49 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Trp or Leu
  MISC_FEATURE (41)..(41): Xaa = Ala, Asn, Ser, Trp or Glu
  MISC_FEATURE (47)..(47): Xaa = Ser or Phe
  MISC_FEATURE (48)..(49): Xaa = any amino acid, non amino acid, or is absent
XXXXGFXLKXXXXNSXXNXLAXCXLSXXIXVXXXQLXIXXXTAYKPXXX

SEQ ID NO: 35850 - protein, 51 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (40)..(40): Xaa = Asn, Trp or Ala
  MISC_FEATURE (42)..(42): Xaa = Phe, Asn, Tyr or Pro
  MISC_FEATURE (43)..(43): Xaa = Pro, His, Tyr, Trp or Ala
  MISC_FEATURE (46)..(46): Xaa = Tyr or Ala
  MISC_FEATURE (48)..(48): Xaa = Trp or Gln
  MISC_FEATURE (49)..(49): Xaa = Arg or Gln
  MISC_FEATURE (50)..(51): Xaa = any amino acid, non amino acid, or is absent
XXXXGFXLKXXXXNSXXNXLAXCXLSXXIXVXXXQLXIXXAXXAPXIXXXX

SEQ ID NO: 35851 - protein, 51 aa, Artificial Sequence
  Synthetic construct
  MISC_FEATURE (1)..(4): Xaa = any amino acid, non amino acid, or is absent
  MISC_FEATURE (7)..(7): Xaa = any amino acid, non amino acid, or is absent
  MISC_FEATURE (10)..(11): Xaa = any amino acid, non amino acid, or is absent
  MISC_FEATURE (12)..(13): Xaa = Phe, Trp or Thr
  MISC_FEATURE (16)..(17): Xaa = Phe, Trp or Thr
  MISC_FEATURE (19)..(19): Xaa = Arg, His or Lys
  MISC_FEATURE (22)..(22): Xaa = Asp or Glu
  MISC_FEATURE (24)..(24): Xaa = Ala or Gly
  MISC_FEATURE (27)..(27): Xaa = Arg, His or Lys
  MISC_FEATURE (28)..(28): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (33)..(33): Xaa = Arg, His or Lys
  MISC_FEATURE (34)..(34): Xaa = Ala, Cys, Gly, Ile, Leu, Met, Asn, Pro, Gln, Ser, Val or Tyr
  MISC_FEATURE (37)..(37): Xaa = Ala, Cys, Gly, Ile, Leu, Met, Asn, Pro, Gln, Ser, Val or Tyr
  MISC_FEATURE (39)..(39): Xaa = Asp or Glu
  MISC_FEATURE (41)..(41): Xaa = Glu, Gly, Trp or Phe
  MISC_FEATURE (42)..(42): Xaa = Gly, Ala or Asn
  MISC_FEATURE (45)..(45): Xaa = His, Trp or Lys
  MISC_FEATURE (50)..(51): Xaa = any amino acid, non amino acid, or is absent
XXXXGFXLKXXXXNSXXNXLAXCXLSXXIXVXXXQLXIXHXXQPXAQEPXX

SEQ ID NO: 35852 - protein, 51 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (45)..(45): Xaa = any amino acid, non amino acid, or is absent
  MISC_FEATURE (48)..(51): Xaa = any amino acid, non amino acid, or is absent
XXXXTPAXXXXXXXNSXXNXLAXCXLSXXIXVXXXQLXIXXXGFXLKXXXX

SEQ ID NO: 35853 - protein, 52 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (46)..(46): Xaa = Asn or Asp
  MISC_FEATURE (47)..(47): Xaa = Asn or Glu
  MISC_FEATURE (48)..(52): Xaa = any amino acid, non amino acid, or is absent
XXXXTPAXXXXXXXNSXXNXLAXCXLSXXIXVXXXQLXIXXXTPAXXXXXXX

SEQ ID NO: 35854 - protein, 48 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Ile, Phe, Trp, Tyr or Ala
  MISC_FEATURE (42)..(42): Xaa = Asp, Ala, Gln, Glu, Gly, His, Ile, Leu, Phe, Pro, Thr or Tyr
  MISC_FEATURE (43)..(43): Xaa = Gln, Leu, Trp or Tyr
  MISC_FEATURE (47)..(48): Xaa = any amino acid, non amino acid, or is absent
XXXXTPAXXXXXXXNSXXNXLAXCXLSXXIXVXXXQLXIXXXXAPWXX

SEQ ID NO: 35855 - protein, 49 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (43)..(43): Xaa = Tyr or Pro
  MISC_FEATURE (44)..(44): Xaa = Trp, Tyr, Phe, Ala, Val, Cys, Thr, Leu, Ser, His, Gln, Glu, Gly or Ile
  MISC_FEATURE (45)..(45): Xaa = Trp, Ile, Phe, Pro, Asp, Gly, Cys or Ala
  MISC_FEATURE (46)..(46): Xaa = Gly or Asn
  MISC_FEATURE (48)..(49): Xaa = any amino acid, non amino acid, or is absent
XXXXTPAXXXXXXXNSXXNXLAXCXLSXXIXVXXXQLXIXPPXXXXPXX

SEQ ID NO: 35856 - protein, 49 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Gly, Tyr or Trp
  MISC_FEATURE (42)..(42): Xaa = Trp, Val, Ile, Phe, Arg, Met, Ser or Leu
  MISC_FEATURE (43)..(43): Xaa = Ile or Gly
  MISC_FEATURE (44)..(44): Xaa = Tyr, Pro, His, Leu or Phe
  MISC_FEATURE (45)..(45): Xaa = Ile, Asp, Tyr, Phe, Val, Thr, Gly, Ala or Gln
  MISC_FEATURE (46)..(46): Xaa = Phe, Arg, Cys, Leu, Ala, Gln, Asp or Val
  MISC_FEATURE (47)..(47): Xaa = Phe or Tyr
  MISC_FEATURE (48)..(49): Xaa = any amino acid, non amino acid, or is absent
XXXXTPAXXXXXXXNSXXNXLAXCXLSXXIXVXXXQLXIXXXXXXXXXX

SEQ ID NO: 35857 - protein, 49 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Pro or Ser
  MISC_FEATURE (47)..(47): Xaa = Pro, Tyr, Leu, Ala, Glu, Gly, Val or Ile
  MISC_FEATURE (48)..(49): Xaa = any amino acid, non amino acid, or is absent
XXXXTPAXXXXXXXNSXXNXLAXCXLSXXIXVXXXQLXIXFXPPAPXXX

SEQ ID NO: 35858 - protein, 49 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (44)..(44): Xaa = Val or Ile
  MISC_FEATURE (48)..(49): Xaa = any amino acid, non amino acid, or is absent
XXXXTPAXXXXXXXNSXXNXLAXCXLSXXIXVXXXQLXIXDFTXFPPXX

SEQ ID NO: 35859 - protein, 49 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Tyr, Thr or His
  MISC_FEATURE (45)..(45): Xaa = His or Ile
  MISC_FEATURE (47)..(47): Xaa = Tyr or Ala
  MISC_FEATURE (48)..(49): Xaa = any amino acid, non amino acid, or is absent
XXXXTPAXXXXXXXNSXXNXLAXCXLSXXIXVXXXQLXIXXTPAXFXXX

SEQ ID NO: 35860 - protein, 52 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Pro or Ala
  MISC_FEATURE (44)..(44): Xaa = Ala, Pro, Trp, Asn or Leu
  MISC_FEATURE (47)..(47): Xaa = Pro or Phe
  MISC_FEATURE (51)..(52): Xaa = any amino acid, non amino acid, or is absent
XXXXTPAXXXXXXXNSXXNXLAXCXLSXXIXVXXXQLXIXXARXTPXSPPXX

SEQ ID NO: 35861 - protein, 50 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Trp or Leu
  MISC_FEATURE (42)..(42): Xaa = Ala, Asn, Ser, Trp or Glu
  MISC_FEATURE (48)..(48): Xaa = Ser or Phe
  MISC_FEATURE (49)..(50): Xaa = any amino acid, non amino acid, or is absent
XXXXTPAXXXXXXXNSXXNXLAXCXLSXXIXVXXXQLXIXXXTAYKPXXX

SEQ ID NO: 35862 - protein, 52 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Asn, Trp or Ala
  MISC_FEATURE (43)..(43): Xaa = Phe, Asn, Tyr or Pro
  MISC_FEATURE (44)..(44): Xaa = Pro, His, Tyr, Trp or Ala
  MISC_FEATURE (47)..(47): Xaa = Tyr or Ala
  MISC_FEATURE (49)..(49): Xaa = Trp or Gln
  MISC_FEATURE (50)..(50): Xaa = Arg or Gln
  MISC_FEATURE (51)..(52): Xaa = any amino acid, non amino acid, or is absent
XXXXTPAXXXXXXXNSXXNXLAXCXLSXXIXVXXXQLXIXXAXXAPXIXXXX

SEQ ID NO: 35863 - protein, 52 aa, Artificial Sequence
  Synthetic construct
  MISC_FEATURE (1)..(4): Xaa = any amino acid, non amino acid, or is absent
  MISC_FEATURE (8)..(8): Xaa = Asn or Asp
  MISC_FEATURE (9)..(9): Xaa = Asn or Glu
  MISC_FEATURE (10)..(12): Xaa = any amino acid, non amino acid, or is absent
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Glu, Gly, Trp or Phe
  MISC_FEATURE (43)..(43): Xaa = Gly, Ala or Asn
  MISC_FEATURE (46)..(46): Xaa = His, Trp or Lys
  MISC_FEATURE (51)..(52): Xaa = any amino acid, non amino acid, or is absent
XXXXTPAXXXXXXXNSXXNXLAXCXLSXXIXVXXXQLXIXHXXQPXAQEPXX

SEQ ID NO: 35864 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(38): Xaa = any amino acid, non amino acid, or is absent
  MISC_FEATURE (41)..(41): Xaa = any amino acid, non amino acid, or is absent
  MISC_FEATURE (44)..(47): Xaa = any amino acid, non amino acid, or is absent
XXXXXAPWXXNSXXNXLAXCXLSXXIXVXXXQLXIXXXGFXLKXXXX

SEQ ID NO: 35865 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(38): Xaa = any amino acid, non amino acid, or is absent
  MISC_FEATURE (42)..(42): Xaa = Asn or Asp
  MISC_FEATURE (43)..(43): Xaa = Asn or Glu
  MISC_FEATURE (44)..(48): Xaa = any amino acid, non amino acid, or is absent
XXXXXAPWXXNSXXNXLAXCXLSXXIXVXXXQLXIXXXTPAXXXXXXX

SEQ ID NO: 35866 - protein, 44 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Ile, Phe, Trp, Tyr or Ala
  MISC_FEATURE (38)..(38): Xaa = Asp, Ala, Gln, Glu, Gly, His, Ile, Leu, Phe, Pro, Thr or Tyr
  MISC_FEATURE (39)..(39): Xaa = Gln, Leu, Trp or Tyr
  MISC_FEATURE (43)..(44): Xaa = any amino acid, non amino acid, or is absent
XXXXXAPWXXNSXXNXLAXCXLSXXIXVXXXQLXIXXXXAPWXX

SEQ ID NO: 35867 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (39)..(39): Xaa = Tyr or Pro
  MISC_FEATURE (40)..(40): Xaa = Trp, Tyr, Phe, Ala, Val, Cys, Thr, Leu, Ser, His, Gln, Glu, Gly or Ile
  MISC_FEATURE (41)..(41): Xaa = Trp, Ile, Phe, Pro, Asp, Gly, Cys or Ala
  MISC_FEATURE (42)..(42): Xaa = Gly or Asn
  MISC_FEATURE (44)..(45): Xaa = any amino acid, non amino acid, or is absent
XXXXXAPWXXNSXXNXLAXCXLSXXIXVXXXQLXIXPPXXXXPXX

SEQ ID NO: 35868 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Gly, Tyr or Trp
  MISC_FEATURE (38)..(38): Xaa = Trp, Val, Ile, Phe, Arg, Met, Ser or Leu
  MISC_FEATURE (39)..(39): Xaa = Ile or Gly
  MISC_FEATURE (40)..(40): Xaa = Tyr, Pro, His, Leu or Phe
  MISC_FEATURE (41)..(41): Xaa = Ile, Asp, Tyr, Phe, Val, Thr, Gly, Ala or Gln
  MISC_FEATURE (42)..(42): Xaa = Phe, Arg, Cys, Leu, Ala, Gln, Asp or Val
  MISC_FEATURE (43)..(43): Xaa = Phe or Tyr
  MISC_FEATURE (44)..(45): Xaa = any amino acid, non amino acid, or is absent
XXXXXAPWXXNSXXNXLAXCXLSXXIXVXXXQLXIXXXXXXXXXX

SEQ ID NO: 35869 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (38)..(38): Xaa = Pro or Ser
  MISC_FEATURE (43)..(43): Xaa = Pro, Tyr, Leu, Ala, Glu, Gly, Val or Ile
  MISC_FEATURE (44)..(45): Xaa = any amino acid, non amino acid, or is absent
XXXXXAPWXXNSXXNXLAXCXLSXXIXVXXXQLXIXFXPPAPXXX

SEQ ID NO: 35870 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (40)..(40): Xaa = Val or Ile
  MISC_FEATURE (44)..(45): Xaa = any amino acid, non amino acid, or is absent
XXXXXAPWXXNSXXNXLAXCXLSXXIXVXXXQLXIXDFTXFPPXX

SEQ ID NO: 35871 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Tyr, Thr or His
  MISC_FEATURE (41)..(41): Xaa = His or Ile
  MISC_FEATURE (43)..(43): Xaa = Tyr or Ala
  MISC_FEATURE (44)..(45): Xaa = any amino acid, non amino acid, or is absent
XXXXXAPWXXNSXXNXLAXCXLSXXIXVXXXQLXIXXTPAXFXXX

SEQ ID NO: 35872 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Pro or Ala
  MISC_FEATURE (40)..(40): Xaa = Ala, Pro, Trp, Asn or Leu
  MISC_FEATURE (43)..(43): Xaa = Pro or Phe
  MISC_FEATURE (47)..(48): Xaa = any amino acid, non amino acid, or is absent
XXXXXAPWXXNSXXNXLAXCXLSXXIXVXXXQLXIXXARXTPXSPPXX

SEQ ID NO: 35873 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Trp or Leu
  MISC_FEATURE (38)..(38): Xaa = Ala, Asn, Ser, Trp or Glu
  MISC_FEATURE (44)..(44): Xaa = Ser or Phe
  MISC_FEATURE (45)..(46): Xaa = any amino acid, non amino acid, or is absent
XXXXXAPWXXNSXXNXLAXCXLSXXIXVXXXQLXIXXXTAYKPXXX

SEQ ID NO: 35874 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (37)..(37): Xaa = Asn, Trp or Ala
  MISC_FEATURE (39)..(39): Xaa = Phe, Asn, Tyr or Pro
  MISC_FEATURE (40)..(40): Xaa = Pro, His, Tyr, Trp or Ala
  MISC_FEATURE (43)..(43): Xaa = Tyr or Ala
  MISC_FEATURE (45)..(45): Xaa = Trp or Gln
  MISC_FEATURE (46)..(46): Xaa = Arg or Gln
  MISC_FEATURE (47)..(48): Xaa = any amino acid, non amino acid, or is absent
XXXXXAPWXXNSXXNXLAXCXLSXXIXVXXXQLXIXXAXXAPXIXXXX

SEQ ID NO: 35875 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Ile, Phe, Trp, Tyr or Ala
  MISC_FEATURE (4)..(4): Xaa = Asp, Ala, Gln, Glu, Gly, His, Ile, Leu, Phe, Pro, Thr or Tyr
  MISC_FEATURE (5)..(5): Xaa = Gln, Leu, Trp or Tyr
  MISC_FEATURE (9)..(10): Xaa = Phe, Trp or Thr
  MISC_FEATURE (13)..(14): Xaa = Phe, Trp or Thr
  MISC_FEATURE (16)..(16): Xaa = Arg, His or Lys
  MISC_FEATURE (19)..(19): Xaa = Asp or Glu
  MISC_FEATURE (21)..(21): Xaa = Ala or Gly
  MISC_FEATURE (24)..(24): Xaa = Arg, His or Lys
  MISC_FEATURE (25)..(25): Xaa = Ala, Cys, Gly, Ile, Leu, Met, Asn, Pro, Gln, Ser, Val or Tyr
  MISC_FEATURE (27)..(27): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (30)..(30): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (34)..(34): Xaa = Ala, Cys, Gly, Ile, Leu, Met, Asn, Pro, Gln, Ser, Val or Tyr
  MISC_FEATURE (36)..(36): Xaa = Asp or Glu
  MISC_FEATURE (38)..(38): Xaa = Glu, Gly, Trp or Phe
  MISC_FEATURE (39)..(39): Xaa = Gly, Ala or Asn
  MISC_FEATURE (42)..(42): Xaa = His, Trp or Lys
  MISC_FEATURE (47)..(48): Xaa = any amino acid, non amino acid, or is absent
XXXXXAPWXXNSXXNXLAXCXLSXXIXVXXXQLXIXHXXQPXAQEPXX

SEQ ID NO: 35876 - protein, 48 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (42)..(42): Xaa = any amino acid, non amino acid, or is absent
  MISC_FEATURE (45)..(48): Xaa = any amino acid, non amino acid, or is absent
XXPPXXXXPXXNSXXNXLAXCXLSXXIXVXXXQLXIXXXGFXLKXXXX

SEQ ID NO: 35877 - protein, 49 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (43)..(43): Xaa = Asn or Asp
  MISC_FEATURE (44)..(44): Xaa = Asn or Glu
  MISC_FEATURE (45)..(49): Xaa = any amino acid, non amino acid, or is absent
XXPPXXXXPXXNSXXNXLAXCXLSXXIXVXXXQLXIXXXTPAXXXXXXX

SEQ ID NO: 35878 - protein, 45 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Ile, Phe, Trp, Tyr or Ala
  MISC_FEATURE (39)..(39): Xaa = Asp, Ala, Gln, Glu, Gly, His, Ile, Leu, Phe, Pro, Thr or Tyr
  MISC_FEATURE (40)..(40): Xaa = Gln, Leu, Trp or Tyr
  MISC_FEATURE (44)..(45): Xaa = any amino acid, non amino acid, or is absent
XXPPXXXXPXXNSXXNXLAXCXLSXXIXVXXXQLXIXXXXAPWXX

SEQ ID NO: 35879 - protein, 46 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (40)..(40): Xaa = Tyr or Pro
  MISC_FEATURE (41)..(41): Xaa = Trp, Tyr, Phe, Ala, Val, Cys, Thr, Leu, Ser, His, Gln, Glu, Gly or Ile
  MISC_FEATURE (42)..(42): Xaa = Trp, Ile, Phe, Pro, Asp, Gly, Cys or Ala
  MISC_FEATURE (43)..(43): Xaa = Gly or Asn
  MISC_FEATURE (45)..(46): Xaa = any amino acid, non amino acid, or is absent
XXPPXXXXPXXNSXXNXLAXCXLSXXIXVXXXQLXIXPPXXXXPXX

SEQ ID NO: 35880 - protein, 46 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Gly, Tyr or Trp
  MISC_FEATURE (39)..(39): Xaa = Trp, Val, Ile, Phe, Arg, Met, Ser or Leu
  MISC_FEATURE (40)..(40): Xaa = Ile or Gly
  MISC_FEATURE (41)..(41): Xaa = Tyr, Pro, His, Leu or Phe
  MISC_FEATURE (42)..(42): Xaa = Ile, Asp, Tyr, Phe, Val, Thr, Gly, Ala or Gln
  MISC_FEATURE (43)..(43): Xaa = Phe, Arg, Cys, Leu, Ala, Gln, Asp or Val
  MISC_FEATURE (44)..(44): Xaa = Phe or Tyr
  MISC_FEATURE (45)..(46): Xaa = any amino acid, non amino acid, or is absent
XXPPXXXXPXXNSXXNXLAXCXLSXXIXVXXXQLXIXXXXXXXXXX

SEQ ID NO: 35881 - protein, 46 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Pro or Ser
  MISC_FEATURE (44)..(44): Xaa = Pro, Tyr, Leu, Ala, Glu, Gly, Val or Ile
  MISC_FEATURE (45)..(46): Xaa = any amino acid, non amino acid, or is absent
XXPPXXXXPXXNSXXNXLAXCXLSXXIXVXXXQLXIXFXPPAPXXX

SEQ ID NO: 35882 - protein, 46 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (41)..(41): Xaa = Val or Ile
  MISC_FEATURE (45)..(46): Xaa = any amino acid, non amino acid, or is absent
XXPPXXXXPXXNSXXNXLAXCXLSXXIXVXXXQLXIXDFTXFPPXX

SEQ ID NO: 35883 - protein, 46 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Tyr, Thr or His
  MISC_FEATURE (42)..(42): Xaa = His or Ile
  MISC_FEATURE (44)..(44): Xaa = Tyr or Ala
  MISC_FEATURE (45)..(46): Xaa = any amino acid, non amino acid, or is absent
XXPPXXXXPXXNSXXNXLAXCXLSXXIXVXXXQLXIXXTPAXFXXX

SEQ ID NO: 35884 - protein, 49 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Pro or Ala
  MISC_FEATURE (41)..(41): Xaa = Ala, Pro, Trp, Asn or Leu
  MISC_FEATURE (44)..(44): Xaa = Pro or Phe
  MISC_FEATURE (48)..(49): Xaa = any amino acid, non amino acid, or is absent
XXPPXXXXPXXNSXXNXLAXCXLSXXIXVXXXQLXIXXARXTPXSPPXX

SEQ ID NO: 35885 - protein, 47 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Trp or Leu
  MISC_FEATURE (39)..(39): Xaa = Ala, Asn, Ser, Trp or Glu
  MISC_FEATURE (45)..(45): Xaa = Ser or Phe
  MISC_FEATURE (46)..(47): Xaa = any amino acid, non amino acid, or is absent
XXPPXXXXPXXNSXXNXLAXCXLSXXIXVXXXQLXIXXXTAYKPXXX

SEQ ID NO: 35886 - protein, 49 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Asn, Trp or Ala
  MISC_FEATURE (40)..(40): Xaa = Phe, Asn, Tyr or Pro
  MISC_FEATURE (41)..(41): Xaa = Pro, His, Tyr, Trp or Ala
  MISC_FEATURE (44)..(44): Xaa = Tyr or Ala
  MISC_FEATURE (46)..(46): Xaa = Trp or Gln
  MISC_FEATURE (47)..(47): Xaa = Arg or Gln
  MISC_FEATURE (48)..(49): Xaa = any amino acid, non amino acid, or is absent
XXPPXXXXPXXNSXXNXLAXCXLSXXIXVXXXQLXIXXAXXAPXIXXXX

SEQ ID NO: 35887 - protein, 49 aa, Artificial Sequence
  Synthetic construct
  MISC_FEATURE (1)..(2): Xaa = any amino acid, non amino acid, or is absent
  MISC_FEATURE (5)..(5): Xaa = Tyr or Pro
  MISC_FEATURE (6)..(6): Xaa = Trp, Tyr, Phe, Ala, Val, Cys, Thr, Leu, Ser, His, Gln, Glu, Gly or Ile
  MISC_FEATURE (7)..(7): Xaa = Trp, Ile, Phe, Pro, Asp, Gly, Cys or Ala
  MISC_FEATURE (8)..(8): Xaa = Gly or Asn
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Glu, Gly, Trp or Phe
  MISC_FEATURE (40)..(40): Xaa = Gly, Ala or Asn
  MISC_FEATURE (43)..(43): Xaa = His, Trp or Lys
  MISC_FEATURE (48)..(49): Xaa = any amino acid, non amino acid, or is absent
XXPPXXXXPXXNSXXNXLAXCXLSXXIXVXXXQLXIXHXXQPXAQEPXX

SEQ ID NO: 35888 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (42)..(42): Xaa = any amino acid, non amino acid, or is absent
  MISC_FEATURE (45)..(48): Xaa = any amino acid, non amino acid, or is absent
XXXXXXXXXXXNSXXNXLAXCXLSXXIXVXXXQLXIXXXGFXLKXXXX

SEQ ID NO: 35889 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (43)..(43): Xaa = Asn or Asp
  MISC_FEATURE (44)..(44): Xaa = Asn or Glu
  MISC_FEATURE (45)..(49): Xaa = any amino acid, non amino acid, or is absent
XXXXXXXXXXXNSXXNXLAXCXLSXXIXVXXXQLXIXXXTPAXXXXXXX

SEQ ID NO: 35890 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Ile, Phe, Trp, Tyr or Ala
  MISC_FEATURE (39)..(39): Xaa = Asp, Ala, Gln, Glu, Gly, His, Ile, Leu, Phe, Pro, Thr or Tyr
  MISC_FEATURE (40)..(40): Xaa = Gln, Leu, Trp or Tyr
  MISC_FEATURE (44)..(45): Xaa = any amino acid, non amino acid, or is absent
XXXXXXXXXXXNSXXNXLAXCXLSXXIXVXXXQLXIXXXXAPWXX

SEQ ID NO: 35891 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (40)..(40): Xaa = Tyr or Pro
  MISC_FEATURE (41)..(41): Xaa = Trp, Tyr, Phe, Ala, Val, Cys, Thr, Leu, Ser, His, Gln, Glu, Gly or Ile
  MISC_FEATURE (42)..(42): Xaa = Trp, Ile, Phe, Pro, Asp, Gly, Cys or Ala
  MISC_FEATURE (43)..(43): Xaa = Gly or Asn
  MISC_FEATURE (45)..(46): Xaa = any amino acid, non amino acid, or is absent
XXXXXXXXXXXNSXXNXLAXCXLSXXIXVXXXQLXIXPPXXXXPXX

SEQ ID NO: 35892 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Gly, Tyr or Trp
  MISC_FEATURE (39)..(39): Xaa = Trp, Val, Ile, Phe, Arg, Met, Ser or Leu
  MISC_FEATURE (40)..(40): Xaa = Ile or Gly
  MISC_FEATURE (41)..(41): Xaa = Tyr, Pro, His, Leu or Phe
  MISC_FEATURE (42)..(42): Xaa = Ile, Asp, Tyr, Phe, Val, Thr, Gly, Ala or Gln
  MISC_FEATURE (43)..(43): Xaa = Phe, Arg, Cys, Leu, Ala, Gln, Asp or Val
  MISC_FEATURE (44)..(44): Xaa = Phe or Tyr
  MISC_FEATURE (45)..(46): Xaa = any amino acid, non amino acid, or is absent
XXXXXXXXXXXNSXXNXLAXCXLSXXIXVXXXQLXIXXXXXXXXXX

SEQ ID NO: 35893 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Pro or Ser
  MISC_FEATURE (44)..(44): Xaa = Pro, Tyr, Leu, Ala, Glu, Gly, Val or Ile
  MISC_FEATURE (45)..(46): Xaa = any amino acid, non amino acid, or is absent
XXXXXXXXXXXNSXXNXLAXCXLSXXIXVXXXQLXIXFXPPAPXXX

SEQ ID NO: 35894 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (41)..(41): Xaa = Val or Ile
  MISC_FEATURE (45)..(46): Xaa = any amino acid, non amino acid, or is absent
XXXXXXXXXXXNSXXNXLAXCXLSXXIXVXXXQLXIXDFTXFPPXX

SEQ ID NO: 35895 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Tyr, Thr or His
  MISC_FEATURE (42)..(42): Xaa = His or Ile
  MISC_FEATURE (44)..(44): Xaa = Tyr or Ala
  MISC_FEATURE (45)..(46): Xaa = any amino acid, non amino acid, or is absent
XXXXXXXXXXXNSXXNXLAXCXLSXXIXVXXXQLXIXXTPAXFXXX

SEQ ID NO: 35896 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Pro or Ala
  MISC_FEATURE (41)..(41): Xaa = Ala, Pro, Trp, Asn or Leu
  MISC_FEATURE (44)..(44): Xaa = Pro or Phe
  MISC_FEATURE (48)..(49): Xaa = any amino acid, non amino acid, or is absent
XXXXXXXXXXXNSXXNXLAXCXLSXXIXVXXXQLXIXXARXTPXSPPXX

SEQ ID NO: 35897 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Trp or Leu
  MISC_FEATURE (39)..(39): Xaa = Ala, Asn, Ser, Trp or Glu
  MISC_FEATURE (45)..(45): Xaa = Ser or Phe
  MISC_FEATURE (46)..(47): Xaa = any amino acid, non amino acid, or is absent
XXXXXXXXXXXNSXXNXLAXCXLSXXIXVXXXQLXIXXXTAYKPXXX

SEQ ID NO: 35898 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Asn, Trp or Ala
  MISC_FEATURE (40)..(40): Xaa = Phe, Asn, Tyr or Pro
  MISC_FEATURE (41)..(41): Xaa = Pro, His, Tyr, Trp or Ala
  MISC_FEATURE (44)..(44): Xaa = Tyr or Ala
  MISC_FEATURE (46)..(46): Xaa = Trp or Gln
  MISC_FEATURE (47)..(47): Xaa = Arg or Gln
  MISC_FEATURE (48)..(49): Xaa = any amino acid, non amino acid, or is absent
XXXXXXXXXXXNSXXNXLAXCXLSXXIXVXXXQLXIXXAXXAPXIXXXX

SEQ ID NO: 35899 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Gly, Tyr or Trp
  MISC_FEATURE (4)..(4): Xaa = Trp, Val, Ile, Phe, Arg, Met, Ser or Leu
  MISC_FEATURE (5)..(5): Xaa = Ile or Gly
  MISC_FEATURE (6)..(6): Xaa = Tyr, Pro, His, Leu or Phe
  MISC_FEATURE (7)..(7): Xaa = Ile, Asp, Tyr, Phe, Val, Thr, Gly, Ala or Gln
  MISC_FEATURE (8)..(8): Xaa = Phe, Arg, Cys, Leu, Ala, Gln, Asp or Val
  MISC_FEATURE (9)..(9): Xaa = Phe or Tyr
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Glu, Gly, Trp or Phe
  MISC_FEATURE (40)..(40): Xaa = Gly, Ala or Asn
  MISC_FEATURE (43)..(43): Xaa = His, Trp or Lys
  MISC_FEATURE (48)..(49): Xaa = any amino acid, non amino acid, or is absent
XXXXXXXXXXXNSXXNXLAXCXLSXXIXVXXXQLXIXHXXQPXAQEPXX

SEQ ID NO: 35900 - protein, 48 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (42)..(42): Xaa = any amino acid, non amino acid, or is absent
  MISC_FEATURE (45)..(48): Xaa = any amino acid, non amino acid, or is absent
XXFXPPAPXXXNSXXNXLAXCXLSXXIXVXXXQLXIXXXGFXLKXXXX

SEQ ID NO: 35901 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (43)..(43): Xaa = Asn or Asp
  MISC_FEATURE (44)..(44): Xaa = Asn or Glu
  MISC_FEATURE (45)..(49): Xaa = any amino acid, non amino acid, or is absent
XXFXPPAPXXXNSXXNXLAXCXLSXXIXVXXXQLXIXXXTPAXXXXXXX

SEQ ID NO: 35902 - protein, 45 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Ile, Phe, Trp, Tyr or Ala
  MISC_FEATURE (39)..(39): Xaa = Asp, Ala, Gln, Glu, Gly, His, Ile, Leu, Phe, Pro, Thr or Tyr
  MISC_FEATURE (40)..(40): Xaa = Gln, Leu, Trp or Tyr
  MISC_FEATURE (44)..(45): Xaa = any amino acid, non amino acid, or is absent
XXFXPPAPXXXNSXXNXLAXCXLSXXIXVXXXQLXIXXXXAPWXX

SEQ ID NO: 35903 - protein, 46 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (40)..(40): Xaa = Tyr or Pro
  MISC_FEATURE (41)..(41): Xaa = Trp, Tyr, Phe, Ala, Val, Cys, Thr, Leu, Ser, His, Gln, Glu, Gly or Ile
  MISC_FEATURE (42)..(42): Xaa = Trp, Ile, Phe, Pro, Asp, Gly, Cys or Ala
  MISC_FEATURE (43)..(43): Xaa = Gly or Asn
  MISC_FEATURE (45)..(46): Xaa = any amino acid, non amino acid, or is absent
XXFXPPAPXXXNSXXNXLAXCXLSXXIXVXXXQLXIXPPXXXXPXX

SEQ ID NO: 35904 - protein, 46 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Gly, Tyr or Trp
  MISC_FEATURE (39)..(39): Xaa = Trp, Val, Ile, Phe, Arg, Met, Ser or Leu
  MISC_FEATURE (40)..(40): Xaa = Ile or Gly
  MISC_FEATURE (41)..(41): Xaa = Tyr, Pro, His, Leu or Phe
  MISC_FEATURE (42)..(42): Xaa = Ile, Asp, Tyr, Phe, Val, Thr, Gly, Ala or Gln
  MISC_FEATURE (43)..(43): Xaa = Phe, Arg, Cys, Leu, Ala, Gln, Asp or Val
  MISC_FEATURE (44)..(44): Xaa = Phe or Tyr
  MISC_FEATURE (45)..(46): Xaa = any amino acid, non amino acid, or is absent
XXFXPPAPXXXNSXXNXLAXCXLSXXIXVXXXQLXIXXXXXXXXXX

SEQ ID NO: 35905 - protein, 46 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Pro or Ser
  MISC_FEATURE (44)..(44): Xaa = Pro, Tyr, Leu, Ala, Glu, Gly, Val or Ile
  MISC_FEATURE (45)..(46): Xaa = any amino acid, non amino acid, or is absent
XXFXPPAPXXXNSXXNXLAXCXLSXXIXVXXXQLXIXFXPPAPXXX

SEQ ID NO: 35906 - protein, 46 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (41)..(41): Xaa = Val or Ile
  MISC_FEATURE (45)..(46): Xaa = any amino acid, non amino acid, or is absent
XXFXPPAPXXXNSXXNXLAXCXLSXXIXVXXXQLXIXDFTXFPPXX

SEQ ID NO: 35907 - protein, 46 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Tyr, Thr or His
  MISC_FEATURE (42)..(42): Xaa = His or Ile
  MISC_FEATURE (44)..(44): Xaa = Tyr or Ala
  MISC_FEATURE (45)..(46): Xaa = any amino acid, non amino acid, or is absent
XXFXPPAPXXXNSXXNXLAXCXLSXXIXVXXXQLXIXXTPAXFXXX

SEQ ID NO: 35908 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Pro or Ala
  MISC_FEATURE (41)..(41): Xaa = Ala, Pro, Trp, Asn or Leu
  MISC_FEATURE (44)..(44): Xaa = Pro or Phe
  MISC_FEATURE (48)..(49): Xaa = any amino acid, non amino acid, or is absent
XXFXPPAPXXXNSXXNXLAXCXLSXXIXVXXXQLXIXXARXTPXSPPXX

SEQ ID NO: 35909 - protein, 47 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Trp or Leu
  MISC_FEATURE (39)..(39): Xaa = Ala, Asn, Ser, Trp or Glu
  MISC_FEATURE (45)..(45): Xaa = Ser or Phe
  MISC_FEATURE (46)..(47): Xaa = any amino acid, non amino acid, or is absent
XXFXPPAPXXXNSXXNXLAXCXLSXXIXVXXXQLXIXXXTAYKPXXX

SEQ ID NO: 35910 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Asn, Trp or Ala
  MISC_FEATURE (40)..(40): Xaa = Phe, Asn, Tyr or Pro
  MISC_FEATURE (41)..(41): Xaa = Pro, His, Tyr, Trp or Ala
  MISC_FEATURE (44)..(44): Xaa = Tyr or Ala
  MISC_FEATURE (46)..(46): Xaa = Trp or Gln
  MISC_FEATURE (47)..(47): Xaa = Arg or Gln
  MISC_FEATURE (48)..(49): Xaa = any amino acid, non amino acid, or is absent
XXFXPPAPXXXNSXXNXLAXCXLSXXIXVXXXQLXIXXAXXAPXIXXXX

SEQ ID NO: 35911 - protein, 49 aa, Artificial Sequence
  Synthetic construct
  MISC_FEATURE (1)..(2): Xaa = any amino acid, non amino acid, or is absent
  MISC_FEATURE (4)..(4): Xaa = Pro or Ser
  MISC_FEATURE (9)..(9): Xaa = Pro, Tyr, Leu, Ala, Glu, Gly, Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Glu, Gly, Trp or Phe
  MISC_FEATURE (40)..(40): Xaa = Gly, Ala or Asn
  MISC_FEATURE (43)..(43): Xaa = His, Trp or Lys
  MISC_FEATURE (48)..(49): Xaa = any amino acid, non amino acid, or is absent
XXFXPPAPXXXNSXXNXLAXCXLSXXIXVXXXQLXIXHXXQPXAQEPXX

SEQ ID NO: 35912 - protein, 48 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (42)..(42): Xaa = any amino acid, non amino acid, or is absent
  MISC_FEATURE (45)..(48): Xaa = any amino acid, non amino acid, or is absent
XXDFTXFPPXXNSXXNXLAXCXLSXXIXVXXXQLXIXXXGFXLKXXXX

SEQ ID NO: 35913 - protein, 49 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (43)..(43): Xaa = Asn or Asp
  MISC_FEATURE (44)..(44): Xaa = Asn or Glu
  MISC_FEATURE (45)..(49): Xaa = any amino acid, non amino acid, or is absent
XXDFTXFPPXXNSXXNXLAXCXLSXXIXVXXXQLXIXXXTPAXXXXXXX

SEQ ID NO: 35914 - protein, 45 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Ile, Phe, Trp, Tyr or Ala
  MISC_FEATURE (39)..(39): Xaa = Asp, Ala, Gln, Glu, Gly, His, Ile, Leu, Phe, Pro, Thr or Tyr
  MISC_FEATURE (40)..(40): Xaa = Gln, Leu, Trp or Tyr
  MISC_FEATURE (44)..(45): Xaa = any amino acid, non amino acid, or is absent
XXDFTXFPPXXNSXXNXLAXCXLSXXIXVXXXQLXIXXXXAPWXX

SEQ ID NO: 35915 - protein, 46 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (40)..(40): Xaa = Tyr or Pro
  MISC_FEATURE (41)..(41): Xaa = Trp, Tyr, Phe, Ala, Val, Cys, Thr, Leu, Ser, His, Gln, Glu, Gly or Ile
  MISC_FEATURE (42)..(42): Xaa = Trp, Ile, Phe, Pro, Asp, Gly, Cys or Ala
  MISC_FEATURE (43)..(43): Xaa = Gly or Asn
  MISC_FEATURE (45)..(46): Xaa = any amino acid, non amino acid, or is absent
XXDFTXFPPXXNSXXNXLAXCXLSXXIXVXXXQLXIXPPXXXXPXX

SEQ ID NO: 35916 - protein, 46 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Gly, Tyr or Trp
  MISC_FEATURE (39)..(39): Xaa = Trp, Val, Ile, Phe, Arg, Met, Ser or Leu
  MISC_FEATURE (40)..(40): Xaa = Ile or Gly
  MISC_FEATURE (41)..(41): Xaa = Tyr, Pro, His, Leu or Phe
  MISC_FEATURE (42)..(42): Xaa = Ile, Asp, Tyr, Phe, Val, Thr, Gly, Ala or Gln
  MISC_FEATURE (43)..(43): Xaa = Phe, Arg, Cys, Leu, Ala, Gln, Asp or Val
  MISC_FEATURE (44)..(44): Xaa = Phe or Tyr
  MISC_FEATURE (45)..(46): Xaa = any amino acid, non amino acid, or is absent
XXDFTXFPPXXNSXXNXLAXCXLSXXIXVXXXQLXIXXXXXXXXXX

SEQ ID NO: 35917 - protein, 46 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Pro or Ser
  MISC_FEATURE (44)..(44): Xaa = Pro, Tyr, Leu, Ala, Glu, Gly, Val or Ile
  MISC_FEATURE (45)..(46): Xaa = any amino acid, non amino acid, or is absent
XXDFTXFPPXXNSXXNXLAXCXLSXXIXVXXXQLXIXFXPPAPXXX

SEQ ID NO: 35918 - protein, 46 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (41)..(41): Xaa = Val or Ile
  MISC_FEATURE (45)..(46): Xaa = any amino acid, non amino acid, or is absent
XXDFTXFPPXXNSXXNXLAXCXLSXXIXVXXXQLXIXDFTXFPPXX

SEQ ID NO: 35919 - protein, 46 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Tyr, Thr or His
  MISC_FEATURE (42)..(42): Xaa = His or Ile
  MISC_FEATURE (44)..(44): Xaa = Tyr or Ala
  MISC_FEATURE (45)..(46): Xaa = any amino acid, non amino acid, or is absent
XXDFTXFPPXXNSXXNXLAXCXLSXXIXVXXXQLXIXXTPAXFXXX

SEQ ID NO: 35920 - protein, 49 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Pro or Ala
  MISC_FEATURE (41)..(41): Xaa = Ala, Pro, Trp, Asn or Leu
  MISC_FEATURE (44)..(44): Xaa = Pro or Phe
  MISC_FEATURE (48)..(49): Xaa = any amino acid, non amino acid, or is absent
XXDFTXFPPXXNSXXNXLAXCXLSXXIXVXXXQLXIXXARXTPXSPPXX

SEQ ID NO: 35921 - protein, 47 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Trp or Leu
  MISC_FEATURE (39)..(39): Xaa = Ala, Asn, Ser, Trp or Glu
  MISC_FEATURE (45)..(45): Xaa = Ser or Phe
  MISC_FEATURE (46)..(47): Xaa = any amino acid, non amino acid, or is absent
XXDFTXFPPXXNSXXNXLAXCXLSXXIXVXXXQLXIXXXTAYKPXXX

SEQ ID NO: 35922 - protein, 49 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Asn, Trp or Ala
  MISC_FEATURE (40)..(40): Xaa = Phe, Asn, Tyr or Pro
  MISC_FEATURE (41)..(41): Xaa = Pro, His, Tyr, Trp or Ala
  MISC_FEATURE (44)..(44): Xaa = Tyr or Ala
  MISC_FEATURE (46)..(46): Xaa = Trp or Gln
  MISC_FEATURE (47)..(47): Xaa = Arg or Gln
  MISC_FEATURE (48)..(49): Xaa = any amino acid, non amino acid, or is absent
XXDFTXFPPXXNSXXNXLAXCXLSXXIXVXXXQLXIXXAXXAPXIXXXX

SEQ ID NO: 35923 - protein, 49 aa, Artificial Sequence
  Synthetic construct
  MISC_FEATURE (1)..(2): Xaa = any amino acid, non amino acid, or is absent
  MISC_FEATURE (6)..(6): Xaa = Val or Ile
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Glu, Gly, Trp or Phe
  MISC_FEATURE (40)..(40): Xaa = Gly, Ala or Asn
  MISC_FEATURE (43)..(43): Xaa = His, Trp or Lys
  MISC_FEATURE (48)..(49): Xaa = any amino acid, non amino acid, or is absent
XXDFTXFPPXXNSXXNXLAXCXLSXXIXVXXXQLXIXHXXQPXAQEPXX

SEQ ID NO: 35924 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (42)..(42): Xaa = any amino acid, non amino acid, or is absent
  MISC_FEATURE (45)..(48): Xaa = any amino acid, non amino acid, or is absent
XXXTPAXFXXXNSXXNXLAXCXLSXXIXVXXXQLXIXXXGFXLKXXXX

SEQ ID NO: 35925 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(39): Xaa = any amino acid, non amino acid, or is absent
  MISC_FEATURE (43)..(43): Xaa = Asn or Asp
  MISC_FEATURE (44)..(44): Xaa = Asn or Glu
  MISC_FEATURE (45)..(49): Xaa = any amino acid, non amino acid, or is absent
XXXTPAXFXXXNSXXNXLAXCXLSXXIXVXXXQLXIXXXTPAXXXXXXX

SEQ ID NO: 35926 - protein, 45 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Ile, Phe, Trp, Tyr or Ala
  MISC_FEATURE (39)..(39): Xaa = Asp, Ala, Gln, Glu, Gly, His, Ile, Leu, Phe, Pro, Thr or Tyr
  MISC_FEATURE (40)..(40): Xaa = Gln, Leu, Trp or Tyr
  MISC_FEATURE (44)..(45): Xaa = any amino acid, non amino acid, or is absent
XXXTPAXFXXXNSXXNXLAXCXLSXXIXVXXXQLXIXXXXAPWXX

SEQ ID NO: 35927 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (40)..(40): Xaa = Tyr or Pro
  MISC_FEATURE (41)..(41): Xaa = Trp, Tyr, Phe, Ala, Val, Cys, Thr, Leu, Ser, His, Gln, Glu, Gly or Ile
  MISC_FEATURE (42)..(42): Xaa = Trp, Ile, Phe, Pro, Asp, Gly, Cys or Ala
  MISC_FEATURE (43)..(43): Xaa = Gly or Asn
  MISC_FEATURE (45)..(46): Xaa = any amino acid, non amino acid, or is absent
XXXTPAXFXXXNSXXNXLAXCXLSXXIXVXXXQLXIXPPXXXXPXX

SEQ ID NO: 35928 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Gly, Tyr or Trp
  MISC_FEATURE (39)..(39): Xaa = Trp, Val, Ile, Phe, Arg, Met, Ser or Leu
  MISC_FEATURE (40)..(40): Xaa = Ile or Gly
  MISC_FEATURE (41)..(41): Xaa = Tyr, Pro, His, Leu or Phe
  MISC_FEATURE (42)..(42): Xaa = Ile, Asp, Tyr, Phe, Val, Thr, Gly, Ala or Gln
  MISC_FEATURE (43)..(43): Xaa = Phe, Arg, Cys, Leu, Ala, Gln, Asp or Val
  MISC_FEATURE (44)..(44): Xaa = Phe or Tyr
  MISC_FEATURE (45)..(46): Xaa = any amino acid, non amino acid, or is absent
XXXTPAXFXXXNSXXNXLAXCXLSXXIXVXXXQLXIXXXXXXXXXX

SEQ ID NO: 35929 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Pro or Ser
  MISC_FEATURE (44)..(44): Xaa = Pro, Tyr, Leu, Ala, Glu, Gly, Val or Ile
  MISC_FEATURE (45)..(46): Xaa = any amino acid, non amino acid, or is absent
XXXTPAXFXXXNSXXNXLAXCXLSXXIXVXXXQLXIXFXPPAPXXX

SEQ ID NO: 35930 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (41)..(41): Xaa = Val or Ile
  MISC_FEATURE (45)..(46): Xaa = any amino acid, non amino acid, or is absent
XXXTPAXFXXXNSXXNXLAXCXLSXXIXVXXXQLXIXDFTXFPPXX

SEQ ID NO: 35931 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Tyr, Thr or His
  MISC_FEATURE (42)..(42): Xaa = His or Ile
  MISC_FEATURE (44)..(44): Xaa = Tyr or Ala
  MISC_FEATURE (45)..(46): Xaa = any amino acid, non amino acid, or is absent
XXXTPAXFXXXNSXXNXLAXCXLSXXIXVXXXQLXIXXTPAXFXXX

SEQ ID NO: 35932 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Pro or Ala
  MISC_FEATURE (41)..(41): Xaa = Ala, Pro, Trp, Asn or Leu
  MISC_FEATURE (44)..(44): Xaa = Pro or Phe
  MISC_FEATURE (48)..(49): Xaa = any amino acid, non amino acid, or is absent
XXXTPAXFXXXNSXXNXLAXCXLSXXIXVXXXQLXIXXARXTPXSPPXX

SEQ ID NO: 35933 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Trp or Leu
  MISC_FEATURE (39)..(39): Xaa = Ala, Asn, Ser, Trp or Glu
  MISC_FEATURE (45)..(45): Xaa = Ser or Phe
  MISC_FEATURE (46)..(47): Xaa = any amino acid, non amino acid, or is absent
XXXTPAXFXXXNSXXNXLAXCXLSXXIXVXXXQLXIXXXTAYKPXXX

SEQ ID NO: 35934 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (38)..(38): Xaa = Asn, Trp or Ala
  MISC_FEATURE (40)..(40): Xaa = Phe, Asn, Tyr or Pro
  MISC_FEATURE (41)..(41): Xaa = Pro, His, Tyr, Trp or Ala
  MISC_FEATURE (44)..(44): Xaa = Tyr or Ala
  MISC_FEATURE (46)..(46): Xaa = Trp or Gln
  MISC_FEATURE (47)..(47): Xaa = Arg or Gln
  MISC_FEATURE (48)..(49): Xaa = any amino acid, non amino acid, or is absent
XXXTPAXFXXXNSXXNXLAXCXLSXXIXVXXXQLXIXXAXXAPXIXXXX

SEQ ID NO: 35935 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Tyr, Thr or His
  MISC_FEATURE (7)..(7): Xaa = His or Ile
  MISC_FEATURE (9)..(9): Xaa = Tyr or Ala
  MISC_FEATURE (10)..(11): Xaa = Phe, Trp or Thr
  MISC_FEATURE (14)..(15): Xaa = Phe, Trp or Thr
  MISC_FEATURE (17)..(17): Xaa = Arg, His or Lys
  MISC_FEATURE (20)..(20): Xaa = Asp or Glu
  MISC_FEATURE (22)..(22): Xaa = Ala or Gly
  MISC_FEATURE (25)..(25): Xaa = Arg, His or Lys
  MISC_FEATURE (26)..(26): Xaa = Ala, Cys, Gly, Ile, Leu, Met, Asn, Pro, Gln, Ser, Val or Tyr
  MISC_FEATURE (28)..(28): Xaa = Arg, His or Lys
  MISC_FEATURE (30)..(30): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (32)..(32): Xaa = Ala, Cys, Gly, Ile, Leu, Met, Asn, Pro, Gln, Ser, Val or Tyr
  MISC_FEATURE (35)..(35): Xaa = Ala, Cys, Gly, Ile, Leu, Met, Asn, Pro, Gln, Ser, Val or Tyr
  MISC_FEATURE (37)..(37): Xaa = Asp or Glu
  MISC_FEATURE (39)..(39): Xaa = Glu, Gly, Trp or Phe
  MISC_FEATURE (40)..(40): Xaa = Gly, Ala or Asn
  MISC_FEATURE (43)..(43): Xaa = His, Trp or Lys
  MISC_FEATURE (48)..(49): Xaa = any amino acid, non amino acid, or is absent
XXXTPAXFXXXNSXXNXLAXCXLSXXIXVXXXQLXIXHXXQPXAQEPXX

SEQ ID NO: 35936 - protein, 51 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (45)..(45): Xaa = any amino acid, non amino acid, or is absent
  MISC_FEATURE (48)..(51): Xaa = any amino acid, non amino acid, or is absent
XXXARXTPXSPPXXNSXXNXLAXCXLSXXIXVXXXQLXIXXXGFXLKXXXX

SEQ ID NO: 35937 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (46)..(46): Xaa = Asn or Asp
  MISC_FEATURE (47)..(47): Xaa = Asn or Glu
  MISC_FEATURE (48)..(52): Xaa = any amino acid, non amino acid, or is absent
XXXARXTPXSPPXXNSXXNXLAXCXLSXXIXVXXXQLXIXXXTPAXXXXXXX

SEQ ID NO: 35938 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Ile, Phe, Trp, Tyr or Ala
  MISC_FEATURE (42)..(42): Xaa = Asp, Ala, Gln, Glu, Gly, His, Ile, Leu, Phe, Pro, Thr or Tyr
  MISC_FEATURE (43)..(43): Xaa = Gln, Leu, Trp or Tyr
  MISC_FEATURE (47)..(48): Xaa = any amino acid, non amino acid, or is absent
XXXARXTPXSPPXXNSXXNXLAXCXLSXXIXVXXXQLXIXXXXAPWXX

SEQ ID NO: 35939 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (43)..(43): Xaa = Tyr or Pro
  MISC_FEATURE (44)..(44): Xaa = Trp, Tyr, Phe, Ala, Val, Cys, Thr, Leu, Ser, His, Gln, Glu, Gly or Ile
  MISC_FEATURE (45)..(45): Xaa = Trp, Ile, Phe, Pro, Asp, Gly, Cys or Ala
  MISC_FEATURE (46)..(46): Xaa = Gly or Asn
  MISC_FEATURE (48)..(49): Xaa = any amino acid, non amino acid, or is absent
XXXARXTPXSPPXXNSXXNXLAXCXLSXXIXVXXXQLXIXPPXXXXPXX

SEQ ID NO: 35940 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Gly, Tyr or Trp
  MISC_FEATURE (42)..(42): Xaa = Trp, Val, Ile, Phe, Arg, Met, Ser or Leu
  MISC_FEATURE (43)..(43): Xaa = Ile or Gly
  MISC_FEATURE (44)..(44): Xaa = Tyr, Pro, His, Leu or Phe
  MISC_FEATURE (45)..(45): Xaa = Ile, Asp, Tyr, Phe, Val, Thr, Gly, Ala or Gln
  MISC_FEATURE (46)..(46): Xaa = Phe, Arg, Cys, Leu, Ala, Gln, Asp or Val
  MISC_FEATURE (47)..(47): Xaa = Phe or Tyr
  MISC_FEATURE (48)..(49): Xaa = any amino acid, non amino acid, or is absent
XXXARXTPXSPPXXNSXXNXLAXCXLSXXIXVXXXQLXIXXXXXXXXXX

SEQ ID NO: 35941 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Pro or Ser
  MISC_FEATURE (47)..(47): Xaa = Pro, Tyr, Leu, Ala, Glu, Gly, Val or Ile
  MISC_FEATURE (48)..(49): Xaa = any amino acid, non amino acid, or is absent
XXXARXTPXSPPXXNSXXNXLAXCXLSXXIXVXXXQLXIXFXPPAPXXX

SEQ ID NO: 35942 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (44)..(44): Xaa = Val or Ile
  MISC_FEATURE (48)..(49): Xaa = any amino acid, non amino acid, or is absent
XXXARXTPXSPPXXNSXXNXLAXCXLSXXIXVXXXQLXIXDFTXFPPXX

SEQ ID NO: 35943 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Tyr, Thr or His
  MISC_FEATURE (45)..(45): Xaa = His or Ile
  MISC_FEATURE (47)..(47): Xaa = Tyr or Ala
  MISC_FEATURE (48)..(49): Xaa = any amino acid, non amino acid, or is absent
XXXARXTPXSPPXXNSXXNXLAXCXLSXXIXVXXXQLXIXXTPAXFXXX

SEQ ID NO: 35944 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Pro or Ala
  MISC_FEATURE (44)..(44): Xaa = Ala, Pro, Trp, Asn or Leu
  MISC_FEATURE (47)..(47): Xaa = Pro or Phe
  MISC_FEATURE (51)..(52): Xaa = any amino acid, non amino acid, or is absent
XXXARXTPXSPPXXNSXXNXLAXCXLSXXIXVXXXQLXIXXARXTPXSPPXX

SEQ ID NO: 35945 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Trp or Leu
  MISC_FEATURE (42)..(42): Xaa = Ala, Asn, Ser, Trp or Glu
  MISC_FEATURE (48)..(48): Xaa = Ser or Phe
  MISC_FEATURE (49)..(50): Xaa = any amino acid, non amino acid, or is absent
XXXARXTPXSPPXXNSXXNXLAXCXLSXXIXVXXXQLXIXXXTAYKPXXX

SEQ ID NO: 35946 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Asn, Trp or Ala
  MISC_FEATURE (43)..(43): Xaa = Phe, Asn, Tyr or Pro
  MISC_FEATURE (44)..(44): Xaa = Pro, His, Tyr, Trp or Ala
  MISC_FEATURE (47)..(47): Xaa = Tyr or Ala
  MISC_FEATURE (49)..(49): Xaa = Trp or Gln
  MISC_FEATURE (50)..(50): Xaa = Arg or Gln
  MISC_FEATURE (51)..(52): Xaa = any amino acid, non amino acid, or is absent
XXXARXTPXSPPXXNSXXNXLAXCXLSXXIXVXXXQLXIXXAXXAPXIXXXX

SEQ ID NO: 35947 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Pro or Ala
  MISC_FEATURE (6)..(6): Xaa = Ala, Pro, Trp, Asn or Leu
  MISC_FEATURE (9)..(9): Xaa = Pro or Phe
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Glu, Gly, Trp or Phe
  MISC_FEATURE (43)..(43): Xaa = Gly, Ala or Asn
  MISC_FEATURE (46)..(46): Xaa = His, Trp or Lys
  MISC_FEATURE (51)..(52): Xaa = any amino acid, non amino acid, or is absent
XXXARXTPXSPPXXNSXXNXLAXCXLSXXIXVXXXQLXIXHXXQPXAQEPXX

SEQ ID NO: 35948 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(40): Xaa = any amino acid, non amino acid, or is absent
  MISC_FEATURE (43)..(43): Xaa = any amino acid, non amino acid, or is absent
  MISC_FEATURE (46)..(49): Xaa = any amino acid, non amino acid, or is absent
XXXXTAYKPXXXNSXXNXLAXCXLSXXIXVXXXQLXIXXXGFXLKXXXX

SEQ ID NO: 35949 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(40): Xaa = any amino acid, non amino acid, or is absent
  MISC_FEATURE (44)..(44): Xaa = Asn or Asp
  MISC_FEATURE (45)..(45): Xaa = Asn or Glu
  MISC_FEATURE (46)..(50): Xaa = any amino acid, non amino acid, or is absent
XXXXTAYKPXXXNSXXNXLAXCXLSXXIXVXXXQLXIXXXTPAXXXXXXX

SEQ ID NO: 35950 - protein, 46 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Ile, Phe, Trp, Tyr or Ala
  MISC_FEATURE (40)..(40): Xaa = Asp, Ala, Gln, Glu, Gly, His, Ile, Leu, Phe, Pro, Thr or Tyr
  MISC_FEATURE (41)..(41): Xaa = Gln, Leu, Trp or Tyr
  MISC_FEATURE (45)..(46): Xaa = any amino acid, non amino acid, or is absent
XXXXTAYKPXXXNSXXNXLAXCXLSXXIXVXXXQLXIXXXXAPWXX

SEQ ID NO: 35951 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (41)..(41): Xaa = Tyr or Pro
  MISC_FEATURE (42)..(42): Xaa = Trp, Tyr, Phe, Ala, Val, Cys, Thr, Leu, Ser, His, Gln, Glu, Gly or Ile
  MISC_FEATURE (43)..(43): Xaa = Trp, Ile, Phe, Pro, Asp, Gly, Cys or Ala
  MISC_FEATURE (44)..(44): Xaa = Gly or Asn
  MISC_FEATURE (46)..(47): Xaa = any amino acid, non amino acid, or is absent
XXXXTAYKPXXXNSXXNXLAXCXLSXXIXVXXXQLXIXPPXXXXPXX

SEQ ID NO: 35952 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Gly, Tyr or Trp
  MISC_FEATURE (40)..(40): Xaa = Trp, Val, Ile, Phe, Arg, Met, Ser or Leu
  MISC_FEATURE (41)..(41): Xaa = Ile or Gly
  MISC_FEATURE (42)..(42): Xaa = Tyr, Pro, His, Leu or Phe
  MISC_FEATURE (43)..(43): Xaa = Ile, Asp, Tyr, Phe, Val, Thr, Gly, Ala or Gln
  MISC_FEATURE (44)..(44): Xaa = Phe, Arg, Cys, Leu, Ala, Gln, Asp or Val
  MISC_FEATURE (45)..(45): Xaa = Phe or Tyr
  MISC_FEATURE (46)..(47): Xaa = any amino acid, non amino acid, or is absent
XXXXTAYKPXXXNSXXNXLAXCXLSXXIXVXXXQLXIXXXXXXXXXX

SEQ ID NO: 35953 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (40)..(40): Xaa = Pro or Ser
  MISC_FEATURE (45)..(45): Xaa = Pro, Tyr, Leu, Ala, Glu, Gly, Val or Ile
  MISC_FEATURE (46)..(47): Xaa = any amino acid, non amino acid, or is absent
XXXXTAYKPXXXNSXXNXLAXCXLSXXIXVXXXQLXIXFXPPAPXXX

SEQ ID NO: 35954 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (42)..(42): Xaa = Val or Ile
  MISC_FEATURE (46)..(47): Xaa = any amino acid, non amino acid, or is absent
XXXXTAYKPXXXNSXXNXLAXCXLSXXIXVXXXQLXIXDFTXFPPXX

SEQ ID NO: 35955 - protein, 47 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Tyr, Thr or His
  MISC_FEATURE (43)..(43): Xaa = His or Ile
  MISC_FEATURE (45)..(45): Xaa = Tyr or Ala
  MISC_FEATURE (46)..(47): Xaa = any amino acid, non amino acid, or is absent
XXXXTAYKPXXXNSXXNXLAXCXLSXXIXVXXXQLXIXXTPAXFXXX

SEQ ID NO: 35956 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Pro or Ala
  MISC_FEATURE (42)..(42): Xaa = Ala, Pro, Trp, Asn or Leu
  MISC_FEATURE (45)..(45): Xaa = Pro or Phe
  MISC_FEATURE (49)..(50): Xaa = any amino acid, non amino acid, or is absent
XXXXTAYKPXXXNSXXNXLAXCXLSXXIXVXXXQLXIXXARXTPXSPPXX

SEQ ID NO: 35957 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Trp or Leu
  MISC_FEATURE (40)..(40): Xaa = Ala, Asn, Ser, Trp or Glu
  MISC_FEATURE (46)..(46): Xaa = Ser or Phe
  MISC_FEATURE (47)..(48): Xaa = any amino acid, non amino acid, or is absent
XXXXTAYKPXXXNSXXNXLAXCXLSXXIXVXXXQLXIXXXTAYKPXXX

SEQ ID NO: 35958 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (39)..(39): Xaa = Asn, Trp or Ala
  MISC_FEATURE (41)..(41): Xaa = Phe, Asn, Tyr or Pro
  MISC_FEATURE (42)..(42): Xaa = Pro, His, Tyr, Trp or Ala
  MISC_FEATURE (45)..(45): Xaa = Tyr or Ala
  MISC_FEATURE (47)..(47): Xaa = Trp or Gln
  MISC_FEATURE (48)..(48): Xaa = Arg or Gln
  MISC_FEATURE (49)..(50): Xaa = any amino acid, non amino acid, or is absent
XXXXTAYKPXXXNSXXNXLAXCXLSXXIXVXXXQLXIXXAXXAPXIXXXX

SEQ ID NO: 35959 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Trp or Leu
  MISC_FEATURE (4)..(4): Xaa = Ala, Asn, Ser, Trp or Glu
  MISC_FEATURE (10)..(10): Xaa = Ser or Phe
  MISC_FEATURE (11)..(12): Xaa = Phe, Trp or Thr
  MISC_FEATURE (15)..(16): Xaa = Phe, Trp or Thr
  MISC_FEATURE (18)..(18): Xaa = Arg, His or Lys
  MISC_FEATURE (21)..(21): Xaa = Asp or Glu
  MISC_FEATURE (23)..(23): Xaa = Ala or Gly
  MISC_FEATURE (26)..(26): Xaa = Arg, His or Lys
  MISC_FEATURE (27)..(27): Xaa = Ala, Cys, Gly, Ile, Leu, Met, Asn, Pro, Gln, Ser, Val or Tyr
  MISC_FEATURE (29)..(29): Xaa = Arg, His or Lys
  MISC_FEATURE (31)..(31): Xaa = Ala, Cys, Gly, Ile, Leu, Met, Asn, Pro, Gln, Ser, Val or Tyr
  MISC_FEATURE (32)..(32): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (36)..(36): Xaa = Ala, Cys, Gly, Ile, Leu, Met, Asn, Pro, Gln, Ser, Val or Tyr
  MISC_FEATURE (38)..(38): Xaa = Asp or Glu
  MISC_FEATURE (40)..(40): Xaa = Glu, Gly, Trp or Phe
  MISC_FEATURE (41)..(41): Xaa = Gly, Ala or Asn
  MISC_FEATURE (44)..(44): Xaa = His, Trp or Lys
  MISC_FEATURE (49)..(50): Xaa = any amino acid, non amino acid, or is absent
XXXXTAYKPXXXNSXXNXLAXCXLSXXIXVXXXQLXIXHXXQPXAQEPXX

SEQ ID NO: 35960 - protein, 51 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (45)..(45): Xaa = any amino acid, non amino acid, or is absent
  MISC_FEATURE (48)..(51): Xaa = any amino acid, non amino acid, or is absent
XXXAXXAPXIXXXXNSXXNXLAXCXLSXXIXVXXXQLXIXXXGFXLKXXXX

SEQ ID NO: 35961 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(42): Xaa = any amino acid, non amino acid, or is absent
  MISC_FEATURE (46)..(46): Xaa = Asn or Asp
  MISC_FEATURE (47)..(47): Xaa = Asn or Glu
  MISC_FEATURE (48)..(52): Xaa = any amino acid, non amino acid, or is absent
XXXAXXAPXIXXXXNSXXNXLAXCXLSXXIXVXXXQLXIXXXTPAXXXXXXX

SEQ ID NO: 35962 - protein, 48 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Ile, Phe, Trp, Tyr or Ala
  MISC_FEATURE (42)..(42): Xaa = Asp, Ala, Gln, Glu, Gly, His, Ile, Leu, Phe, Pro, Thr or Tyr
  MISC_FEATURE (43)..(43): Xaa = Gln, Leu, Trp or Tyr
  MISC_FEATURE (47)..(48): Xaa = any amino acid, non amino acid, or is absent
XXXAXXAPXIXXXXNSXXNXLAXCXLSXXIXVXXXQLXIXXXXAPWXX

SEQ ID NO: 35963 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (43)..(43): Xaa = Tyr or Pro
  MISC_FEATURE (44)..(44): Xaa = Trp, Tyr, Phe, Ala, Val, Cys, Thr, Leu, Ser, His, Gln, Glu, Gly or Ile
  MISC_FEATURE (45)..(45): Xaa = Trp, Ile, Phe, Pro, Asp, Gly, Cys or Ala
  MISC_FEATURE (46)..(46): Xaa = Gly or Asn
  MISC_FEATURE (48)..(49): Xaa = any amino acid, non amino acid, or is absent
XXXAXXAPXIXXXXNSXXNXLAXCXLSXXIXVXXXQLXIXPPXXXXPXX

SEQ ID NO: 35964 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Gly, Tyr or Trp
  MISC_FEATURE (42)..(42): Xaa = Trp, Val, Ile, Phe, Arg, Met, Ser or Leu
  MISC_FEATURE (43)..(43): Xaa = Ile or Gly
  MISC_FEATURE (44)..(44): Xaa = Tyr, Pro, His, Leu or Phe
  MISC_FEATURE (45)..(45): Xaa = Ile, Asp, Tyr, Phe, Val, Thr, Gly, Ala or Gln
  MISC_FEATURE (46)..(46): Xaa = Phe, Arg, Cys, Leu, Ala, Gln, Asp or Val
  MISC_FEATURE (47)..(47): Xaa = Phe or Tyr
  MISC_FEATURE (48)..(49): Xaa = any amino acid, non amino acid, or is absent
XXXAXXAPXIXXXXNSXXNXLAXCXLSXXIXVXXXQLXIXXXXXXXXXX

SEQ ID NO: 35965 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (42)..(42): Xaa = Pro or Ser
  MISC_FEATURE (47)..(47): Xaa = Pro, Tyr, Leu, Ala, Glu, Gly, Val or Ile
  MISC_FEATURE (48)..(49): Xaa = any amino acid, non amino acid, or is absent
XXXAXXAPXIXXXXNSXXNXLAXCXLSXXIXVXXXQLXIXFXPPAPXXX

SEQ ID NO: 35966 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (44)..(44): Xaa = Val or Ile
  MISC_FEATURE (48)..(49): Xaa = any amino acid, non amino acid, or is absent
XXXAXXAPXIXXXXNSXXNXLAXCXLSXXIXVXXXQLXIXDFTXFPPXX

SEQ ID NO: 35967 - protein, 49 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Tyr, Thr or His
  MISC_FEATURE (45)..(45): Xaa = His or Ile
  MISC_FEATURE (47)..(47): Xaa = Tyr or Ala
  MISC_FEATURE (48)..(49): Xaa = any amino acid, non amino acid, or is absent
XXXAXXAPXIXXXXNSXXNXLAXCXLSXXIXVXXXQLXIXXTPAXFXXX

SEQ ID NO: 35968 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Pro or Ala
  MISC_FEATURE (44)..(44): Xaa = Ala, Pro, Trp, Asn or Leu
  MISC_FEATURE (47)..(47): Xaa = Pro or Phe
  MISC_FEATURE (51)..(52): Xaa = any amino acid, non amino acid, or is absent
XXXAXXAPXIXXXXNSXXNXLAXCXLSXXIXVXXXQLXIXXARXTPXSPPXX

SEQ ID NO: 35969 - protein, 50 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Trp or Leu
  MISC_FEATURE (42)..(42): Xaa = Ala, Asn, Ser, Trp or Glu
  MISC_FEATURE (48)..(48): Xaa = Ser or Phe
  MISC_FEATURE (49)..(50): Xaa = any amino acid, non amino acid, or is absent
XXXAXXAPXIXXXXNSXXNXLAXCXLSXXIXVXXXQLXIXXXTAYKPXXX

SEQ ID NO: 35970 - protein, 52 aa, Artificial Sequence
  Synthetic construct
  MISC_FEATURE (1)..(2): Xaa = any amino acid, non amino acid, or is absent
  MISC_FEATURE (3)..(3): Xaa = Asn, Trp or Ala
  MISC_FEATURE (5)..(5): Xaa = Phe, Asn, Tyr or Pro
  MISC_FEATURE (6)..(6): Xaa = Pro, His, Tyr, Trp or Ala
  MISC_FEATURE (9)..(9): Xaa = Tyr or Ala
  MISC_FEATURE (11)..(11): Xaa = Trp or Gln
  MISC_FEATURE (12)..(12): Xaa = Arg or Gln
  MISC_FEATURE (13)..(14): Xaa = Phe, Trp or Thr
  MISC_FEATURE (17)..(18): Xaa = Phe, Trp or Thr
  MISC_FEATURE (20)..(20): Xaa = Arg, His or Lys
  MISC_FEATURE (23)..(23): Xaa = Asp or Glu
  MISC_FEATURE (25)..(25): Xaa = Ala or Gly
  MISC_FEATURE (28)..(28): Xaa = Arg, His or Lys
  MISC_FEATURE (29)..(29): Xaa = Ala, Cys, Gly, Ile, Leu, Met, Asn, Pro, Gln, Ser, Val or Tyr
  MISC_FEATURE (31)..(31): Xaa = Arg, His or Lys
  MISC_FEATURE (33)..(33): Xaa = Ala, Cys, Gly, Ile, Leu, Met, Asn, Pro, Gln, Ser, Val or Tyr
  MISC_FEATURE (34)..(34): Xaa = Arg, His or Lys
  MISC_FEATURE (35)..(35): Xaa = Ala, Cys, Gly, Ile, Leu, Met, Asn, Pro, Gln, Ser, Val or Tyr
  MISC_FEATURE (38)..(38): Xaa = Ala, Cys, Gly, Ile, Leu, Met, Asn, Pro, Gln, Ser, Val or Tyr
  MISC_FEATURE (40)..(40): Xaa = Asp or Glu
  MISC_FEATURE (41)..(41): Xaa = Asn, Trp or Ala
  MISC_FEATURE (43)..(43): Xaa = Phe, Asn, Tyr or Pro
  MISC_FEATURE (44)..(44): Xaa = Pro, His, Tyr, Trp or Ala
  MISC_FEATURE (47)..(47): Xaa = Tyr or Ala
  MISC_FEATURE (49)..(49): Xaa = Trp or Gln
  MISC_FEATURE (50)..(50): Xaa = Arg or Gln
  MISC_FEATURE (51)..(52): Xaa = any amino acid, non amino acid, or is absent
XXXAXXAPXIXXXXNSXXNXLAXCXLSXXIXVXXXQLXIXXAXXAPXIXXXX

(The sequence listing continues in the following parts.)

We claim:

1. A therapeutic composition for improving a Toll-like receptor (TLR)-related condition, the therapeutic composition comprising a peptide configured to modulate TLR-related functionality and derived based on reengineering of a target peptide sequence associated with a microorganism-related modulator associated with Amuc_1100 protein from *Akkermansia muciniphila*, wherein the peptide corresponds to a peptide sequence comprising at least one motif of a set of peptide sequence motifs comprising:

a first motif comprising XXGFXLKXX (SEQ ID NO: 1), wherein X in the first motif comprises any amino acid type or no amino acid;

a second motif comprising XXTPA[Z][B]XXX (SEQ ID NOS:2-5), wherein X in the second motif comprises any amino acid type or no amino acid, wherein Z in the second motif comprises at least one of (N,D), and wherein B in the second motif comprises at least one of (N,E);

a third motif comprising [X][Z][B]APW (SEQ ID NOS: 6-245), wherein X in the third motif comprises at least one of (I,F,W,Y,A), wherein Z in the third motif comprises at least one of (D,A,Q,E,G,H,I,L,F,P,T,Y), and wherein B in the third motif comprises at least one of (Q,L,W,Y);

a fourth motif comprising PP[X][Z][B][O]P (SEQ ID NOS:246-693), wherein X in the fourth motif comprises at least one of (Y,P), wherein Z in the fourth motif comprises at least one of (W,Y,F,A,V,C,T,L,S,H,Q,E,G,I), wherein B in the fourth motif comprises at least one of (W,I,F,P,D,G,C,A), and wherein O in the fourth motif comprises at least one of (G,N);

a fifth motif comprising [X][Z][i][O][B][J][f] (SEQ ID NOS: 694-35253), wherein X in the fifth motif comprises at least one of (G,Y,W), wherein Z in the fifth motif comprises at least one of (W,V,I,F,R,M,S,L), wherein i in the fifth motif comprises at least one of (I,G), wherein O in the fifth motif comprises at least one of (Y,P,H,L,F), wherein B in the fifth motif comprises at least one of (I,D,Y,F,V,T,G,A,Q), wherein J in the fifth motif comprises at least one of (F,R,C,L,A,Q,D,V), and wherein f in the fifth motif comprises at least one of (F,Y);

a tenth motif comprising [X][J]TAYKP[B] (SEQ ID NOS: 35304-35323), wherein X in the tenth motif comprises at least one of (W,L), wherein J in the tenth motif comprises at least one of (A,N,S,W,E), and wherein B in the tenth motif comprises at least one of (S,F);

an eleventh motif comprising [X]A[J][B]AP[Z]I[O][U] (SEQ ID NOS:35324-35803), wherein X in the eleventh motif comprises at least one of (N,W,A), wherein J in the eleventh motif comprises at least one of (F,N,Y,P), wherein B in the eleventh motif comprises at least one of (P,H,Y,W,A), wherein Z in the eleventh motif comprises at least one of (Y,A), wherein O in the eleventh motif comprises at least one of (W,Q), and wherein U in the eleventh motif comprises at least one of (R, Q); and a twelfth motif comprising H[X][J]QP[B]AQEP (SEQ ID NOS:35804-35839), wherein X in the twelfth motif comprises at least one of (E,G,W,F), wherein J in the twelfth motif comprises at least one of (G,A,N), and wherein B in the twelfth motif comprises at least one of (H,W,K).

2. The therapeutic composition of claim 1, wherein the peptide is derived based on reengineering of the target peptide sequence associated with the microorganism-related modulator associated with Amuc_1100 and on a binding parameter value for the peptide for a TLR binding site for Staphylococcal Superantigen-Like protein 3 (SSL3), and wherein the peptide corresponds to the peptide sequence comprising the at least one motif comprising at least one of the third motif, the fourth motif, and the fifth motif.

3. The therapeutic composition of claim 1, wherein the peptide is derived based on reengineering of the target peptide sequence associated with the microorganism-related modulator associated with Amuc_1100 and on a binding parameter value for the peptide for a TLR binding site for a proline-proline glutamic acid protein, and wherein the peptide corresponds to the peptide sequence comprising the at least one motif comprising at least one of the tenth motif, the eleventh motif, and the twelfth motif.

4. A therapeutic composition for improving a Toll-like receptor (TLR)-related condition, the therapeutic composition comprising a peptide configured to modulate TLR-related functionality and derived based on reengineering of a target peptide sequence associated with a microorganism-related modulator associated with Rv1168c protein from *Mycobacterium tuberculosis*, wherein the peptide corresponds to a peptide sequence comprising at least one motif of a set of peptide sequence motifs comprising:

a sixth motif comprising F[X]PPAP[J] (SEQ ID NOS: 35254-35269), wherein X in the sixth motif comprises at least one of (P,S), and wherein J in the sixth motif comprises at least one of (P,Y,L,A,E,G,V,I);

a seventh motif comprising DFT[X]FPP (SEQ ID NOS: 35270-35271), wherein X in the seventh motif comprises at least one of (V,I);

an eighth motif comprising [X]TPA[J]F[B] (SEQ ID NOS:35272-35283), wherein X in the eight motif comprises at least one of (Y,T,H), wherein J in the eight motif comprises at least one of (H,I), and wherein B in the eight motif comprises at least one of (Y,A); and a ninth motif comprising [B]AR[X]TP[Z]SPP (SEQ ID NOS:35284-35303), wherein B in the ninth motif comprises at least one of (P,A), wherein X in the ninth motif comprises at least one of (A,P,W,N,L), and wherein Z in the ninth motif comprises at least one of (P,F).

5. The therapeutic composition of claim 4, wherein the peptide is derived based on reengineering of the target peptide sequence associated with the microorganism-related modulator associated with Rv1168c and on a binding parameter value for the peptide for a TLR binding site for Staphylococcal Superantigen-Like protein 3 (SSL3), and wherein the peptide corresponds to the peptide sequence comprising the at least one motif comprising at least one of the sixth motif, the seventh motif, and the eighth motif.

6. The therapeutic composition of claim 4, wherein the peptide is derived based on reengineering of the target peptide sequence associated with the microorganism-related modulator associated with Rv1168c and on a binding parameter value for the peptide for a TLR binding site for a proline-proline glutamic acid protein, and wherein the peptide corresponds to the peptide sequence comprising the at least one motif comprising the ninth motif.

7. The therapeutic composition of claim 1 or 4, wherein the peptide is configured to modulate TLR2-related functionality and derived based on reengineering of the target peptide sequence associated with a microorganism-related modulator of TLR2, and wherein the TLR-related condition comprises at least one of a metabolic disease and an immune disorder.

8. The therapeutic composition of claim 1 or 4, wherein the peptide corresponds to the peptide sequence with at least 90% identity to a determined peptide sequence comprising the at least one motif of the set of peptide sequence motifs.

9. A therapeutic composition for improving a Toll-like receptor (TLR)-related condition, the therapeutic composition comprising a peptide configured to modulate TLR-related functionality and derived based on reengineering of a target peptide sequence associated with a microorganism-related modulator associated of a TLR, wherein the peptide corresponds to a peptide sequence comprising nXX[MOTIF1][α][α]NS[α][α]N[β]LA[γ]C[AG]LS[β][δ]I[β]V[δ][β][δ]QL[δ]I[γ][MOTIF2]XXn (SEQ ID NOS:35840-35983), wherein α comprises an aromatic type amino acid selected from at least one of F, W and T, wherein β comprises a positive type amino acid selected from at least one of R, H and K, wherein γ comprises a negative type amino acid selected from at least one of D and E, wherein δ comprises any amino acid, except for α, β and γ types, wherein X comprises any amino acid type or no amino acid, wherein n comprises any number and type of amino acid, wherein MOTIF1 comprises a first target motif from a set of peptide sequence motifs, wherein MOTIF2 comprises a second target motif from a set of peptide sequence motifs, and wherein the set of peptide sequence motifs comprising:

a first motif comprising XXGFXLKXX (SEQ ID NO: 1), wherein X in the first motif comprises any amino acid type or no amino acid;

a second motif comprising XXTPA[Z][B]XXX (SEQ ID NOS:2-5), wherein X in the second motif comprises any amino acid type or no amino acid, wherein Z in the second motif comprises at least one of (N,D), and wherein B in the second motif comprises at least one of (N,E);

a third motif comprising [X][Z][B]APW (SEQ ID NOS: 6-245), wherein X in the third motif comprises at least one of (I,F,W,Y,A), wherein Z in the third motif comprises at least one of (D,A,Q,E,G,H,I,L,F,P,T,Y), and wherein B in the third motif comprises at least one of (Q,L,W,Y);

a fourth motif comprising PP[X][Z][B][O]P (SEQ ID NOS:246-693), wherein X in the fourth motif comprises at least one of (Y,P), wherein Z in the fourth motif comprises at least one of (W,Y,F,A,V,C,T,L,S,H,Q,E,G,I), wherein B in the fourth motif comprises at least one of (W,I,F,P,D,G,C,A), and wherein O in the fourth motif comprises at least one of (G,N);

a fifth motif comprising [X][Z][i][O][B][J][f] (SEQ ID NOS: 694-35253), wherein X in the fifth motif comprises at least one of (G,Y,W), wherein Z in the fifth motif comprises at least one of (W,V,I,F,R,M,S,L), wherein i in the fifth motif comprises at least one of (I,G), wherein O in the fifth motif comprises at least one of (Y,P,H,L,F), wherein B in the fifth motif comprises at least one of (I,D,Y,F,V,T,G,A,Q), wherein J in the fifth motif comprises at least one of (F,R,C,L,A,Q,D,V), and wherein f in the fifth motif comprises at least one of (F,Y);

a sixth motif comprising F[X]PPAP[J] (SEQ ID NOS: 35254-35269), wherein X in the sixth motif comprises at least one of (P,S), and wherein J in the sixth motif comprises at least one of (P,Y,L,A,E,G,V,I);

a seventh motif comprising DFT[X]FPP (SEQ ID NOS: 35270-35271), wherein X in the seventh motif comprises at least one of (V,I);

an eighth motif comprising [X]TPA[J]F[B] (SEQ ID NOS:35272-35283), wherein X in the eight motif comprises at least one of (Y,T,H), wherein J in the eight motif comprises at least one of (H,I), and wherein B in the eight motif comprises at least one of (Y,A);

a ninth motif comprising [B]AR[X]TP[Z]SPP (SEQ ID NOS:35284-35303), wherein B in the ninth motif comprises at least one of (P,A), wherein X in the ninth motif comprises at least one of (A,P,W,N,L), and wherein Z in the ninth motif comprises at least one of (P,F);

a tenth motif comprising [X][J]TAYKP[B] (SEQ ID NOS: 35304-35323), wherein X in the tenth motif comprises at least one of (W,L), wherein J in the tenth motif comprises at least one of (A,N,S,W,E), and wherein B in the tenth motif comprises at least one of (S,F);

an eleventh motif comprising [X]A[J][B]AP[Z]I[O][U] (SEQ ID NOS:35324-35803), wherein X in the eleventh motif comprises at least one of (N,W,A), wherein J in the eleventh motif comprises at least one of (F,N,Y,P), wherein B in the eleventh motif comprises at least one of (P,H,Y,W,A), wherein Z in the eleventh motif comprises at least one of (Y,A), wherein O in the eleventh motif comprises at least one of (W,Q), and wherein U in the eleventh motif comprises at least one of (R, Q); and a twelfth motif comprising H[X][J]QP[B]AQEP (SEQ ID NOS:35804-35839), wherein X in the twelfth motif comprises at least one of (E,G,W,F), wherein J in the twelfth motif comprises at least one of (G,A,N), and wherein B in the twelfth motif comprises at least one of (H,W,K).

10. A therapeutic composition for improving a Toll-like receptor (TLR)-related condition, the therapeutic composition comprising a peptide configured to modulate TLR-related functionality and derived based on reengineering of a target peptide sequence associated with a microorganism-related modulator associated of a TLR, wherein the peptide corresponds to a peptide sequence comprising a combination of at least three motifs from a set of peptide sequence motifs, wherein the peptide corresponds to the peptide sequence comprising nXX[MOTIF1]nX[MOTIF2]nX[MOTIF3]XXn (SEQ ID NOS:35984-37711), wherein X comprises any amino acid type or no amino acid, wherein n comprises any number and type of amino acid, and wherein the set of peptide sequence motifs comprising:

a first motif comprising XXGFXLKXX (SEQ ID NO: 1), wherein X in the first motif comprises any amino acid type or no amino acid;

a second motif comprising XXTPA[Z][B]XXX (SEQ ID NOS:2-5), wherein X in the second motif comprises any amino acid type or no amino acid, wherein Z in the second motif comprises at least one of (N,D), and wherein B in the second motif comprises at least one of (N,E);

a third motif comprising [X][Z][B]APW (SEQ ID NOS: 6-245), wherein X in the third motif comprises at least one of (I,F,W,Y,A), wherein Z in the third motif comprises at least one of (D,A,Q,E,G,H,I,L,F,P,T,Y), and wherein B in the third motif comprises at least one of (Q,L,W,Y);

a fourth motif comprising PP[X][Z][B][O]P (SEQ ID NOS:246-693), wherein X in the fourth motif comprises at least one of (Y,P), wherein Z in the fourth motif comprises at least one of (W,Y,F,A,V,C,T,L,S,H,Q,E,G,I), wherein B in the fourth motif comprises at least one of (W,I,F,P,D,G,C,A), and wherein O in the fourth motif comprises at least one of (G,N);

a fifth motif comprising [X][Z][i][O][B][J][f] (SEQ ID NOS: 694-35253), wherein X in the fifth motif comprises at least one of (G,Y,W), wherein Z in the fifth motif comprises at least one of (W,V,I,F,R,M,S,L), wherein i in the fifth motif comprises at least one of (I,G), wherein O in the fifth motif comprises at least one of (Y,P,H,L,F), wherein B in the fifth motif comprises at least one of (I,D,Y,F,V,T,G,A,Q), wherein J in the fifth motif comprises at least one of (F,R,C,L,A,Q,D,V), and wherein f in the fifth motif comprises at least one of (F,Y);

a sixth motif comprising F[X]PPAP[J] (SEQ ID NOS: 35254-35269), wherein X in the sixth motif comprises at least one of (P,S), and wherein J in the sixth motif comprises at least one of (P,Y,L,A,E,G,V,I);

a seventh motif comprising DFT[X]FPP (SEQ ID NOS: 35270-35271), wherein X in the seventh motif comprises at least one of (V,I);

an eighth motif comprising [X]TPA[J]F[B] (SEQ ID NOS:35272-35283), wherein X in the eight motif comprises at least one of (Y,T,H), wherein J in the eight motif comprises at least one of (H,I), and wherein B in the eight motif comprises at least one of (Y,A);

a ninth motif comprising [B]AR[X]TP[Z]SPP (SEQ ID NOS:35284-35303), wherein B in the ninth motif comprises at least one of (P,A), wherein X in the ninth motif comprises at least one of (A,P,W,N,L), and wherein Z in the ninth motif comprises at least one of (P,F);

a tenth motif comprising [X][J]TAYKP[B] (SEQ ID NOS: 35304-35323), wherein X in the tenth motif comprises at least one of (W,L), wherein J in the tenth motif comprises at least one of (A,N,S,W,E), and wherein B in the tenth motif comprises at least one of (S,F);

an eleventh motif comprising [X]A[J][B]AP[Z]I[O][U] (SEQ ID NOS:35324-35803), wherein X in the eleventh motif comprises at least one of (N,W,A), wherein J in the eleventh motif comprises at least one of (F,N,Y,P), wherein B in the eleventh motif comprises at least one of (P,H,Y,W,A), wherein Z in the eleventh motif comprises at least one of (Y,A), wherein O in the eleventh motif comprises at least one of (W,Q), and wherein U in the eleventh motif comprises at least one of (R, Q); and a twelfth motif comprising H[X][J]QP[B]AQEP (SEQ ID NOS:35804-35839), wherein X in the twelfth motif comprises at least one of (E,G,W,F), wherein J in the twelfth motif comprises at least one of (G,A,N), and wherein B in the twelfth motif comprises at least one of (H,W,K).

11. The therapeutic composition of claim 1 or 4, further comprising a carrier configured to at least one of encapsulate and covalently-conjugate with the peptide, wherein the carrier comprises at least one: a micelle, a polymer, a liposome, a dendrimer, a metallic nanoparticle, a microsphere, a polyelectrolyte complex, an emulsion, a hydrogel, and an injectable polymer.

12. The therapeutic composition of claim 11, wherein the peptide is modified, to improve stability and prevent degradation, with at least one of: an unnatural amino acid, acetylation, and PEGylation.

\* \* \* \* \*